United States Patent 12,390,499 (BACTERIOPHAGE FOR MODULATING INFLAMMATORY BOWEL DISEASE) - sequence listing, part 4

SEQ ID NO: 73 - DNA, 86716 bp, Unknown
  source: /note="Description of Unknown: KP2-Mcoc1 Bacteria Sequence"
ctgcagagtcaagcatttatttttgcttttctctgcgaggttctcaccggaaccccgctgacccggcggcttgtttgccgttgttccgtgtcagtggaggcgcattatagggagtaattctgaggtggcaaggggaaatgcaaaaaaacttttcgttcgctcgattttccatcacaacgcgagttttacgcgctatttgcgcgccatttgtgcgatttcccgagcaaaccgggatacctgttgccagtcggtatagaccacttctttgcgggtatccgtttcacccccggtcattttcataatcaggcggatcataaaccgatcgtaccagctgtagcgcgggtagcgcagcgcgccggcaaataccgcgcagctctgcggctgccacggcgagttcagcagaaacttacgcgtatagctgttggtctgcggcgtgcgcttctcgggtttacgcgccaccaggttaaccgaaaagaatgcccccggcagcgcctgcaatgctgccagatgctttttcacaaagcggtccaccgccggatgaaagtgcccatagcgaatcgacgcgccaatgaccacccgatcgtagtgatgccattcgacgacatcggtacggttcaggttcagggtgtccgcatcgatgcccagctctttaagctcagaggcgagaaacgaagcgatttcacgggtctgcccgtcgcgggtggagaagagaattaaagttttcacgagcactcctgttattcgcgccagaaagtgggggtaaagagcaccagtaaggtgaacacttccagacgaccaaacagcatattagcaatcaggatccatttcgcgaccgggttcatggtggcaaagttatccgcgacgacgccgagcccaggcccgaggttgttcaatgtcgccaccacggaggcgaaagcagagaagtcatccaccccggtggcgataatcgccagcatactaatgataaagaccagcgcataggcggagaagaatccccatactgcttccagaatacgttccggcagcgcgcggttacctaatttaatgctatacaccgcattcgggtgcaccagccgcttcagctcacggttgccctgcttgaacagcaacaggatacggatcacttttaatccaccgcccgtggagccagcgcagccgccgataaatgcggagcacagcaacagcaccggaaggaacagcggccagcgtgcaatgctatcggtggtgaaccccgcggtggtcgccatcgacaccacctggaaaaacgcctggttcagcgtcgtcaacaccgagccgtacacgttatgaagccatagcaccagcgtacagacgatgaccagcgtcaactggacgccaatgaacatcctaaattcagggtcgcgccagtacaccttcaggctgcgtccgctcaacaacgaaaaatgcagaccgtagttacagccggagatcagcaggaagatggcaatgatggagttgatcatcgggctgttgaaatagccgacgctggcatcgtgagtcgagaaaccgccgatggcgatggtggcgaaactgtgcccgatcgcatcgaacgccggcataccggcaaaccagagcgccaatgcgcaggcgatcgtgagtaacacatagatgagccacaatgtcttcgccgtctcggcaatacgcggacgcatcttgttatccttcagcgggccgggcatttccgcgcggtagagctgcatccccccgacgccgaggataggcagaatcgctaccgccagcacaatgatccccatgccgccgaaccactgcagcatctggcgataaaagaggatagcgtgcggaagcgagtccagccccaccagagtggtcgccccggtcgtcgtcaggccggaaaatgactcgaagaaggcatccgtcaccgtcaggttcggctgttcggagaagataaagggcaaggcccccacgctccccagcacggtccagaacagcaccacgatcagaaacccttcacgagatttcagttcgcctttttgcttacggttcggccaccacagcatggagccgatcgccagagcgacaaagaaggtttgagtgaaggcccgtcccgcgccatcgcgatatatcagggccactaatcccgggacgatcatcgtccccgaaaacaagatgaccagcagtccaacgattcgggttatggcgcgaaaatgcatctctggcgcttcctttgataggcaaaaaacagaggggattattcgttaatcttcagtaattgcaatgaaccacgactaaaatcagccagtcttgctgaaaaagccgccacttcggcctggggaagcgccacgcgcagccgaactgacgccagatattcgctttcaacgacgtttccggagaattgggcgagcagcgcttcgacgccggccagttgcccatactcacactgcaaagtatatgccgttaacggcgtcttgcgcagcgtcgtcagctgcgccagcgcctgatgcaccccgccgccataggccttaaccagaccgccggtgcccagcaggataccaccgtagtaacgcacgacgacagcggttatctcgccgacgccgcttcccatcagctgcgccagcatcggtttacccgccgttcccgccggttcgccatcgtctgaaaaccccagctgttgcgaatcatcaggcggccccgcgacccacgccacgcagtggtggcgggcatcagggtgatccgctctgacggactcgacaaaagcttttgccgccgccacgccgtcggtatgcgccaacagcgtgataaaacggctttttttaatctcctcaacgacggtaaccggcgccgccgggattaaccagctctccatcaggccagcttcagatcgcgcgtcatattttcgatactgttttcgtgaatcaccacgttatcttcgatacggatcccaccgaacggcttcatggcgtcaattttttgccagttaaagtgcttgctgaacgggccctcacgccacggcgccagtaacgactcgatgaagtagatgccgggttcaatagttaacaccatccgcggctcgataatacgggtgcagcgcagatacgggtatttcgacggcgccgccagatgcgtaccggtgtcatcctgcataaagccagcgacatcatgcacctgcagacccagcggatggccaatcccgtgcggcataaacggcccggtcaggtcattctccaccatcgcctcttcgctcatgtcggtaaccaactggtgtttacgcaacagcttcgcgatacgctgatggaactggatatggtaatcaatgtaactggtaccggccttcatggtactaatcagcgcctgctgctcatcgttaacgtctttgatcagatgggcaaagtcgttatcgccgtgcgccgcccaagtgcgcgtcagatctgcggcatagccgttatattccgcaccggcgtcgagcaggaaactgcgcatctccgccggggcacgatggtccagtttggtgtagtgcaggacggaggcatgctcattcagcgcgacaatattgctgtaaggcacgtcggtatcacgatggccggtggcggtgagataggcctggttgatatcgaattcgctcattcccgactggaaagcttcgtaggccgcacgatgaccattcaccgccgacttctgcgcttcacgcatgcaggccagctcgtaatcggttttgtaagcccggtagtaatgcaggtagtcgataacccctttcgggttgatcttatccgcggcgatacccaggcccagcgcgcgctcaggcaccggaccgatatagccaatattaccgcgagcagcaggcagctggctgccgatgccatcggccttcggtagcgcgatcacgtctatctcttcggtccagaaagaggtcggcaacggctcaacgttatgccagtaatctaccggcagatagaaccacagcttcggtttattcacaccgtccaccagcagccagcagttaggcacctgagtcacaggcacccaggctttgaactgcggattgaccttgaacgggtacggatggtcatcaaggaagacgttaaccagctcgccggagtgaatcagcagagcatccatttgaaaacgggccaggacgtcgcgggtacgttcttgtagggtaacaatatgatttttatagagcgcggccagggattccatcttttatcctttgcttttatgggatcgtgatacaccgcatcttagcacatcgacctgcgtgcgggtgatttccgccggatgtgatccgaccagcaattatttaaagagtaatttgcaattctttaacataaattccacactccgtttcatctggtatgaccagatcatattgctggattcaggagactgacatgctctacaaaggcgacaccctgtacctcgactggctggaagatggcatcgccgaactggtgttcgatgccccaggttcggtcaacaagcttgataccgcaaccgtagccagcctcggtcatgcgctggacgtactggaaaaacaaagcgatctcaaaggtctgctgctgcgctctgaaaaagcggcatttatcgtcggcgcggatatcaccgaattcctctcgctgttcctggtccctgaggagcagttaagccagtggctgcattttgctaacagcgtcttcaatcgtctggaagatctccccgtccccactatctctgccgtcaatggctatgcgctgggcggcggctgcgaatgcgtgctggcgaccgactatcgcctcgccacgccggctctgcgcattgggctgccagaaaccaagctcggcattatgccgggcttcggcggttccgtgcgtctgccgcgcctgctcggcgccgatagcgcgctggaaattattgccgccgggaaagacgtcggcgccgatcaagcactgaaaatcggcctggtggatggcgtggtcgctgcggaaaaactacgcgacggcgcgctggcgatcctacgtcaggccatgaatggcgacctggactggaaagcgaaacgtcagccgaagctggagccgctgaagctcagcaaaattgaagccgccatgagcttcacgattgccaaaggcatggtcgcgcaaaccgccgggaagcattacccggcgccgatcaccgcggtcaaaaccattgaagccgccgcgcgtcttggtcgtgaagaagccctggtgctggaaaataaaaactttgtcccgctggcccataccaatgaggcccgcgcgctggttggtatcttcctgaacgaccagtacgtcaaagcgaaagcgaaaaagctgaccaaagatgtcgagacgccgaagcatgctgccgtcctgggcgctggcattatgggcggcggtatcgcttaccagtcagcctggaagggcgtgccggtggtgatgaaagacatcagcgacaaatcgctgacccttggcatgaccgaagcggcgaagctgctgaataaacagctggaacgcggcaaaatcgacggtctgaagctggccggagtgattagcaccattcagccaaccctggaatacagcggttttgaccgcgtggacgtcgtcgttgaagcggtggtggaaaacccgaaagtgaagaaagccgtactagcggaaaccgagtcaaaagtgcgcccggataccgtgctggcgtccaacacctcaacgatccccatcagcgagctggccagcgttctgcagcgcccggaaaacttctgcggtatgcacttctttaacccggtgcatcgcatgccgctggttgaagtgatccgcggcgaaaaaacctcggataataccattgccaaagtggtggcctgggccagcaaaatgggcaaaacgccgattgtggtgaatgattgtcccggcttcttcgtcaaccgggtactgttcccctacttcgccggcttcagccagctgctgcgcgacggggcggacttccgcaaagtcgacaaagtgatggagaaacagtttggctggccgatgggcccggcttatctgctggacgtggtcggcatcgataccgcgcaccatgctcaggcggtcatggcggcgggcttcccgcagcggatgcagaaagattatcgcgacgccatcgacgccctgtttgacgccaaccgtttcggccagaagaacggcctcggcttctggcgctataaagacgacagcaaaggtaagccgaagaaagaagaagatgctaccgtcgacagcctgctggccgacgtcagccagtcgaagcgcgatttcagcgatgaagagattatcgcccgcatgatgatccccatggttaacgaagtcgtccgctgcctggaagaaggcattatcgccagcccggcggaagcggatatggcgctggtatacggcctgggcttccctccgttccacggcggcgcattccgctggctggacaccatcggcagcgcgaagtatctcgatatggcgcagcaataccagcaccttggcccgctgtatgaagtgccagccggtctgcgtgacaaagcgcgccataacgaagcgtattatccccaggtagagccagcccgtccggttggcgctctgaaaacggcttaaggagtcacaatggaacaggttgtcattgtcgatgcaattcgcaccccgatgggccgttcgaagggcggcgcatttcgccacgtgcgcgcggaagacctctccgcgcacctgatgcgtagcctgctgtcgcgcaatccgtcgcttgaggcaagcgcgatagacgatatctactggggttgcgtgcagcaaaccctcgagcagggttttaacatcgcccgaaacgcggcgctgctggcggagatcccgcattcggtaccagcaaatacggtcaaccgtctgtgcggttcttccatgcaggcgctgcacgatgcggcccgtatgatcatgaccggcgatgccagcgtctgcctgattggcggcgtcgagcacatgggccatgtgccaatgagccacggcgtcgatttccatccgggcctcagccgcaacgtggcaaaggcggcagggatgatggggctgactgcggagatgctggcgcgtctgcacggtattagccgcgagatgcaggatcagttcgccgcgcgctctcacgctcgtgcctgggccgcaacccagtccggcgcattcaaagcggagattatccccaccggcggccacgatgccgatggcgtactcaagtcctttaactatgacgaggtgatccgcccggaaaccaccgtcgagacgctgtccacgcttaaaccggcgtttgacccggtgaccggtacggtaacggcgggtacctcttccgccctttccgatggcgcagcggcgatgctgctgatgagcgaaagccgcgctcgcgagctggggctgaagccgcgcgctcgcgtccgttcaatggcggtggtcggctgcgacccgtccattatgggttatggcccggttccggcctcaaagctggcgctgaaaaaagcgggcttatccaccagcgatatcgacgtttttgaaatgaatgaagcatttgccgcgcagatcctaccgtgtattaaagatctgggcttaatggagcagatcgatgagaagatcaacctcaacggcggggcgatcgcgctcggtcatccgctgggctgttccggggcgcgtattagcaccacgctgatcaaccagatggagcgcaaagacgctcagttcggcctcgccaccatgtgtatcggcctgggacaagggatcgctaccgtgtttgagcgggtttaagcgaaagggtatctcaacgccattgccaccagaacctggcggctatggcgaagagagcaggtttagttgccgttcttcccgcctgtcaggggcgggttttttattttcagataaacgcaaacgcatcgccaaacaggcgatcttcacgcgcgccgcgctcattacagaacaggtcgcgagcgatcttcgccatctcaaaacgaccggcaatgtagatgtcatgctcggccagcgtaccgtaatcctgcagcacggcggtgagtaccgtaccggagcgaccacgccacccttcttccggctgttcgaccaccggctcgatgcgcagattcggatgcttgatgcttaacgcttccagctcggccagatcgtacagatgcttagcctcgcggccgccccaataaatggcgatatcgcgatccgggttacgcgccagcgcgcttaacagaatagaacgcacataagagaatccggtaccgccggcgatcagaatcagcgggcgatcttcgtcatcgcgcagccacgcttcgccatgcggaatatcaacctcaatttcacgctctttcagaatgcgatccatgaccgccatcgcgtacagattgagctccgaggcgccgatatgcagctcgataaattcctgttccgccggcgtggaagccatggagaacgggcgcttgtcgcgctcatccattaccaccatcagatactggccggcacggaaggaaaatgccgcttccggcactaatcgaacacgatatacggtatcggtaatcgcctccaccgaggtcactttacagcttaaggttgtcatgcgtcccctctgtcgggtcaatagagcaaaacagcggcgttagccccgcttactgttgtttaaagatggccagttcatcccagatggcgtcaatacgcgccgtaacggcaggatcttttttgattgggcgaccccattcacgctgggtttcgccaggccatttattggtggcatccagccccatttttgaacccaggccggaaaccggcgaggcaaaatccagataatcaattggcgtattctctaccagtaccgtatcacgagccgggtccatacgggtagtgatcgcccaaatcacatcgttccagtcgcgtgcattgacgtcgtcatcgcagacaatcacgaacttggtgtacataaactggcgcaggaacgaccagacgcccatcattacgcgcttggcatgtcccgcgtactgttttttcatggtcaccaccgccaggcgataggagcacccttccggcggcagatagaaatcaacgatttccgggaactgcttttgcaggatcggcacaaagacttcattcagcgccacgcccagcaccgctggctcatcgggcggtcggccggtataggtagaatgataaatcgcgtcttcacgctgggtaatatgggttaccgtaaataccgggaagctgtccacttcattgtagtaaccggtgtgatcgccatacgggccttccggcgccatttcaccggcctcaatgtagccttcaagcacaatttccgcgctggccggcacttcaaggtcattggaaacgcacttaaccacttcggtcttggtgccgcgcagcaggcctgcgaaagcatattccgacagggtatcgggcaccggcgtcaccgcgccaagaatggttgccggatcggcgccaagcgccacggaaaccgggaagcgttcgcccggacgcgccgcgcaccactcctggaaatccagcgcgccgccgcgatgagacagccagcgcataatcagtttgtttttgccgatcagctgctggcgataaattcccaggttctgccgctctttgtgcggcccgcgggttaccgtcaacccccaggtgatcagcggcgcggcatcttccggccagcaggtcataatcgggattttattcagatcgacatcatcgccctggatgattttttgctgacagggggcgccgcgcaggcgtttggtcggcatattcagcacttgcttgaactgcggcagcttatcaaacaggtcgcggaagccttttggcggctcaggttctttcagaaaggccaacagtttacccacctcgcgcagcgaactgacatcctcctgccccatccccaacgccacgcgacgcggcgtgccgaacagattgcacagcaccggcatggtatagcctttcggattctcaaacagcaacgccgggccgccggcgcgcagagtccggtcggcaatttcggtgatttccaggtgaggatcgaccggcagagtgatacgttttagttcgccctgttgttccaggagtgtcagaaagtcgcgaagatcgtgatatttcatggaagtgttattgacctctctacaggcggctaattatacggtgttcgacggcgcgatgctgtaattttgttaaattagcgtgaaagaacgctgaaatttggatttcaattataatggctttcgcgattacaccagccatttgttatgcttgccgttattagaagtggaatgagtcattatgcaagcctggtacttactgtattgcaaacgtgggcagctacaacgagcccaggaacatctggaacgtcagtcagttaactgcctgatgccgacgattgcgctggaaaaaatcattcgcggtaaacgcaccatggtcagcgaaccgttgttcccgaactacctgtttattgagttcgatccagaggtgattcataccaccaccatcagcgccactcgcggggttaacaacttcgtgcgctttggcgccctacccgctatcgtcccctcggcggtcatccatcagctttctatctacaaaccggaagggattaccgacccggaaacgccgcatgagggcgatagcgtgctaatcaccgacggcgcgtttgaaggcctggaggcgatcttcaccgagcccgacggcgaagcgcgctctatgttgctgttaaacctgctgaataagcaagtcctgcagagcgttaaaaataccgacttccagaaaatctaaacgccgttaatgtcgacgccaaacagcgccctgacgtttgcgtccgtttgcgcctccagccattgcgcctcctcgccgcgccaggccgcgacgctggccaggatatgcggcaaatacgcgggctcgttacgccgcgaggccggtttcggcttgagatcgcgcggcagcagataaggcgcatcggtctccagcagcagacgttccgccgggatcgccggcagcagctcgcgcagctccagtccccgccgctcatcgcaaacccaaccggtaataccgataaacaggcccagatccaggcattcctgcacctcgctgcggctgccggtaaagcagtgcagcaccgcgcccgggagcttctcaagccagggtttaagcagcgtcagaaaccgatcgtgggcgtcgcggcagtgcaaaaacaccggcatcgacagctcagcggccagcgccagctgggcgctgaacgctacctcctgctcgtgcggcgtggaaaaattccggttaaaatccagaccgcactcgcctatcgccaccacctgcggctcgccggcgagggtataaatcgcctcggcgaccgctggcgtccagctgctaccgtcatggggatgaacccccgccgtggaccagcagccggaatagcggctcgccagtttctgcgcctgctggctctccgccaaatttgtgccggtcagcagcatgccgttaacccccgccgccagggcgcgcgccactacctcatcatgatcgcgggaaaactgcgaactggtcagattaacgccgatatcaaacatgatcgctcccatatgccaaccgccctgacgggcggttggcggtattactcttctctgtgctctgcggcttcagcttcggccgcggcgtcgtcatcgcgcgtcaggcgcttcccggtgtagaagcgggcaaagaacaccccgacttcaaacagacagtacatcggaatggccagcagtgtctgcgagaatacgtccggcggcgtcagcagcatgcccaccacgaaggcacccaccagcacatacggcctttttttacgcaagtcttccggcgtggtaacgcccatccagcagagcaacacaatggcgaccggcacctcaaaggagaccccgaatgccataaacagcgccatcacgaagtcgagatagctgcgaatatcggtcgagaccagcaccccttccggcgccgcatgggtcaggaagccgaacgccagcggaaacacgacaaaataggcgaaagccatgccgatatagaacagcagggtactggataccagtaaaggcaccaccagccggcgttcgtgcttatacaacgccggcgcgacgaaggcccatacctggtaaagaataatcggcaccgacaggatcaccgacaccatgaaggtcaactttatcggcgtaaagaaaggtgaagcgacatcggtggcgatcatcgtcgcgcccacaggcatcttactgataagcggggccgagaccagctggtagatatcattggcgaaatagaccagcgccaggaagatcaccagaatagcaatgatgctgttgagcagacgcttgcgcagctcaatcagatgcgaaattagcggttgtgtatcgtctacgcccatgtttacggtttatcactcgatgcgggggaagaatggggaactgccgccgtagcggacgttttctctgcctgaaggtcagccggtgaagcagattgctcggcggcaacgggatctggcgcatgagccggagcgctggcctgatgttctgccgtcgccggcgtgacgtcctggcgctgcgcttcgctgcctttgaccaccggattaaggatggtattggcttcgtcgctggctttttcgggatcgtgggcgctataggagcgcttcatcgactccgcggcctcgcgcagttcatccatcgaggctttcagctccggcgtcaggttattcaggctagccttttccaccttcttcaggctctcctggaactcctgcagttttagctcctgggccagctcattttgtaccgtggtcgccagcgagcgtaacgtacggatccagccaactaccgttttaaccgctacgggaagccgctgtggccccagaacaatgaggccaatcacaaacaccagcagtagttcactaaaaccaatatcgaacacgagttacacctgctctttgtcgtggcgttttgtctcgtctttttttgcatcatcctgtttatcggcgatggttttcgccgtgaaatctgcgtctggcgccgacttttcgggtttatcatcatcactcatagcttttttaaagcctttgatagatgcccctaagtcagaccccagcgagctcagcttcttcgtcccaaaaagcagaactacgatgacgacaacaattaataactgccaaatactgataccacccatacacgttcccctatgacagatgatgaattgtgtggacgcattatacacgccatcctgcgagccgcctcttcgtcaggccgccgacatgattttgcgcaaataagcctgcgtcatgaagaggcgaaccgatcagtgggttttccgccagccaataagccaggtcaccacaccgccggccatcagccaaccgggcatcattccccactcagggcgatggataaagagcagcgtaccactgagcaataaaaccgcgcctataccaaacaggtaacgggattggccctggcgcacatgacgcacatgcatatcccgcacaatagtatcgacgctggtctgcagctgtttactctgctgcaggctctgatacaccagctcaggtatttccggcattctttcgatccagaacggcgctttgtctttaaacgcgcgcaccagcgccggaatgccgacctgatctttgatccacgactcgaggaaaggcttcgccgttttccacaagtctaactgaggatagagctgccggcctaccccttctacgtaaagtaatgtcttctgtagtaaaacgagctgcggctggacttccatattgaaacgccgcgcggtattgaacagattaagcagcacgtggccgaaggagatctccgccagcggcttctcaaagatcggctcgcagaccgtgcggatcgcgaactcaaactcttcaacgttggtatcgggcggaacccaaccggaatcgacgtgcagctcggcaactttacgataatcgcggttgaaaaaggcgataaagttttccgccagatagcgcttatcttctttgttcagtgagccgacaataccgcagtcgatgccgatatactgcggatcttccggatgctcgtagctgacgaatatgttgccaggatgcatatcggcatggaagaagctgtcgcggaacacctgggtgaagaagacctggacgccccgctccgccagcagctgcatattggtgccctgggcctccagcgcctccacatcggacaccgggataccgtaaatgcgctccattaccatcatgctttcgctgcagtagtcggggtacacctccggcacgtacagcatcgggctgtcttcgaaattacgccgcagctgaatagcgttggcggattcccgcagcaggttcagctcatccagcagcgttttttcatattcacgaactacctcctgcgggcgcagacggcgaccgtcaggcagcagacgcggtacccagcgcgccaggcggtagatgagcttcatgtccgctttaatgatcggcaaaatatccgggcggataaccttgatcaccacctctttgccattctctttcagacgcgcggtatgcacctgggcgatggacgccgaggctaacggctcaacggagaaatcatcaaaccaggtctcgaccggcagcccccccatcgctttctctatctgctgctgcgcgagcttcccttcaaagggcgccacgcggtcctgcaacagcgccagctgatcggcaatatgcggcggaaagagatcccggcgggtggaaagcatctggccgaattttatccacaccggccccagctcctggagcgccagccgaaggcgggcaccaagaggctgatcctgatggcggtttggcatccagaacagcatccgccgccagatacgcagcggcagcgtgatccgcattttggggatgagctcatcgagcccgtagctcaaaaaggtgtggatgatgaaatacaggcgccgtaattctcctggcgtcatttgccctccagcgtttccagccgtttttccagtgcggccagcgcgcgctcaatagccgttgtctcttcagcaaaccaggccagctccagcggccccggcgccaggcgccactcttcagtgatcgcttccgcgacatagcgctgctggcgctctgcccccttcagcagaaactgagcgccgccgcgcaggactttaccgacgccttcggccacaatatcgccggtatagggcgccagcagttcagcgggatcaaactctgccaggtcgcacagggagaccatattctgcaccacctgcagatcgccctgcacttccagatcaccgctgcgaataagcgccgtgagctgctgacgattgcgcagttttggcagcacgctgagccgggtaatcacggtgcaatcggcctctccgtcccaggcgctcaggacgtcaacctggcgttcgctgaataccagcaccacgggcgtggcgaaatcctgcagctggacccgcaataccttgcccagcaggcgctggcgagcgggtttaagcgctttgtcgcgccagaggaaagtattcagcgccgtttcaatgccagcggtaaccaggggtgtgaaaggcatagcgtccctcctgtcagaacttgtaaccgcgatgcaaagcaacgatacccgccgtcaggttgtagtaatccacgttttcgaagcccgcatcctgcatcatccctttcagggtttcctggtccggatgcatacgaatagattccgccaggtagcgatagctgtcgccatcttttgccaccagctcgcccaccttcggcaggatatggaaggagtaagcgtcgtaggctttgctcagcggttcgataatgggtttagaaaactccagcaccagcagacgtccgcccggcttcagcacgcgatacatcgaacgcagcgctttctctttgtcggtcacgttacgcagaccgaaagagatggtgatgcagtcaaaggtattatcagcaaaaggcagggcttccgcgttggcctgaacatactcaacgttgcctacgatgccgatattgcgcagcttttcgcggcccattttgagcatagaatcattgatatcagcaagcatgacgcggccggtttcccctaccaggcgggagaacttggccgtcaaatcaccggtaccaccagccagatccagcacggtctgcccgcgacgtacgccgctgcagtcgatggtgaaacgcttccacaaacgatggatcccaaacgacatcaggtcgttcatcacatcatattttgcggcgacagaatggaatacatgcgccaccatatctgctttctgctctttagcgaccgtctgaaagccaaagtgcgtcgtttcttgtgaatcctcaaccatctctatgcctgcttgcttttcaagaaaatgttcactgagtgtatcagactcagcgcatttcccatacgtttcagcatggcggagccgcctcccggctacgcaccgtctcggcagagtcgggtgaaaatgcgtcattttccggcaggttatcctcatcttcgagacgatattgctcgtcctgagccgtagcttgttcgactaaatcaggattaatcccgcgcttgacctccacgcccaggccgcgaaaggcctccgcctgggccagcagattaccacgcccggaagcgagctttttcatcgcctggcgatagctctcttgcgccttatccaggctctggccgatggcggacatatcatccacaaacaggcgcattttgtcgtaaaggcgccccgcccgctcggcaatcttttgcgcgttacgactctggtgctcatagcgccacagattggcgatagtgcgcagggctaccagcagcgtcgtcgggctaaccagcataatattattttgcagcgcctcgctgatgagctcaggctggcgatcgatggccagcaggaacgccggctcaacgggaataaacatcagcacatagtcgagcgagcgcaggccaggcagctgttgataatccttgcgtcccagcaggcgaatatggttacgcaccgaggcaaggtgttcctgcagcgcgacttcgcgggtgtagtcgtcttcggcgttgaaatagcgctcataggcgaccagggtcattttggcgtcgatcaccacgtccttaccctgcggcaggcgcacgataacgtccggctgcatccgcgagcggttgtcggtctcaatactgacctgagtctggtactcatagccttcgcgcaggccggaggcctccagcacgcgggttaagaccacttccccccagttgccctgagttttgttatcccccttcagcgctttggtcaggttcagcgcctcctgtgccatctgcgcgttcaactgctgcagattgcggatctcatgcgccagggtatgtctttcacgcggctcctggccaaagctctcctgcacctggcggcggaacccgtccagctgttcgcgtagcggcgtcagcaggccatgcaggctctggcggttttgctcatcgacccgccggttgctgtgttcgaaaatacggttggcgaggttttcaaactgctcgctaaggcgctgctcgctgttcatcatctggcggatcttatcttccgcatgcagctgggtggattcgagccgggtggtgacctcacggagatcggcctcgagcgaggtattgatatcccgtaggctgcgcagctcgttgttcagcagctcacactcctcacgccagtgggcctcctgcgccagttgctggcgggcggcgctcagctcaatatccaactctcgccgttcctcgatgagatcggcccgaatttgatcggcgcgcgctttggtcgccagccagccgaccattaacccggctgccagtgcgataaccgcgctgataataatggagagatccacgacgccccctgcgataacctgatgacacaaaatagaattgtgctgtacaaacgtccagtttaaaaggaatttcctgcgagaggcgacgcaaaaaagaaaggccggaggatccggcctgacagggaaagtgttgagttacagcagacgacgcgccgcttccacgacgattttcaccgcgtggctttcggtttgcttcatggtttcggcgttagggatctcttgctgggtacggttcacgataaccccagccaccatcccggcgcgcaggccctggctggcgcacatggtcagcagcgtggcggattccatttcatagttcatcacgcccattgcctgccactcttccattgagcccttgaagcggctcacgacgcggccggagaaggtgtcgtaacgctcctggcccgggtagaaggtatccgaggaagcggttacgccgatatgggtggtggcgccgattgatttcgccgcttccaccagcgcggtggtgcaggcgaagtctgcgacggccgggaattccatcggcgcgaagtgcaggctggcgccgtccagacgaacggaggcggtagtcaccaacacatcgccaacgttgatgtgcggttgaatcgcacctgtggtgccgatacgcaggaaggtacgcacccccagctgcgccagctcttccacggcgatggaagtcgacgggccgccgatgccggtagagcagacgatcactggtttgccgtccagctccgcgcgccaggaggtaaattcgcggtgagatgccagtttaaccggcttatccatcagcgcggcgatcttttccacacgctccggatcgccagggacgatagccagcgtagccccttgtaaatcgttcttggtgaggccgagatgaaaaacatcagacttggacataaaaaactcctctgtgggtcgaattatcagcagaagcaaaacggtactgtacagaagcccctggcaacattttgtgatgatagtcaccaagaccaataatagttgcagttgtttttcagtaaatagtgatacacatcacattaacaagttatattcatcatcacagaacaaaagatagccgctttcaggcactgtgctttattaccgcccgaactaaaggtaaagggtctatagttactgatgcgctaataaataagggtacggagaataccatgaccaccaccaagcaacctggattcgcacctgcagcttcaccacacgccgcaaccgccgttcatacgccggaagagcatattatcgccggagagacgtcgattccctctcagggtgaaaacatgccggcctaccacgcccgcccgaaaaatgccgacggtccgctgccgatcgttatcgtggtacaggaaattttcggcgtgcatgaacatattcgcgatctttgtcgccgcctggcacaggaaggctatctggctatcgcgcctgaattgtacttccgtcagggcgatccgaatgagtaccacgatatcccgaccctgttcaaagagctggtcagcaaggtgccggacgcgcaggtgctggcggatctcgaccacgtcgccagctgggcggcgcgccacggcggcgatgcccatcgtctgctgatcaccggcttctgctggggcggacgcattacctggctgtatgccgcgcataacccgcagcttaaagcggcagtggcctggtacggtaagctggtgggagaaaaatcactgaattcgccgaagcacccggtagatatcgccgtcgatctcaacgccccggtgcttggtctgtacggcgctaaagacgccagcattccgcaggacaccgtcgagactatgcgtcaggcgctgcgggcagccaacgccacggcggaaatcgtggtctatcccgaagccgatcatgcctttaacgccgactatcgcgccagctatcatgaagagtcagccaaagacggctggcagcggatgctcgcctggtttgctcagtatggcggtaaaaaagggtaatcgccctaagcatgaaaaaaggaggcaaatgcctcctttttgatttttcgcgtaacgattaggcggactggcgcagatttcgcgccgcttgcaccatattcgccagcgcggcgcgggtttccggccagccgcgagttttcaggccgcagtccgggttaacccacagtcgctccaccgggatacgctgcgcagctttcttcagcagcgcttcgatccactccacgctcggcacgtttggcgagtgaatatcatatactcccggcccgatctcattggggtactcgaacgcttcgaacgactccagcagctccatatcggaccgcgaggtttcaatggtgatcacgtcagcgtccagcgcggcaatggagtccatgatgtcattgaactcgcaatagcacatgtgagtatggatctgcgtgtcgtctttggcgaccgcagcattaaggcggaaggcttccacaccccactgcagataggcatcccagtcgctgcgcttcagcggtaacccttcgcgcagcgccggctcatcaatctggatgatgccgatccccgccgcctccagatccgccacttcatcacgcagggccagcgcaatctgtttcgcgatggtttcacggctgacatcctcccgcgggaaggaccagcacagaatggtcaccggtccagtgagcatccctttcaccggcttgtcggtcagcgactgcgcatacttcgcccagtcgacggtgatcgcctgcggacggctgacgtcgccgatcaccaccggcggcttcacgcagcgggaaccatagctctgcacccagccgttttgcgtgaagataaaaccgtccagatgttcgccgaagtattccaccatgtcgttccgctcggcctccccgtgcaccagtacgtctaaacctaaccgctcctgctcgacgatcgcctgcttaatatgttccgcaatccccgtccgataatgactggcgtcaaggttaccctttttgaagtccaggcgcaggccgcggatctcggtcgtttgcgggaatgacccgatggtggtggtcggccatttcggcaggttaaagcgctggcgctgtgcctgcgcgcgaacctcataggggctggcgcgctggctgtcctgagcagtgatcgccgccagccgtttttccacctccgcgttgtgcacgcgggtcgaatggcgacgggcctggattggcgcgctccactcggtaatcgccgctgtatcgccgctgttcagcgcatcgcgcagcagcgccagctcaccgcatttctgcagcgcgaaggcaaaccagctcttcacttccgcatcaaggcgcgtctccacgcttagatcgatcgggctatgcagcagagagcaggatgacgcgacccatagctcgcgcttaccgacgaggtctttaatttgcgcatacttttcggtgagatcggcgcgccagacgttacgcccattgatcaagcccgcggacagcagccagtcggccggcaggcggttgtgcagttcggcaacatcatctttgccgtgcaccagatcgacgtgcagcccctggaccggtagcgcagcaatggtcgcgagattgtcgctaacgccttcaaaataggtagtcagcagcagcttcacctggccctgcagggcgtcataagccggttgaaaggcctccagccacgctggcggcagctccagcaccagcgccggttcatcaatctgcacccaatcgatgccgcgcttcgccagttcggccagcacctgctggtaaaccggcaggatggtattcagcagggtcaggcggtcaaacggttcacctttcactttacccagccacagataggttaccggccccagcagcacgggcttgatcttgtggcccagcgccagcgcttcgtctacttcatccagcagttgggtccagctcagtttgaactgctggcccttcacgaactccggcaccatatagtgatagttggtgttgaaccatttggtcatttccgcagcggcggccggttcgccagtcggcgcgcggccgcggccaatgcggaacagggtatcgatgtcgatggatccgtctttgttctgatgacgagccggcacgttgccaagcagcaggctggtagtcagaacatggtcgtaccaggcgaaatcccccaccggcagcagatcaacgcccgcctgtttctgctgctcccagtgacgggcgcgcagctcacggcctaccgccagcagttcctcgcgagtggcgttgcccgcccagtagctctcttgcgcttttttcagctcgcggcgcaggccaacgcgaggaaaaccgagggtgtggttaataattgtcatttatgttcctctcttatttcattgaatctgaagaaaaaatctcaatagttcggcttgcaggaaggcggcaacgatgcgcatccccaggagcttactgaaggaagtgactggggtaagcaaggcagccaacgcatctgcaagtcgaaatatgacgagttttagacgtccagatgtttacacatccataattgacagttactgtatattcctcaagcgcaaattgctcatggcgaagtgaaggactttcatgatcgaaattaaacatctgaaaacgctgcaagcgttgcggaacagcggttcactggcgggtgcggcagcggccctgcaccagacccagtccgccttgtctcaccagttcagcgatctggaacagcgccttggctttcgtctctttgtgcgtaagagccagccgctgcgttttacgcctcagggggaaatcctcttacagctggccaaccaggtgctgccgcagatcgctcgcgccctgcaggactgtaacgaaccacagcagacccggctgaggctggctatcgaatgtcacagctgtattcagtggctgacgccggcgctggagaatttccgcgcccgctggccacatgtggaggtcgacttccattccggcgtcaccttcgacccacagcctgcgctgcagcagggtgaactggatctggtgatgacctccgatattctgccgcgcagcggcctgcactactcgccgatgtttgattttgaggtgcgtctggtgctggcgcccgagcatccgttagctatgaagacgctggttaccccggaggatctggccgcggaaacgctgttgatttatcccgtgcagcgcgggcgcctcgatatctggcgccacttcctgcagccggccggcatcagcccgcagctgaaaagcgtcgataacacgctgttgttgatccagatggtggctgcccggatgggcatcgccgcgctgccgcactgggtggtggaaagctttgaacgccagggcctggtggtcaccaaaaccctgggtgagggattatggagccggttgtacgcggccgttcgcgatggcgaacagcgtcaaccggtcaccgaagcgtttattcgctctgcgcggaaccacgcctgcgatcatctgccgtttgtccggagtgcggagcgacccagcggcgatggacccacagcgaggccaggatcaccaacgctccgctaataaagctcggccagtgcggctgctcctgccagatggcaaggttaaccagcagcccggcggggacatggacgttattcatgatccccagcgtgccggcatccacctgggtggcgccatagttccacataaagtaacccagcccggaagccaccacgccgagccacaccagcacgctccactgcagcgtggtggtcggcagcttctgggcgttgccgagcataaaccacgccgccaccgccacgataaaggccccgacatagaaccaggcaaaggcattgtgctgcggcatcggacgcacctccatcagacgcttataccccaccataccgatggcgaagcagaggtttgacagctgtaccagtaacagcccggtccagaaatgatcgctgactttgtcatagcggataatcgccgcccccagcaccgccagcgcggcactcagcagatagccccagcgcagcttacgtccgctgagcaggtcgtagatcagtgtgatatacaggggagtaaacacggtaaacagcagaaattccgagaccgtcagatagagataggcgcggaaagccagcaggtacatgatgcctagctgcatcgcgcccaccagcatatagagcacgatcgtgcgcggcgactggccgcgcgtgcgcaggaaaggcaggaacaccagcgccgccaggcccacgcgcatcagcaccgaaaaatagctgtcgacgctaccggccaggtattcgccaatcaggctaaaagaaaaggcccacaggatagtggtgataattaacagcgccacaatggtcgtctcgttggataaagaacaggcattgtagcgaagagtcaggttgacgactggacacttattcgccagtcgtcaatctttttcagtcgaggtatagcttacgcaggtagtgcgggacagcatcgtcggcgttactgccgatcacttccagttccggatgcagatccttcagccgctggtgggcgttggccatgatgcagcctttgccagccatcgacagcatctcagcgtcgttcataccgtcgccgaaggcgatgcaatcggaaagagtgtagccgagcatcttcgccaccgcctccagcgcatgccccttcgataccccacccgccataacttccaggcaggttaaggtggagaagctgacgttcacccgatcgccccagcgggcgttcatcgcctgctccagcggcagcagatgctcatgatcctcgcaggtaaagaatactttgctgatcccctgcggatccagttcgcccggctcatacagcttgtagttaaacaccgcctccttgaagaagcgcatctcttccggacgatggcggttcatataccactcgtcttcccgataaacgttagtgacgattttcgggtcgttacgcacgatctcaaacaggtcggcggcaatatcgcgatcgaggttatgggcaaagatttgctgaccatcgctatcgtgaacgcgggcgccgttagaggtgatcatgtacgaccggatgccgagattatcgcggatttgcccgacgtcgatgtagtgacggccggtggcgaagacgaaattgatcccacgggcggtaagcagctttagcgtctctttggcatacggggtcaggaaatgatcgggggaaagcagcgtgccgtctaaatcagacgcaacaacctggtacataaaaaagttaacctctaagcagggcgacgagcgttatcgtcggattaagtatgtcgattgaaaaactcgacgatggcattgagcgcgactgagcgcatagcgtccttttcaaaaaggatctcatgatatgccccttcaatgacgagcggtttaccgccctcacaaggatggccggcagcggcccgtaattcgcaatagcggtcgtgcatcagattatcgaccacccgctcctcctccgcctgtaaaagcagcgtcggggcggtatctttttccacattcgccagcacttcgtcgccggccagcatgccctcacgcacccagtgccaggtcggaccgccgacctgcagccgcggctcatcggcatagaagcgcaggttgcgacgatagcgttgccgactgtgcgtcagcacgttaacggcaaaaggcagcgcccgccagcgcccggtgccgatggcatactcttcgcgaatgcgctgatggccctcagcccagtcgagaatatggcgcaccatccagtccggcagccgaatgataatcccgaacatcggcgcgcagagcgctattgcatcgcaatgcgcccggtaacgttgcagaaaaagcgtggcaatcgctccgcccatagaatgagcaaggataaaccgttttcgccagtgtccaggaaccacctgctgctgccagagcgcggccaggtcatcaacatagtcgctgaagttaaccacgtgtccgcggtgggtatctgagagcaggcggcccgagcgtccctgcccgcgatggtcaatgatcatcacgtcaaagccgcagtgaaagagatcgtaggccacttcagcatacttcacgtagctttcaatgcgcccggggcaaatcaacaccagacgatcgttatgttgcgcgcaaaagcggacaaagcgtaccggtacatcgtcgacgcctttaaattcagcttcttcgcgctgtcgccagaaatccgtcagcggccccatgctaaaggccgcaaacgcgttttctcgtgtttcccagtcctttttctgcccaaacatcgggtttacacccctgttaaccgctgaaaatcgtttttttaccgtgtatcacacaatgctgacacaatagcgtattgtggcataaaaacagacaatcagggagtttctcatgaccattgagtggtggttcgcctacctgctgacatcaattattctcagcctgtcgccgggttccggagcgattaataccatgaccacttccattaaccacggataccgcggcgcggcggcgtcgattgccggtttgcagaccgggctggccattcatatcgtgctggttggcgttggtctcggcactctcttctcccgctcggtgctggcctttgaggtgctaaaatgggccggcgccgcctacctgatctggctgggtatccagcaatggcgggcggcaggggcgatcgacctgaatacgctggcgaaggcgcagacgcgcggcaaactgttccagcgcgcggtgttcgtaaatctcaccaatcccaaaagcattgtttttctggccgccctttttccgcagtttatcctgccgcaccagccgcaggtgatgcaatatctcgttctgggcgtcaccaccatcgtcgtcgatatcattgtgatgattggctatgcgaccctggcgcagcgcatttccgcatggatcaaagggccaaagcagatgaaggcgttgaacaaagtctttggttcactgtttatgctggtcggggcgctgctcgcctccgcccgccatgcctgaatcatggaatctcgctcgcaaagagaggttcgcgaggtgaacgacgctttctctctgcgcgagccggcgcgcaaagtgggtaattaattttattgcccgctgtcggcgctgaacccgccgtgccaggatgccgccagatacgtgattcatggatgaacggcaatggcggaaacggcgacccctcatgatgcggtatttaaaacttttctctcacgggtagagacggcgcgcgattttatcgagctccacctgcctccgtcgttaacacagatctgcaaactggacaccctgcgtctggaatccggcagctttcttgaagacgatctcaggccttactacagcgatatcctatattcgctggaaaccacccgcggtgcgggctatgtccatgttctgatcgagcaccagagcgcacccgataagctgatggcctttcgcttaatgcgctatgccatcgccgccatgcagcggcacctggagagcggccataaaacgctgcctctggttatccctattctcttctatcagggacgacgcagcccctatccctggtcgatgcgctggctggataattttgccgatcctgagaccgccagccagctctatagcggggcgtttccgctggtcgatatcacggtgatccccgacgacgacatcatgcagcaccgcagcatggcagccctgacgctggtgcaaaagcacatccgccagcgcgatatggcgcaattgctggataagttgacccacctcttaatgctggagcagatgagcggacaacaaatcaccgtattggtaaactatatggctcaggcaggggatgccgaagatactcggacactcttgtacgggctggcacagcgcgtgccgcagcatggaggattactgatgacgctggcggaaacatggcttgcagaaggtatggagaaaggcgtacagcagggcataaaagaaggtaaacaccaggctctggtgcaggttgccgaagcgatgcgcagtcgcggtattgatgaccaggcgattatggaaatgaccggtctgtctgaagacgagctgcagcggcttcgccactgatactttcccacccggaaacaaccgggtgggaaacagcatgccggttaacgcgagataatcaggtggatgccgaagcccgcaaacagcgtaccggcgataccgtcgatccacttcgccatccgctgatagccgcggcgcatcccgggcagggcgaacaggctggcaaccaccataaaccaggccagcgtctcaacgataatcagcaggaaaatgccccagcgcgcgccggcgccgacgctgtcacccacgaacagcgaaaacaccgagccgaagtagataatcgctttcggattcgccagattggtcagcaatcccttcacgaagctgcgtccgctgcgggccagctccacctgcggctccgccgaggccaccttctcttttttcagcgcgccacgcagcatctggtagcccatccagcatagatacaggcccccgccgaccattataatgttatgcagccacgccatccgggcgaggatcaggttcaggccgagcagcgccactcccgcccagaccatgacgccgcaggtgatccccagcacacccatcatcgcctctctgcgcgagcggctgatggccgtttgtgagacaaagaaaaagtccggccccgggctcatcagcgcaatgatatgcaccagcgccacggtgaggaaaagcatcagcatagttaactcgcaggaaaataatgaagagagaaactattctggcactttttcagccagctgactactcatcgtcgccatcaacatgcgcccgaatcagcgccataaacggcttcccgaaacgctcgagcttgcgtgtccccacgccgttgacgctgagcatttcgccggcggtcagcggcgattgttcggccatctcgataagcgtcgcgtcgttgaagaccacatatggcgggatgttctcttcgtcggcgatcgctttacgtaatttgcgcagcttggcgaacagtttacggtcgtaattgccgccaaaggatttctgcatcgcctttggcttcagcgccacgatacgcggcacggcgagctgcagcggcacttcgccacgcagcaccggtcgcgcggcttcggtcagctgcagcgcggagtgctgggcgatattctgcgtcaccagcccaaggtggatcagctggcggatcacgctcacccagtgctcgtgactttgctcccggccgataccgtaaaccggcagcttatcgtggcccatctctcggatgcgctggttgttggccccgcgcaggacctccaccacgtaacccattccgaagcgttgattgacccggtaaatcgttgaaagcgccttgcgggcgtccattaagccatcgtactgctttggcgggtcaagacagatatcgcagttgccgcacggctcctgacgcccttcgccaaaatagttcagcagcaccagacggcgacaggtctgcgcttcggcaaacgcccccatcgcattcagcttatgccgttcgatatcctgtagcggcccggcgggtttttcttccagacagcggcgcagccacgccatatccgccggatcgtaaaacagcatcgcttccgccggcaggccatcacgcccggcgcggccggtctcctgatagtaggattcaatattgcgcggaatatcaaaatgcaccacaaagcggacgttcggcttgttaatgcccatcccgaaggccaccgtcgccaccacgatctgcagatcgtcgcgctggaatttctcctgcacctcggcgcgcacgtcgttttccagaccggcatggtaagccgccgcgctaataccgcggctttgcagcctggcggcggtgtcttccactttcgaacggctgttgcagtagataatgcccgatttgccgcgctgatcctgaacgtagcgcatcagctgatcgagcggcttaaatttctccatcagcatatagcggatgtttggccggtcgaagctactgacctgaatcagcggatcgttaagccccagcaggcggacgatatcgcggcgggtggtgtcatcggcggtggcggtcaacgccataaacgggatctgcggcatccgctgacgcagctggcccagcgcggcatattccggacggaagtcatggccccactgcgagatacagtgcgcttcgtctaccgccagcatcgccagattccagttcgccagatgctcaagaaagttatccagcatcagccgttccggcgcgatatacagcagacgaacctgcccgctgcggcagccggccatcacctcctgctgctgctcgcggctttgcgtcgagttcagacaagccgccgccacgccgttggccagcagctgatcgacctggtccttcatcagcgagatcagcggtgagaccacgaccgtcagaccgcccatgaccagcgccggcacctgatagcacagcgacttgccgccaccggtcggcatgaccaccaggcagtcccggccttcgagcgccgtctcgataatcgtttcctggccaggacggaactgctggtagccgaaggtctcttgtaaaacctgcttagccagcgattcctgatttaatacttccgcctgtgccacgttgaccccatttgcctgaaaagaaaacaggcgctattttcagcgcctgcgagccagagtgcaacgattaaaacagatcgttgagcattagcccgacgccgacgcgcgtttggttaaagttatagtcgataagcgactcgccatagccgctgtagatctgcgtataggcgcgaacatgtttggtaatgggatagctcacgccaagttccgccccgccgtagccggtgttccagttgtattgcccctgcgcgctgaggatcgcctctcccagctggtagcccaccttcagccggtaatagcccatatatttggtgatatccgggttatcatcggtgttgcccaccacataccagggcttcacttccaccagccagttaccgttttgcgccatcaggcgggcataaagccgattccagctgcgcgaggtggggtcggaacgcccattcgagtcgtggttataccccatctcgatatcgcgcagcgtccagccggcaaactggtagtcggtcgcaaagcccaaaaacagctggggttcataattggtttcgcgaaacggcgccgactctttgctgttagagagctgccaccaggatttctgggtataggacgcgcccagcagcgaattatcgcccaggataccgcgccacagcgggaacgccaggcttagctgaaacttcacttcatctttacgggcattttcggcccagtcatagctgcggatcgcctctttattgaggtcgctggtccacgtatagagcagatagttgctctcataagggtagagcaggaaaggattatcatggtcctggagcaggttggcgataatgctgccgcgcactgccggtttgtcgtgtaccgacgcgtcctgcgccataacaccggccggtagcgcgcacagcgccaccaggcaggccaaagagatacgcatgctggtctcctgaaaaatagtttttatttttgtttaacctgaagccattctacctgtttattaatcacctgccccctaatccgctccgaaagtggaaatcaatattttagaagcataaaatcaacattttattaacgaatggaaccggtgttatgtctgaacttactgccgaagcagccctgaaactggtaggggagattttcgtctatcacatgccgtttaaccgcgccctcggtctcgaactggaacgctacgaaaaagcgtttgcccagcttagctttaataatcagccgatgatggtcggcaactgggcgcaaagcattctgcatggcggggtgatcgcctccgcgctggacgttgccgctggcctggtctgcgtcggcagtacccttacccgccatgacaccatcaacgaagaagagttgcgccaacggctttcccgtatgggaaccatcgacctgcgcgtggactacctgcgtccgggccgcggcgaacgttttaccgccaccagcaccctgctgcgcgccggcaataaagtggcggttgcccgcgtggaactgcataacgaagctcaggtctatattgccagcgcaacggccacctatatggtgggttgattggccaaaatcgagtaacatcactctctttggcaatggattttaccgatggatgcgaaacagacgcggttggggatcattctggccctcgccgcctactttatctggggtatcgcgccagcgtacttcaaacttatctactatgttcccgccgatgaaattttgacccatcgcgtgatctggtctttcttcttcatggtggcgctcatcagcgtcagccgccagtggccacaggtgaaaaagctgctgaaaacgccgcgcaagatcttcctgctggcgctctcggcagtgctggtcggcggtaactggctgttgttcatctgggcggtgaataaccaccatatgctggaagccagcctcggctactttatcaacccgctggtgaatattttgttggggatgattttcctcggcgaacgctttcgtcgtctgcagtggctggcggtgatcctcgccttttgcggcgtgctggtccagctgtggacctttggttcgctgccgataatcggtcttgggctggctttcagttttgccttttacggcctggtgcgaaagaaaattgctgtcgatgcgcaaaccggcatgctggtggaaacgctgtggctgctgccggtggcggcaatctggttgttcggcatcaccgacagcccgaccagccatatgggcgagaacccctggtcgctcaatctgctgctgatggccgcgggcgtggtgaccaccatccctttgctgtgctttaccggggcggcaacgcgtctgcggctctccacgctgggctttttccagtacatcggtccaacgctgatgttcctgctggcggtgacattctacggcgaagtgccgggcaaggataaaatggtgacctttggctttatctgggtcgcgctggcggtgtttatcgtcgatgcgctgtatacccaacgccggttgcgcagaggctaagcctgcatcagccagtaaagaagggagccgacgctccctttttttacagccagtttttacgcttgaagtagagatatggcgccaggccggccaacatcataaacacgatggctcccggataaccaaagctccaatgcagctccggcataaattcaaagttcatcccgtagctggaggccaccagagttggcggcaggaataccaccgagaccaccgagaagatcttgataatgcggttctgctcgatattgataaaacccatcgccgcctgcatcaggaagttcaccttctggaacagcgattcgttgtgcggcagcagagattcgatatcgcgcaggatctcccgcgcctgctccagctggcccgccggcaggcgcgccttgcgcacgaggaagttcagcgcgcgctgggtatccatcagacagaggcgcaccttccagccgatatcttccagttccgccagcgtcgacagcgcttcgtcgtactcgtcgccctgatggccttccataatgacgcggctcagcttttccaggtcgctgtagatgttttcaatttcatccgccagctgctcgattttggtctcgaacaggtcgagcagcagttcgtaggcgttgccgtcgaccagcgtctggttacgcacgcgcatacggtagaggcggaaagcgggtagttcgcgctcgcgcagcgtgaacaggcggccttcgcggatggtaaacgccacggtagagttgccggcgtgatcgtcggcatcttcaaaaaagaagaacgagtggatgtgtaacccgtcttcatcttcaaagaaacgcgcggaggcttcgatatcttccagttccgggcgcgtcgccaggttttgacccagttccgtctgcacgcggcttcgctcatcgtcgtcaggctcgaccagatcgacccacaccgagctggcgaggtgtttgatctcatcggcttccaggcgcgttaaacgattgttttccagttgaaatgcgctcagcatgaccgggactcccaatgcaaaaaaattatcggacagttcggtgggcacacagaaacaaattgggtttcagaccattaagcctgactcagcgcgacgggaatggggcaggtcgctgacaaccgctaaggctatcagcataagaggatagccttaggagttgttcctgaatgacaggaagttgagccagcatctactgggtgtgtccaaggcgaatgtcctcttagcgtaatcgtgcgcgcatgttacgccagcgcaaaatcggcgtcaacacgcaacggaacgcgaaagcgcaaatcaggcgccttaacgtataaaggtagcagaatattacaaaataatgatatttttcttaaagttacactgcctccagccgggcgtaagccgccaccagccatttgattccctggccctgaaaagccacctgcagtcggctgtgctcgccgctgccttcgaggttgacaatagtgccttcgccaaacttcggatgccgtacgcgctggcctaacttgtagccggtatcgctctcggcaatcggcgcgcccagtcgctgatggtttaccgggcggctcaccgtggctcgcagacgcacttcttctacgcactcctgcggcagctcgccgataaagcgcgacgggcggtgataaacctctttcccgtacagacggcgggtttccgcataggtcagcgtcagcttctgcatggcgcgcgttacgccgacgtaggccaggcgacgctcctcctccaggcggccgccttcatcaagggccatctggctcgggaacatcccttcttcgacgccgacgatgaacacctgcgggaactccagccctttcgccgagtgcagggtcatcagctgaaccgcgtcctgccaggtgtccgcctgcccctcgcccgcttccagcgcggcgtgggagaggaacgcctgcagcggcatcagatcttcatcttcttcgttgtagctgaactggcgcgtcgccgtcaccagctcctctaagttttcaatacgggtctggcccttctcgcctttctcctgctcgtacatcgcgcgcaggccggagtctttaatcacccgatcggtctgaacgtgcagcggcatatcggtggtctcctgcgccagcgcgtcaatcagctccataaagcgctgcagggcgctggcggcgcgaccggccagcgctttttctttcaatagctcacgactggcctgccacagcgtcagctggcgatcgcgcgacgtctggcgcaccacgtccagcgtgcggtcgccaatgccgcgggtcggcgtattaaccactcgctcgaacgccgcgtcgtcgttgcggttggcgataaggcgcaggtaagagagcgcgtctttgatttcctgacgctcgaagaagcgcatgccgccgtagatacggtacggcatgctggcctgcaggagggcctcttccagcacgcgcgactgggcgttactgcgatagagaatggcgcattgctccagcgcgccgccgttctcctgccaggttttaattcggttcaccacaaagcgcgcttcgtcgagatcgttgaaggcgcagtacagcgaaatcggctcgccgtcggcgccgtcggtccacagctttttgcccaggcgcccgttgttgttttcaatcagggcgttggcagcgctgagaatattgctggtcgagcgatagttctgctccaggcggatggtttccgcgccggggaagtcgttaaggaagcgctgaatgttctcgacctgcgcgccgcgccagccatagatagactgatcgtcatcgccgacgatcatcaccttgccggtatcgcccgccagcaggcggatccaggcgtactgaatgttgttggtatcctggaattcatcgacaaggatattggtgaagcgctcgcggtagtgctgcaggatatgcggtttgttcagccacagctcatgggcgcgcagcagcagctcggcgaagtccaccagcccggcgcggtcgcaggcttcctgataggcctgatagaccttctgccaggtctgctcgaccgggttgccgtagctctgaatatgatgcgggcgcagcccttcatctttctggctgttgatgtaccacatcgcctggcgcggcggccactgtttctcatcgaggttcatcgccttaatcagacgcttcagcagacgcagctggtcttcgctgtcaaggatttggaagtcctgcggcaggttggcatccagatggtgcgcgcgcagcaaacggtgcgccaggccgtggaaggtgcccacccacatgccgccctgggtggtgcccatcaactggccgatacggtgacgcatctccgccgccgctttgttggtaaaggtcaccgccataatggaatacggggaacagttctccacgctcagcagccaggcgatacggtgcaccagaacgcgcgtcttaccactgcccgcccctgccagaaccagcatattggtgcgcgaggccgctacggcttcacgctgtttgtcattaaggctgtcgagcaggtaagaaacgtccattggcaccgccggaagagaaggggttccacgaacccctgttaatatatacagagtgactggtgattatatcagcgaggtcagagatgccaaccgtgaaatttcaatatgcggcagcaggcggctgtccgcggtgtgcatcaggtccgcgccttgcggtttgatccagcaggcctgcatcccacagcgaatagcgccggccacgtcggtggtcagatcatcgccgacgtgcagaatctgcccgagcggcacattcagacgctccgccgcaaggtggtacatgtcggcaaacggcttggagcggccatccggcccggcgcgcagcacgaagcggaaatagtcgctcagaccgaacagttccgggcgggcgttgccattggtaatcgccaccagcggccacttcttcgccagcttcgccagcgtatcgtgcgtttcctgcgggacatcgacgcggctgcgccagtgagcgaagtgttccatcgccgcatcggcccccgctttcgccgcttcggcggagagcccggcattacgcatacctaactccagcgcacggtggcgccagacggtcacgtcatgataaatctcaggttcagcagccagcagcgtctgacgcagctgattaagctcatgggcgtcgaactggctgagcgaaggatggtagctgcgcacaaaggccagcgactcgtgcatcgtccggtcaatcaccgggcggttatcgtaaagggtatcgtccaggtcaaacgtcagcgcggaaatctggcccagaggtcggtaaaaacgcattatttcccccgtttagcgcgcggatgcgcggcatcgtacaccgaggcaaggtgttgaaaatcaagatgggtatagatttgggtggtggagaggttagcatgccccagcagctcctgcacgccgcgcagatcgccgctcgactccagcatatgggtggcaaaggagtggcgcagcttgtgcgggtgcacatggctgttcagcccctgcttaatgccccactcggcgaatcgcttctgtacgttgcgcgccgaaatacgtttgcccagcttcgacaaaaacagcgcgtcgtcgtcggtaccgaacaggccgcgcaaatccagccagtgctcaatccatgccaccgcgttgcgaccgatcggcaaacgacgctccttgctgcctttgcccatcacccagacctcaccgctttcgagatcgaggtgtttgatatccaggttgaccagttcggacaaacgcaatcccgcgccgtacatcacctccagcatcgcccgatcgcgcaccgccagcggatcgttgagatcgatatccagcagtcgattgacgtcatcgacgtcaatattttttggcaggtggcggggaattttcggcgcggcaatccccttcgccggattggcgctgagctcgccctgaccgaccagccagtcgaagaaactgcgcagcgccgacaggcgaagcgccaggcttgccgggcctaaccccgcgcggcgactacgcaccgcaaagcttcgcacctgagcggcatcgcactgcgaccagcttttcaggcccgcctcatccgccagggcgatcagcgcgtccagctgtcgctggtaattcagtaacgtgatcgggctgagctggcgttcaacgccaagatggcgaagaaagcgggcgacggcggagaagagaggagaatcggtcatgcgcgttcaatccagcgctccagcaggccgggcagcatctgggcaatctcctgcaacagctgcgtcccctgccctggctgataatgctgcgcatcgcggctgctgaagagcatcacccccggggcattatcgccccccagcagcgatatcgccacagacccaatggccttcgcctccggcagcaccaccagcagctccgggccgttcagcggtccaagatagtggcgcgcctggcccagacgttgaatacggatcggctcaaacgcctgccggtttaatgccagatgggtaaacttcgagggcgcgccgaggcgccagcagtcaggaaacaggcgcaccgtggcgcccgccagccccagctcgcgtgcccagcggtgaaggcggttgagcatatcgtcaaggctctccgccgccgccagccgcgtttgcagctgcagcaggcgctggaacaggctttcattagcgaccgcctgctccatcagcagcgacatattttcttccagcacatgaatatggttacgcgcccgcatcatgtgccactccaccagcgaaaacgtaccgcgtaccggatgcgggacgcggagatgttcgacctgggcggcattacgaataaaaaattcaggatgttgcaacagatagtccaccactgcgcgatcgttcaacgcgctggcaacctcctgctgttcttccccgattggtttcataaatgaataaatccatcatagacatgggccgccgggccggtcataaacagcggctggcccgggcctttccaggcgatatcaagacgaccgccgggtaattccacgcgtaccgtttccgccagcagcccctgctggatccccaccgccaccgcggcgcaggcgccgctgccgcaggcctgggtttcccccgcgccgcgttcgtagacgcgcagacggatatgagaccgaccgaccacctgcataaagccgatattggcgcgctccggaaaacgctcatggctttccatcaccgggccgagagtttccaccgctgccgtatccacatcatcaacctggatgacgcagtgcggatttcccatggacaccacgccgcacaatactgtctgctcggcggcacgcatgatataggtcttttccgctttgttggcgcggaacggcacctgggacggctcgaagttgggctcgcccatgttcacccgcaccagatcgtcttccgttacgcttaataccatacgcccgttggccgtactcacgcggatatcacgtttattggtcaggcctttcagccggacgaagcgggcaaaacagcgcgcgccgttgccgcactgcgacacttcgctgccgtcggcgttaaagatccggtagtggaaatccagatccggatcgtagggcggttcgacgaccaatagctgatcgaacccgacgccaaggtggcgatccgccaggcggcgaatcagctccggcgagaaaaaaacattctgcgttaccgcgtcaacgaccataaaatcgttgccaaggccatgcattttagagaactgcatcatctactccagttgcgcggaacagaacgttatcgttagtaattgacctggctcggaccaccggtatcgccacgatcgttacgatccggcgttgcgctctgaatgccagggttaaccggtttggtcggcggcggcgcggttttgtccgccggtgggaaatagagaggccctttcagaccgcagccggtcaggctgaagatcgcaaacaaaacggcaagcgtaggaaaaacgtttttcattgatagttgcccgtgattcattctttctgctttctatcatcgcaggagaagacgtaaaagcaagcctttagcatccgactgcgcgcgcttttgtttcgcgctatactgcgacccatcttcaaaaatcaaaaaagcagaatcaaattatgaacgacagtgaattccatcgcctggccgatagcctgtggatgaccatcgaagaacgtctggacgactgggacggcgatagcgacatcgactgcgaaatcaacggcggcgtgctgaccatcagctttgaaaacggcagcaaaatcattattaaccgtcaggagccgctgcaccaggtgtggctggccaccaaacagggcggctatcacttcgatctcaaaggcgacgagtggatctgcgatcgcagcggcgaaaccttctgggatctgctggagcaggcggcgagccagcaggccggtgagacggtgaaattccgttaatgacgtgtttcccggatagcggcgcatcgcgccttatccgggctacccgacgacttagaaccgtagccctgctaagcgcagcgccagcagggaatatctgcggatagcggctcacgtcttctccgggccaaatctacgagtagcgctgctgcagcaccggcgaggcggtaacgtcctggctggtgggtatcgcggcggcaatcgcctgagtgcggaaagggatcacctgggtgcgcccgtctacctcgacaatctgatagaactgcggcaggttgaagttgataaagctggagccgtaggtgaaacgatcgtgcgatgacgaatagaagcggctgacgtcgcgcaccagctcctctttactgccctcgcagtgatgatagacctcggcgcggttgctctcatcaagaatatagatgttaaaaccgctgtcgttgttatccgcgtcttcaaagaagaactgaataatcccttcgctggcgaagccatccaccaccgccggcagcttaacgtgattggtttccacctgcaccgacagcccgtgcagcttgttgtgcgagatagcgccgtagaactcaatggcgttttccagcttctgcaccgaaacgttaagccgctcgaagaacagcccccacgtctggccggagacgcgcagcgctttgaagcgcccggtatcctggcgggtactggagagacgcagttcgatacattcggagatcatctgctgcacgcgggtgcggatcaggccgcgcaggtgctggctatagcagaacacctccacgctgtccggcggcgcggcgtcctggtgcattttgccgaggatcgttttcagcgcctcgatcatcgcctgttcgccgttaaagtgcagcgtacgcacttcgttccacgagttgcgatacagcaggtcgacgctgccgatcaggcatttttgctcttcgccgaagctgaaaacatccagtttacggaaatcgaagtgcaccacctggttgcggaaggccgcggttgggtcatattcgaggttgacgataatcgccaggtggcggatttcgcacgggctgtacagcgcctttggcgtcggcgccggcaggcgcagcgggaagtggtgcgacacgtcggccaccatctcctgcagcttcgccagatcgacgatgccgttgcccttaataaacaggcgggtgcgtgaggtcagcaggccgttaaaccaggcccaggccaccagcttattaagataacggttatattccagcggctgatggctgatgatcgattccatgtccggcgcgcggttgtacagataccaaccggtacggttggcgcggcccggcggcacgtggataaaggtcaggttcggttccgaaagatccggcgaaatttgcgggtttaccagcgtcactttccccggcagcgcttcaaaggccgcatacagcttacgggtcagcacgccaatatcctgcgggctggcggagacgctaaggttattgcgccgcgcgaagcggatcagattacgatagctctgcatcatggcgtcgagcagttcgttgtgcgccttgcgcacttcatcgattttccagttggcgcggttgtcgagcatcatcagacgcttttcgtcccagccccaggcattcaccaactggctgacgacttcgcgacgccagccgacgcaggcgcgttcgcggctgagtttttcacaaactttcaggtagaagcagcggcgcaccagatcgaggcgggtttcatcttcgatggcctgcagataggtggtcacgcgctccagcatcatgcagtacgggtcgaggccgaaggagacaatctccccgtcgtgcagacgctgtttgatatctttcgctaacaggcggttattggggtattcccaggagtaggcttccagcagcagcgttttcagcaccgctttatagggggagtcgatacttttatacagctgccataggctggcgccgaagtactcttccgccgacagcgaactgaggccgccgagatcgagccattcgttaggcgtcagcacgccctgggcatacagccccatcacgtaatcatcgtaatgctcctcttcatcgcacggcaccatattccacagaatacgcttgccggcgaggcgcaccgcggtgcggtagaactcatcaagcaacaggatatgctgggtcgaaccgcagtcttcgccgccgaggctaccgctttcgttatgacggaaacggttttcgtcgatcaggaagaagctgacttccacgccgagcgaggcagcccagctctcaagcaggctgcattttcgctgcagcagctgacgctcttcgctatccagccaggcctggtgacatacccagatatcaagatcggaagagcagctctggccgacggaggaagtactgcccatcgagtagacgccggtgatcggcagctcgcctttcggcggctcctgagtctgcataccgcgatgcagttccagttcttcaagatagtggcgttgggtttcatcaggcgtgtagaggcaaatgccacggggaacgttaccgtcaaggtaacccggcatcagcgggtgatgataatgtaataacgttggcagtagactgtaaacctgctggaaagcgggtcccatggcagcaagcgcgcgatccacgcgcaattggttgatggcatccagtctctgtttcagtgtctcaatatagaggtacaagacatatcgcctgatgttcaaaaacccgaggtacaatagtacggaggatttcagtatttcaacaaaaaccgtcaccattcgtcgtcggtgtggttgtgatgagcagcggactgacaaatggtttaaaacgtgatcaatttaacaccttgctcattgaccgtaaagaaagatgcgctacatacaagtgtagcaccgtttattacctgtaaattcctcactacgcctccggcaaccgccacgcgcatgaaaggttaaaaaagagtgggccggagccacctcccacataaaccgtgaaaactaacatccgtaagacaacaatgttaggatggatagtggtcgataatgacggtaacaagcatgttagacaaagttttgaaaattgccacacggcaaagcccgcttgcgctatggcaggcgcagtatgttaaagcgcgcctggaacaagcgcatcccggactgaaggtcgagctggtgccgatggtcacgcgcggggatgtcatccttgatactccgctggcaaaggtggggggcaaaggcttatttgtgaaagagttagagctcgccatgctcgaagggcgcgccgatatcgccgtccattcgatgaaagatgtgccggttgaattcccggagggcctggggctggtgactatctgcgagcgcgacgatccgcgcgacgcgtttgtctccaatcgctatgcctcgattgacgaactgccggccggcagcgtcgttggcacgtcaagtttacgccgtcagtgccagctggccgccacccgtccggacctggcgatccgctctctgcgcggtaacgtcggtacccggctgagtaagctggataacggcgagtacgacgccatcatcctcgccgccgccggcctgaagcgcctgcagctggaagcgcgtattcgccagccgctgtcgcctgagcaatctctgccggcggtcggccagggcgcggtcggcatcgaatgccgtcttgatgatgcatggacccgggggctgttagcgcctctcaaccatacggaaacggcggtgcgcgtgcgcgccgagcgggcgatgaacacccgcctcgaaggcggctgccaggtgccgatcggcagctatgcggaactgaaggacggggaactgtggctgcgggcgctggttggcgctccggatggttcacagctggtgcgcggcgaacgacgcgggccagcggaacaagcggaagccctcggcatctcgctggcggaagagcttctggataatggcgcccgcgagattctcgcggcggtttatgatggagaagccccgcgatgagcatcctggtcactcgtccactaccgcaaggagaagcgctggtcagccgtctgcgggccatgggacgcgtggcctggagctttccgctgatagaatttacgcccggcagggagcttcccgcgctgggcgatgcgcttgcccgactggggcccgacgatctgctatttgcgctatcccagcatgcggtggaattcgcccatgcccgtctgcagcagcagggcctgccctggcccacttctccgcgctattttgccattggccgcacgacggcgctggccctgcatacggtcagtgggcagcatatccattacccgttagatcgggaaattagcgaagtcttgctacaattacctgaattacaaaacattgccgggaaaaatgcgctgatcctacgcggcaatggcgggcgggaactcttaggcgcgacgctgaccgagcgcggcgccagggtcacattttgtgaatgttatcaacgtagtgcaaaacattacgatggcgcagaagaagcgatgcgctggcaatctcgcggagtcaccacgctggtggtcaccagcggcgagatgctgcagcagctatggtcgttaataccgcaatggtatcgcgaacagtggctcctgcactgccgcgttgtcgttgtcagcgaacgtctggcccttcaggcccgggaactgggctggcaggagattcaggttgccgatagcgccgacaacgatgcgctgctacgcgcattacaataactctcaacattggaagccataatgacggaacaacaaaatcaatccgccgtggttgaagagaccagggaggccgtggagaccacaccacagccagagaacactgagaagaagaaggcaggcaataaaaccagcctggcgctcagcgcgatcgctatcgccattgcgatagccgccggcatcggcctgtatggcctgaacaaacaacaggccacgcggcaaaacgcaactacctctgaattagcaagccaggtcgcggcgctgcaaaaagcgcaggaaaatcaaaaaagtgaactggaaggtgttatcaaacagcaggccgaccagctaaacgaagccaaacaccagcaggagacgctggccaaacagttggatgagctgcagcaaaaagtggcggtgatttccggtagcgatgccaaaacctggctgctggcccaggccgacttcctcgtcaagctggcgggacgtaagctgtggagcgatcaggatgtcaccaccgccgccgcgctgctgaaaagcgctgacgccagcctcgccgacatgaacgacccaagcctcatcggcgcccgccgggcgatcaccgacgacatcgccaccctctccgcggtaagccaggtggactatgacggcatgatcctcaaggttaatcagctggcgaatcaaatcgataacctgcggctggccgataataacgatgacgattcgccgatggacgctgatagcgatgagctttccagctctatcagcgaatggcgcgtcaacctgcagaaaagctggcagaactttatggacagctttatcaccgtgcgccgccgcgatgaaacggcggtcccgctgctggcgccgaatcaggatatctatctgcgggaaaatattcgctctcgcctgctggtcgccgcgcaggcagttccgcgccatcaggaagagacctggaaacagtcgctggataacgtctcgacctgggtacgcgcctattatgataccgatgacgccaccaccaaagccttcctcgacgaggtggacaagctcagtcagcaaagcattaccatgacggtgccggaaacgctgcagagtcaggcgttgctggaaaaactgatgcagacccgagtgcgcaacctgatggcgcagcctgccgttaccgcgggcggcgcgccttcgcccgcacctgctgcgccggccgcccccgctgcgccgcaaggagagtaacgcatgctgaaaattcttttactcttcgcactgttgatcgccgggatcgtgctcggcccgatgatcgccgggcatcagggctacgtcctgatccagaccgataattacaatatcgagaccagcgtgaccgggctggtgatcatcctgatcctcgccatggtggtgctgttcgccattgaatggctgctgcgccgcattttccgcaccggggcgcatacgcgcggctggtttgtcggccgtaaacgccgtcgcgcgcgtaagcaaaccgagcaggcgctgcttaagctggcggaaggtgattaccagcaggttgagaagctgatggcgaaaaatgccgatcacgccgaacagccggtggtgaactatctgctggcggcggaagcggcccagcagcgcggcgatgaagcgcgggccaaccagcatctggagcgcgccaccgagctggcgggcgatgacctgatcccggtggaaatcactcgcgttcgcctgcagctggcgcgtaatgaaaatcacgctgcgcgccatggcatcgataagctgctggaaattaccccgcgtcatccggaagtgctgcgcctcgccgaacaggcatacacccgcaccggcgcctggcagtcgctgctggacatcattccgtcgatggcgaaagctaacgtcggcgatgaagcgcaccgcgcggcgctggaacagctggcctgggttggcctgatggataaagcgctggccgatggcggcagcgaaggactacgcgaatggtggcgcaaccagagccgtaaaacgcgggcgctggtgccgctgcaggtagcgatggccgagcgcctcatcgagagcgacgatcacgataccgcgcagcaaattatcattgatggtctgaagaaacagtatgatgaccgtctggtgatgccgatcccgcgtctgaagaccaataacccggaacagctggagaaagtgctgcgccagcagatcaaagccgttggcgaccgtccgctgctgtggagcaccctgggccagtcgctgatgcggcacggcgaatggcaggaggccagcatcgccttccgcgccgcgcttaagcagcgtccggatgcctttgattacgcctggctggcggatgccctggaccgcctgcatcagccggaagaagccgccgctatgcgccgagatggactgctgctgacgctgcagaataatcctcagccataacctggcatggctatcgcctcctgcggggcgatagcccttctcccccgccttcgcattgacggatccctgaaagaaaaaaacgcctgcgctgaaatcagggcaggcgttaaaacaggtctgtttgacaacaaattgggtgcttcactcaacgtaatgtccatggtgtttgatgaggcataaatgcgacatctgtcagtggacgataagcaccgtaagaacggctctgcatcattccggagtttatgaggcacgaaggcgaacataagagatggaatgagcatctacccggttattatcgcacaggatccggggaaattgcatctaccacagtgatgaattgagagttttcctgacgcgtattcttaagcaaagagaagattttttatcagcaagatcagagaaataagagatggcggacggcagcagaaaacaaaaaaccccgccgaagcggggttcaaaattggtcggcgagagaggattcgaacctccgacccactggtcccaaaccagttgcgctaccaagctgcgctactcgccgaaatactgctttttgaatttttagttcaattcgttaaagtcgtggtgcgaggggggggacttgaacccccacgtccgtaagaacactaacacctgaagctagcgcgtctaccaattccgccaccttcgcaaattcacaactctatcaaataatggggtggctaatgggattcgaacccacgacaactggaatcacaatccagggctctaccaactgagctatagccaccactgcaaaccttttacgcggtattaaaaccaccgcagctccagcaccgggttaatggtgcgcccgacaggattcgaacctgagacctctgcctccggagggcagcgctctatccagctgagctacgggcgcttagcgccgttgcggggtcggataatacggacttcctaccccgctgtctagtgcctttttaaagaaaattatcgtttgctcatgctttgttcgttttgacggttattcagccgtattattgacttgcccctgtcttccgaggccaaacaccttataaatcagggtgacggcggccagaaaaataatgccgacgaagagcgacatccgggtttcatcattcagtcccatcccgaccagcacgcagatcaggaaggccatcgtgaaatagttggcccacggaaacagcagcgaacggaacggatggctggcaatcgccgcctgatgcacgcgacggaaacgcagctgactaatcaggatcacaaaccagggcaccatccccggcaggacgctggcgctatagacatagacgaacacccgctgcggattaggaataatgtaattcaggcaggagcccaccagcaggatcagaatcgacagcgccacaccgacggacggaacgccgttgcgcgataccttaccgatcgccgccggcagctgacggttcttcgccagggcgtacagcatacgtccgcagctgtacattccgctgttgcagccggaaagcgctgccgtcagcaccacgaagttgataattcccgccgccgcggtaataccgattttggcaaacgtcagtacgaacgggctgccattggagccgatttgatcccacgggaagatagtgacgataacgaaaatcgcgccgacgtagaaaatcaggatccgccacaacactttgcccaccgcgctgcgcagcgtcacctgcgggtttttcgcttcacctgcggtaatgccgatgagctccaccccctgataggacgcgaccacgatacacagcgccgtcaggaagcccttccagccgccagcaaagaaaccaccatgttcggtgagattaccaaaaccgatggagtggccgccgttgccaaagccgaagaaaatgacgcccagacccacgacgatcatcacgataatggtggtcacttttatcatggcgaaccagaactcgatttcaccatatagccggaccgccgcaaggttcgccagcgccaccagtcccacggcaattaacgccgggatccactgcgccatctccgggaaccagaactgcacatagaccccgatggcggtaatctccgagatccccaccgccatccacataaaccagtaggaccacgcggtcagatagccgaagaaggggctcatatagcgatgcgcatacaccgcgaaggagccagtgacaggctcaaggaacagcatttcgcccattgagcgcataatgaaaaagacgaacaggccagcgataatatacgccagcagcacggaaggcccagcccatttcaaggtactggccgcccccataaacaaccccacgccaatcgtcccgccaagggcgatcagttcaatatgccgggcctccagtccacgctggagctccgcttttttctcagtcatatatcctcttgtgtttgccgtattccgggtactcccggttattgttattaactgaaaccatagccttgccgacgcgcaggtctccccggcgcgtatgaagcctgcgaatggttaattaattttgcggaaatggcaaataaagtatcaggcgagtgaagagattacacagaatatgtatgcaaactcgcctggttgcagtggaatatcagagcttaccggaataatgccaacgtaaatagcgcagcagacggaactgtcttttgatacggctcggctgcaaaagcaggcgatagaaccactccagccccagatcctgccagaacttcggcgcccgatggacgtgcccggtaaaaacatcgtaagtgccgccgacgcccatatacagcgcgtgcggatacaggcgccggcagtcgcgcataaagatctcctggcgcggcgaccccatcgcgacggtgacgattttcgccccgctgtcgcgaatgcgttcgaacaatgcctggcgttgctcaggggtgaaataaccgtcctggctgccgacgatgttcacctgccagcgctgacgcagcctggattctgtctgcgccaggacctcaggtttaccaccaaccaaaaacaccggtgtcccttcagcgccggcgcgctgcattaacgcttcccagagatcggccccggcgacgcgggatacctgggcctgcgggtattttttgcgcagcgaacgcaccacgctgatgccatcggcatatttaaactccgccgcctcaatcagcgcccgtacctccgggttatcctctacggccagcattttctcagcattaatggctaccagcgtcccctcccggagcgcgccgtcggcaaacaaataatccagagcgtgcggcatatcgcgccagcctatgagctgcagccctcttaacaggtacaacggcgcggaaatggtcccagtcatgtccatccttctcagacttgcggttgcgaaagcggttttacgcgcttatgaatcagtcccacgctatccaggaaccagtacagcagtttcgccgccagcaagcagataccaaagatcacgaggaaaaacaccacgcgggagccgaacgaatccagcccctcgcgcgccagcactatcatgttgaagatagcgccgaaacagaaactgtgcaggatagccgctttatagcgattgctctcccggttgcccagctcatacagccagtcgaaccatttaataatcaaccctaccgccacggcgcccagcggtacgaaccagacgccgcccatcaccaccagcgagccaatcagcgtcggcgagatcgccagccccgaatggttgtttaatacttcccaggtaaagtagttggcggtattgagcaccatcgtcgggcgaccgtgccacagccagctggggataaagacgtagaagtcgcggatcatcggcgccagaccctggaaatcgatcttttcgtagttctgcagcagcagcgccaggttctcccacggtgagaaggtgtcgcgcgtgagatacagaaaggtataaaacgcttcgtcgccgctgacgttcatcccgtagcgcttcagcgccagccagaacatgccgacaatacccagcacacccgccgccgccagcatccacaggctgatccagccgcgaataataccgatgaacagaaagatggcgaaggcgatgataatattggcgcgcgtcccgccgacgatggcgtaggtcagcaaaccaaaggccaccgtgctgacgaggaagaagatccacgccttataatcctggcgcagaaaatagaccaccagcatcgccggaataaagaagtaaaagaagcgcttcaacgccacgccggacacttcagcagagaaaatctggctgtaggagttgagcttaaacagcaggaaaccgttgtgggcgaagaagatgccgacgcacagcagcgccagccccatcaaaatgccccacgccagatgggtttccacccggttcatggtaaacagcgggcgatgcgcaacctcacgcgatgccgaacgcagccgcgttttataggtcacgtagtagactgcgtagaagcacaccgcgatcagcagcgtctgcagcaaaatctccggcggcgccacgctgacgtcaaagcggaacaccagaatactggtcagcgggaagccgaagaaaaaggtcagcagaaacagcaacgagaaaaaaacgttgaagttaaagcgtacccgacggaactcaaaccaggtggcggtggcgatgaacagcgtcgacagcagccagaccaccagcagcccgctaaattgcattaacgtcatgcctgcccctccgccgctaaccgtagcgcccgccgccagcccgtcagatagttcggccggaagaaggcgatagcggatttatccacgctcgccagctgacgctgcgcttcgcgcaccacgctgacgtccagcgcgtcgctggtgaacagcaccggcacatgctgctcggccatatcctgccagaacgggttttcccgattgagcacgcaggggatgcccgcctgaatcagcagacacagggtgccgatcccctgctggcgggcaaacagaaaatagcccagatcacagcggcgcagcagcgccagataatcatgaaactccagcttctcgctgaggatctgcagatgctcaccgctaaacagcgccgcccccgcctcgcgaacctcattgatataggcgtcgttattcgctggatagcccatcggcacgatgacgtttaccgtatcgccaaactgctgatggattgccttcagcgcggcaatatgttcattgctgcgatccccggagttgcccaccagaatagtcagggtatcaccgcgcggagcgttatcggccagggtattcagcgccggatccatacgggtcgggaagtagagcagctcgcccgggacgcgcggatggcggttagcgaaccagctgagatcgccgcgggtggcgaaaacgcgccctacccgcccctgcgccatacggcgcagcggatagaacaggcgaaacttcaggctggcagaattttcatacagatccgccccccagatatgccagttaaactgcgacgggcggatgccgccgctcaacagcgccagccacagcccggtattgaactggccgtggaagaaaaagcgctgctggcggttggctttcgcggtagcaatcactgcctgcgccagcgcctttttccccggataacaggtgacatccagcgccggatacccatcacgcacgctggcctcatcaccgacgatcataaatctcctggcctgcgggtcggcggccagttcgtcgttaaagaaccgcagtacggtctggttatgatgcgggatatccgatcccagtacatgtatcagtgctgtcatgcccgtttacgccagagtaaaaacacgccactacaaagggcgaaataaacaatataagtggccatatatgcctgcgccgcgccaaccgcgccgtgcgccggtataagccagtgtgagaatgcggtcagcagtgcgaactggctgatttccgtcagaatataaaaacgcagcgacgctttggcgatcaccagatagccatagacgtaagcacctacttttaaaacgtcgcccaccagctgccaggcaaacaggtcacgcatcgcggtaaagcgatcggaaaacagcagccagatggcaaaatcgcgcagcagccagaccgtcaggctcgccgccgctactgccggcaggacgaatttcagcgacttgactatctcgcgggtgatatccattttggcgctcagccgcgacagcgtcggcagcagatagacgctaaacgaggcggtaataaactgcaggtaggcatcggagatgctgctcaccccctgccagatcccgaccgcctcccagccgtaatgcgccgccagcagattacgcatcatcacataggctaccggcagggtcaccgaggttatcagcgccatcagggtaaatttcgatagctgtcccgccagaccgttatcccagcgcggacgcagggcgctcagcgggatattaccccgccgccagagcataatacccgccgggaccaccaccagcgctggaactaacgccagccccagcagcgcgccctgatagcctcccaacacgtagcaagcatagtaagccgccacgccgatcaggctcccggcaatcagcgagaaggcgttacccgccgcatcgcgaaagcctttcatcagcgccagcaggaaattcgcccaggcgatccccatctgcaccagcgccaccaggcgtaccagcccctgatagtgcgtatggccgaacagcccctggcttatcggcgccgccgccagtaaaaataccagcgccagcagggtggaaaagccaagcaccatcgccgacgaggtgcccaccacctgcttcaggcgcgggggatcgtcgtgatgctgcgccaccagcttcgtgacgccattaaatatcccggccccggccagcacgccgagtacggtgaccagttgccggaagttaccggcctggccaacgcccgccggcccaaacgagacggccagcagcttgacgaccagcagaccggcgccgattttgaccagcgtcgatgccgccgtccacagtgaggcttttgctaacgacatatcaggagaagtagctcagcagcgagttaatcaccgtccgctggttcaccacagacagattgtaaaacagcggcaggcgtaccagacgctcgctctcctgagtggtgtagcggtcttcaccgcggaattcgccgaactgttcgcctgccgggcagctgtgcaggggaatgtaatggaataccgcgaggatctccgcctctttcagccaggcgatcagtctgctgcgatcctcgatatcacgcagcttaatgtagaacatgtgcgcgttttgcccgcagtcggccggaaccgtcggcagttcgatacgcccggcgcgcgccagcggcagcagcgcatcatagtagttctgccacagggccaggcgctgctggttgatgcgctccgccgcttccagctgcgcccacagataggcggcctgcaggtcggacatcagatagctggagccaatgtcccgccaggtatatttatccaccaggccgcgaaagaactggctgcggttggtgcctttttcgcgaataatctccgcgcgttccaccagcgtgcgatcgttgatcagcgtcgccccgccctcaccgccggcggtgtagtttttggtttcatggaagctgaagcagccgatatggccgatggtgcccagcgcgcgccccttgtaggtggacatcaccccctgcgcggcgtcttccaccacaaacaggttgtatttgtcggcgatggccatgatggtgtccatctcgcaggctacgccggcataatgcaccgggacaatcgcccgggttttatcggtgatggcggcttcgatgagcgtttcgtcgatattcatcgtatcgcgacggatatcaacgaagacgattttcgccccgcgcagcacaaaggcgttggcggtggagacaaaggtatagctgggcataatcacttcgtcgcccggctggatatccagcagcagcgcggccatctccagcgaagccgtgcaggaaggggtcagtagcgcttttgccgtgccaaatcgctgctccatccactgctggcagcggcgcgtaaagccgccgtcgccgcacagcttgccgctgttcatcgcagactgcatgtaatcaagctcggttccaaccaccggcggcgcgttaaatgggatcatgggggtcacctgtatagccagtaggcggtgctttccacgttagcaccgctgagaatataacgtttaagcgcggcggtgttgcccatctgggtcgccacccgcagtgtagaaagtccgcgcgaggcggcccagtaccgcgccgcctgcatcaactgcgccccggcgccgcgtccggccagcaggccgatacgcgcttcggtcgcagtgatctgccgcagggagacaaaggcgcgaatatcgccctcaggatggcgggaaatcaggcactgatgatcgaaggtgccgcgcaccgcattttcaatccactgggcatagaagcggccgctggcgtcggcagcgtaccagggcgcgcgaaagcggctcatggcaaatgcctgcgccgcctgctcgcgcagcggcgcaatatccgcttccacggcgacgtctgcgccggcatctgcagggctgcccaccggcagcgccagatcgacctcaccttccaccagctgaaaacccagccgctgcagcgcgtccagccggacggtgtcgctggcggcgatcttcgcctgccctcgcgaccaccccgccagcgcctcaggcgtcagccgcggcgcgtgctcgtcaaagcgcacgatcgcgctgttcacggcaaagaagcggttctcccactccagggggtcaatactggcgcggacgggcacggagcagatccagcagatattggccgtagccggttttttccagccgcttcgccgcacgtttgacgccgtcgtcgtccagccagccgttacgccagccgatctcttccagacaggcgattttaaagccctggcgcttctcgacggtctgcacgaacatgctggcctcgatcaggctatcgtgggtgccggtgtccagccaggcaaagccgcgtccaagcagttcgacggtcaatgcgccatcctccagatacatctggttgatggaggtgatttccagctcgccgcgctcggatggcttgacccgtttggcatactccgtcaccttgccatcgtagaaatagagaccggtgaccgcccagttcgacttcggctgcttcggcttctcttccagcgatagcgcacggaagttatcatcaaactccaccacgccaaagcgctcaggatccatcacctgatagccaaaaatcgtcgccccttccgtgcgggcagcgacgctgcgcagcttcgggctaaagctttggccgaagaagatattgtcgcctaacaccagacacgccggttcgccgttaagaaaggcttctccgatgataaacgcctgggctaaaccatccggcgtcggctgtacggcatagtgcagcgcaatgccaaactctgagccatcgccgagcaggcgctggaaatcacgtaggtcgtccggcgtggtgataatcaggatctcacggatcccggccagcattaataccgacagcgggtagtagatcatcggcttatcgtagatcggcaacagctgcttcgatacgccgcgggtgatgggatgtagccgcgttccggaaccgcccgccagaataatacctttcatcattccccccagagatgattagctttgcagcccaagacgctcgccctgatagcttccgtcctgaacccgacgccaccaggcctcgttcgccagataccacgccacggtcttacgcataccggaggtgaaagtctctgccggcgtccagcccagctcgcgggcaatcttcgaagcatcaatggcatagcgcagatcgtggcccggacgatcggcaacgaaggcgatcagatcgcgatagtgcgccacgccctgcggcttatccggcgccagctcttccagcagctgacaaatggtttccaccacctcgatatttttccgttcgttatgaccgccgatattgtaagtttcgcccggttcgccgcgggtcgccaccagatacagcgctctggcgtgatcttccacgtacagccagtcgcggatctgttgtccattgccatacaccggcagcggcttgcccgccagcgcgttaaggatcgtcagcgggatcagcttctcgggaaagtgatacgggccgtagttatttgagcagttggtgataagcgtcggcaggccataggttcgcagccaggcgcgcaccaggtggtcgctgctggctttcgaagccgaataggggctgcttggcgcatagggcgtggtctcggtaaagaaatcatcgctgccgtgcagatcgccatacacttcatcggtggagatgtgatggaagcgaaacgccgatttttgcgccatagccagggtattccaccagctacgggccgcctccagcagcgtataggtgcccacgatattggtctcgataaacgccgccgggccgtcaatcgaacgatcgacatggctttccgccgccaggtgcatcaccgtatccggttgatgctgacgaaaaatgcgatccagctcggcgcggtcgcagatatccacctgttcaaaggcgaaacgcgcatcctgcgccaccggcgccagcgacattaaattgccggcgtaggtcagtttatccaccaccaccacgcgatcggcggtgtgctggataatctcccgcactaccgccgaaccaatgaagcccgcgccgccggtgaccagaatggttctcaccgccacactcctttggtgtcgacgataaacgcctgggtgacgctatcgccgctaacggctttaaattggttatgatcgaccagcatcaccagcacatcggcgctggccagcgccgcctcaagggtcgccagcgtacacagtccatcgagtttcttcggcagcgcgtgaatgttgggctcaaccacctgggtcgtgccgctgtgccagcgggcaatctgcgcggcaatttccatcgccggactttcgcgcaggtcgtcaatattcggtttaaaagcgaggccaaaacaggcgatcgtcagttcgctggcccgcttgttggcggcattcaggcagtccgccacctgcgctttcacctgttcgataacccattccggcttgtggtcgttgacctcgcgagcggtgcggatcagacgcgcctgctgcgggttttgcgccacgataaaccatgggtcgacggcgatacagtggccgccaacacccgggcccggctgcaggatattgacgcgcggatggcggttcgccaggcggatcagctcccagacgttaatcccctggtcggcgcaaatcagcgacagttcgttggcaaaagcgatgttgacgtcgcggaagctgttttccgtcagcttgcacatctcggcggtgcgcgagttggtcaccacgcattcgccttcaaggaagattttatacagctcgctggcgcgagcggagcagaccggcgacatgccgccgataacgcggtcgtttttaatcagctcgaccatcacctgaccgggcaatacccgctccgggcagtaggcgatattcacgtctgccgcttcacccacctgctgggggaagctaagatccgggcgcatctccgccagccactcggccatctgttcggtcgacccgaccggtgaggtggactcgaggatcaccagcgaccctttctttaacgtcggcgcaatggatttggcggccgactcgacaaacaccatatccggctcgtggcgatctttaaacggcgtcggcacggcaatcaggtaagcatccgcctccaccggggtggtggcggcgcttaaatacccctgctcgaccgcggtcttcaccacgctcgccagatctggctccacgatatgaatctctccacggttaatggtctccacggcatgttgattaacatcaacgccgaccacccgcttctgccgggaggcgaacgcggcagcggttggcagcccgatatagccaaggccaatcactgaaatggtagaaaaactcatagcgttacctgattatttttaagtgcagacaaaatgcgacgacatgcttcgccatcgccatagggattatgcgcgcggctcatcgcctggtatgcagcatcatcctccagcagtcgcgtcacttccgcgacgatgcgctggctgtcggtgcccaccagacacacggtgccggcggccaccgcttccggacgttcggtcatatcgcgcatgaccagcaccggcttacccagcgagggggcctcttcctgaatgccgccggaatcggtcaggatcagccaggcgcgatccatcagccagacgaacggcaggtaatcctgcggttcaatcaacatcacattgtcaatatgaccaagaatacgattcaccggctcgctgacattaggattcaggtgaaccggatagacaatctgcacctcagggtgggtatgggctatctcggccagcgcctggcagatctgttcaaaaccgagcccaaagctttcccgccggtggccggtaaccagaatcatctttttaccgtggctgatgaaaggatagcgctgcagcagggtctcccgtagcgcttcatcacccagcacccgatcccgcacccagaacagggcgtcaatgaccgtattcccggtaaccgtgatccgactgtcggcaatattttcccgcagcaggttctgccgcgaggtttccgtgggggcgaaatggtatgtcgccagatggccggtcaacgtacggttgccttcttccggccacggcgaacttaaatcgccggtgcgcaggccggcctctacgtgacccaccggtatccgctggtaaaacgccgccaggctcgccgccatggtggtggtggtatcgccatgcaccagcaccacgtcgggtttaaacgactccagcaccggcttcagcccttcaaggatgcgacaggtgatctcggtcagcccctgccccggcttcatgatgttgagatcgtagtccgggacaatagagaaaagtttcaacacctgatcgagcatctcccgatgctgcgcggtcacgcatactttcgcctcaaaatgaggatcctttgccagcgcatggaccagaggcgccatcttgatggcttccggcctcgtgccaaatacagttagtactttcacatcgattctcttcgattaggcgatgaaggtcatctgcccttcaccacaggccgcaatcacaggacacgacgacgcgataacgccacgcctgcgccgatgagcgcacccacaatcccccacatcaccatcagaaatacacggcgcgggctatcgcgttttacaggttcttccggcgtccgcaaataccggtaagtctgaaaacgcggatctaacgttggaccgacgttcaacgtgctcagcatggcgcggttctggtcgtaatcgaggtcatattccggcccgacggcctgcaggttttccagcctggcctgcagcatcggcctgcccaataaaaatagctctgaatccggcaactgatcggcaggaacatccgtttcgctacgtgaaatattgtgctgctgagccaccttcagcgcctgctccacgctgtgcgtccggcggttgaagatggcctcggccacctcttcctggcgcttcacctgcgccttcatctgcaccgtccgcgccgcccaggcgcctttaagttcgtcgttaagatggcctgccgcccgctggctggcgaaggccacatactgacgcaacagattattggcatcctgcccggtctcggcggtcagtttgacgctgtcgttaatgctcttggccgcatcgcctggcataaactggatattgttaatcaggtcatccagcatcgccgcatcagcgcgggcattacccgactgacgctgcttgtagtagtccgtttgcagccagaaatcgcgccgggtatcccaggaggccagctgcatgatgaactctttatacgcttcatccatggcggaaggctggtcgaccgaggcgaggtcggctttaatgtccagattgcgtaagaactgctgttgggaatagtatccccccaacatattgacagtaggccgatcggtgatcgccgtggcgctccactcctggcgagcaaagaaggtgtacaccagcacgatggcggcgaagagtacggcgccgccgactatccagccttttcctgcccataaagcgcgaaacagcccgcgaatatccagctcgttctcaacgttcactgcttgtgctcccggtaatggttgagtcatcacatccccagctctacttggttagtttcggattattgccgctgtgtcgccgaattctgcgtctgatgcgcttaaccaggcgcgccactttccaggcgcgcttaatacagtagccataaagaaagaaggctaccaaaaagagaattaacatcacccattccggcacaatgcgggtgtattccgccacgacgccaaccagcgccagcagggcggcggccagggtaatcaggacaaacgcctggcgggaagtaaacccggcgcgcatgatcaaatgatgaatatgctgacggtccggtgagaaaggactcatgcctttgcgcaggcggcgatacataatcgccaccatgtccatcagcgggatagcgataatccacagcgcggtcaccgggctaatgggatgcgttttaccttgcgtggtttccagcaggatccagatgatggtgaagccaatcatcgtgctgccggcgtcacccataaagactttatagcggcggccgagggcgccaagattgagaagaatatagggtagaatggcggcgatcatcgcgaaacaccacatcgccaggctgtactgaccatcaaaccaaaggataatcccggtcgccgcaaaagagaccgatgacagtccgccgagcaggccgtcgataccatcgaccatgttgaacgcattgatagcggcccagacggcaaacagcgtcaggaagaagccgaagggccccagcaccagttcccacgatccaaaaataaagcccaaactactcagatgcagattccctgccatcatcataatcacggcgatcgcggcctgaatgaccgcgcgaattttcacgctgatgtcgaagcgatcgtcaagcgcgccaaccagcaccaatacccccgcgcaggccagatacagcgaggcgtgaggaatataataatcggcgatggcgaaagtgaaacagatacctgcataaactgagataccaccgaccaacggaatcaacccctgatgccgtttgcgatagttgggtttatccactaacccgatcttttttgccactttccgcgcgacaaaaataaagagggtcgtgaataagaaaatactgattaattcagtaatagcagtgagtaaattcacaacgcatgtgctctcagcatagttaatccgggaagtatagcgatgatgccccaactccagaaggggaaaagcagaacattacaaatttattgtatagattttagtctgttaaagctgtctccgcctgctatccggcgccattatacgacaactttcgtcccgctttctctgtctctggatcatacaaaccccaaaatgaaaacgccacgcaaaggcgtggcgtttttggctttttttaccttacgagcgcttcatcatatcgaagaagtcatcattcgtcttggtcattgccagcttattgatgaggaattccatcgcatcaatctcacccatcggatggataattttgcgcaggatccacattttctgcagctcttcctgagtggtaagcagctcttctttacgggtaccggaacggttgtagtcgatagccgggaagacgcgtttttcagcaatcttacgagagaggtgcagttccatgttaccggtgcctttaaactcttcgtagataacttcgtccattttggaaccggtgtcgatcagcgccgtggcgatgatggtcaggctaccgccctcctcgacgttacgtgccgcaccaaagaaacgcttcggacggtgcagggcgttggcgtccacaccaccggtcaacactttaccggaagccggaaccacggtgttgtaggcacgcgccagacgggtaatagagtcgagcaggatgataacgtctttcttgtgttcaaccagacgtttcgctttctcaataaccatctcggcaacctgcacgtgacgggatgccggctcgtcaaaggtggaagcaaccacttcacctttcaccagacgctgcatctcggtcacttcttccggacgttcgtcgatcagcagtaccatcaggacacagtccgggtgattgtatgcgatgctctgcgcgatgttctgcagcagcatggttttaccggctttcggcggcgcgacgatcagaccacgctggccgcggccaatcggggaggccagatccagtacgcgagcggttaagtcttcggtagaaccgttaccacgctccatacgcaggcgagagttcgcgtgcagcggcgttaagttctcgaacaggatcttgttacgcgcgttttccggcttgtcgtagttaacttcgttaactttcagcagcgcaaagtaacgttcaccctctttcggaggacgaatcttaccggaaatggtgtcaccagtgcggaggttgaaacggcggatttggctgggggatacgtagatgtcgtcagggccggcgaggtaggagctgtctgcggagcggaggaatccaaatccatcctgcagtatctccagtacgccgtcgccaaagatatcttcgccactcttcgaatgctgcttgaggatggcaaaaataatatcctgcttacgcatacgagccaggttttccagccccatattttcgccgagagtaatcagctcagaaaccggcgtattctttaattcggtaagattcatagtggtgtgggttcttaaactcggggtaaatctcgaacttaatgttgtgaatggtatggcaggaacttccatgcctgttaacggccttcatctcgtgtctgtacgttgcctggtcacaggaaagaacgcagaactgaaacgactagacggaatgagtgaaaagcccggaattattagcttcacgcgcatttatgcgggatgcttcgggtaaaacaagattcaaacaaggtatgtttaaaacgaagtctgtggattaacttagcacgactccagccgggcgtccagagttccgcaaaaaataggaatctggacgccggaacagcaattcgcttacgccaggttagcgtcgaggaactctttcagctgacccttggacagtgcgccaactttagtggccgccacttcgccgtttttaaacagcagcagggttgggataccgcgaatgccgtatttcggcgcagtgcccgggttctggtcaatgttcagcttagctacggtcagtttgccctgatactcttcagcgatctcatccagaatcggggcgatcattttgcacggaccacaccactctgcccagaaatcgacgagggtcagcccgtcagccttgagtacgtccgtgtcaaaactgtcgtcagtcaggtgaataattttatcgctcatatttaactccacaggaataagcctggtgtgttggtgtcgtagccatcaacgacgcgctgcggctacgttatgcacgctattcttcaggatacctcaattctctggcctgccaactggcgcaatccatcatggactcgcctgttgacgccagggtgcctgaacgcgaactgcatgctgcagatttatcgctcccgactcgcttagtagtctaagctatcctggattcgttcagttaccgtagacgtaccttgaataatttcgtacaccgccaacgaaaggttgacgttatttcaccggatacgctttcttaatgcaatagttagctgatattctaccacactatgagcaaaacacatttaacagaacagaagttttccgacttcgccctgcacccggcagtcattgaagcccttgaaaagaaagggtttcataattgcacacccattcaggccctcgcccttccgctgacgctggaaggccgcgatgtcgccgggcaggcgcaaaccggtaccggtaaaacgatggcgttcctgacgtcaacgtttcattatcttctctctcacccggctatcgccgatcgccaggttaaccaaccgcgcgcgctgattatggcgccgacgcgtgaactggcggtacagatccacgccgacgctgagccactggcgcaggccaccggtctgaagctgggtctggcttacggcggcgacggctacgataagcagctgaaagtgctggaaagcggcgtcgatattctgatcggtaccactggtcgtctgatcgattacgcgaagcagaaccacattaacctcggcgccattcaggttgtcgtgctggacgaagccgatcgcatgtacgatctcggctttattaaagatatccgctggctgttccgccgcatgccgccggccactcagcgcctgaacatgctgttctccgcgaccctttcttatcgcgtccgcgaactggcgttcgaacaaatgaataacgccgagtacgttgaagtcgagccggaacagaaaacgggccaccgtattaaagaagagctcttctacccgtccaacgaagaaaaaatgcgcctgctgcagacgctgctggaagaagagtggcccgatcgcgccatcgtcttcgccaataccaagcatcgttgtgaagatatctgggggcatctcgccgccgacggccatcgcgtaggtctgctgaccggcgacgtggcgcagaaaaaacgtctgcgtattctcgaagaatttacccgcggcgacctcgatatcctggtcgcgaccgatgttgccgctcgtggtttgcacattccggccgtgacccacgtctttaactacgatctgccggacgactgcgaagattacgttcaccgcatcggccgtaccggtcgcgctggcgccagcggtcactccattagcctcgcctgcgaagagtatgcgctgaatctgccggcgatcgaaacctatattggtcactcaattccggtcagtaagtacaacccggacgcgctgatgaccgacctgcctaaaccgctgcgtctgacccgtgcgcgcccaggcaacggcccgcgccgtaacggtccaccgcgcaatcgtcgtcgttcaggttaagagatctatgccatacgctcagtcattcagaatctgccagggcgaccttcctctggcgacccgctcagtgatgtggatcgggcctaagcgccccgccgaccagggagccttctgaacgatgaagagtatgagctccacctcgctatatgccgccattgatttgggctccaatagtttccatatgttggtggtgcgcgaggtggcgggcagcatccagacgctgagccgcattaagcgtaaggttcgactggccgccggcctgaatagcgacaacaccctctccgcagaagcgatggaacggggctggcagtgcttacgcctgtttgccgagcgcctgcaggatattccgccgacgcaaatccgcgtcgtggccaccgccacgctgcgtcttgccgtcaatgcgggggagtttctggcgaaagcgcaggagatcctcggcactccagtgcaagtgatcagcggcgaagaagaagcgcgcctgatttaccagggtgtcgcccacaccaccggcggcgccgatcagcgcctggtggtcgatatcggcggcgccagcaccgagctggtgaccgggaccggcgcacaaacaacctcgctgtttagcctgtcgatgggctgtgtcacctggcttgaacgctattttgccgaccgtagtctgacgaaagagaatttcgatctcgccgaagcggctgcgcgcgaggtgctactgcccgtcgccgatgtgctgcgctatcacggatggaaagtgtgcgttggcgcctccggcaccgttcaggctctgcaggaaattatgatggcacaggggatggatgaacgaatcaccctcgccaaactccagcagcttaaacagcgcgctatccagtgcggacgtctggaagagctggagatcgaaggcttaacccttgagcgggcgctggtgtttcctagcgggctggcgatcctgatcgctatcttcagcgaactgaatattcagtgtatgaccctcgcgggcggcgcgttacgcgaaggcctggtgtacggcatgctgcatctctccgttgagcaggacatccgcagccgcacgctgcgtaatattcagcgtcgttttatgatcgacaccgaacaggcccagcgcgtcggcggccttgccagtcatctgctcagtcagttggatggcagctgggagctggatccgctaagccgtgatttactccttagcgcctgtgcgctgcatgagattgggctgagcgtggattttaagcgcgcgccgcagcacgccgcctatctggtcaataacctcgacctgccgggctttaccccggcgcagaagaagctgattgccacgctgctccttaaccagactaacgctatcgacctctcttcgcttcatcaacagaatgccgtcccaccgcgggtggctgagcatctgtgtcgtctgctgcgactggcaatcctgtttgccagccggcggcgcgacgatctgttgcccgccattcagctgaccgctcaagacgaacaactgacgctgatattgccgggaaactggctggatgaacatccgctgggtcgggagatggtcgatcaggagtgtcagtggcaaagctacgtccactggatacttcgggtcgccagcggcgatacgctgaaataatatccagccaggagggcggatgcgggaagaactggatttcaaatcgctacgctttttctctgcgctctaccgcttgggcaatgtttccccagcagcggacgcgctcgatatcagccagcccaccggcagccttttgctgaaaaaactacgagatcattttgctgacccgctgtttgtccgggtcgggcagcggatgatcccgacgccgcgagcggacgcgatcgcccccaccatctcgactcttctccagcttgccgataacgatttagcggtcaaacctgaatttcttccccagcagagccagcgtaattttacgatcggtatgaccgatatcagccaaatgacgctgctgcctttattgcaaattgcgctccagcagcaggcggcggacgggatcacctttacggtacagaatctggatgagcagaccctcaacgccctcgaatccgggaaatgcgatctcgcgatcggctatctgacgcagcttccggaaagcgtctaccagcaacatctcttcgatcaatcatatgtctgcctggctgcggaaaaccatcctcgcattcgtgcacagctccgcgccgaagactggcgccaggaaaagcatctggcgatccgcgtggaggggactgcccatggcgatatggataagctgcttgatgagcaccacatgccccggcgcattgcgctaacgttaccaagttttttaggtaccggtgagctggtggccgaaagcgatatgattgccgtcgtcccggaacaggtggcgcggcatatcacccggcgctatccctgccgcagctggccgctgccttttcccctcgccaaaatcgccatccgtcaggtctggcatcagcggctgcaccgcgatcccggacatatctggctacgctcgctgatcgctacgcttgccgatcccgcacagcagagtacttctattaaaatctaagtaacaaattacgcccgtgtattggttttattaataacccctattacgtttggtttattgctggtaatacgtgaaagcttttattctcctcgcatcaagccacactgacacatatcgcaaggaaaatatcatgcgcggaaaaattgctttagaagaacacgtatccactcctgaaaataaccgtctgtgggattcatctggtgaagcaggtcgtaacggcacagaatatatgaaagatgttgaacgccgcctgctggatcgcagcattcagctggaagaaatggcgcagcgtcatattgatcatgtaattctttctctgacttcacctggcgcccagtctattttagataaagccaaagccgtctcttttgcccgcgataccaacgattttatcgttgagaattatgttaagccaaatccggacaaattcagcgccttcgccaccctggcattgcagaacccggaagccgcggcggaagagctggagcgcgccgtgaaaaagttaggcatgaaaggtgcgctgatcaacggctacaccaacgttaaagatagcgagcatggcctgtatcttgatgacgaatccatgctggtattctgggataaggtcaacgagctgaacgtgcctgtctatctgcatcctcgtgaaccgctggaaggcccggcgcgcggcatctataccggttacgaaagcctgatcggctccgcctggggcttcgctcaggaaacggcagtgcatgctattcgtctgatgatgagcggtctgttcgatcgttatcctaacctcaatctggtgctgggtcacctcggcgaagggctggtacatatgctgccgcgcactcaacatcgtctctatcgtcagcgtttcggctgcggtctgggtaaagcggaaaaaccgttaatgcactacctgcagaataacttcatcgttaccaccagcggccatttcaatacccattcactgaataatgctattgaagtcatgggcgccgatcgcgtgatgttctctgtcgattatccgtatgaagatattcatcaggcctgcgactggtttgatcctttagaacttgaagcaggcctgaaagagaaaatcgcctggggtaatgccagccgcgtatttaacattaaataattaatttaaatatttcagggcctgtatattcaggccctgatttttattagggaaaataaattatggctataggtatatttgtctgtagcggctcgcttctcgttggtgcgctggcgggcgcttcactgaatcgttttattccggaacatttcaaaaaaaccttaccgttgatcgccggactgatctcaatcagtatgggcatattctttgtcaataaattgcataacctgccgccgattgccctggctattattgtcggcacgattatcggcggcctgttgaatattgaaaaatggattgaacgagccggaacaacgctgcgcagccccattgaacgtatttttccggcgcagtccagcgccagcgtcggtgcggaagattttatgaatcagtttatcgccgtgctgatcctgttctgcgccagcggtaccggcatcttcggcgccttaaccgaagggatgaccggcgacccgaccattctgctgaccaagtcgatcctcgacttttttactgccgcgattttcgcctccacgctggggtatatcatcaccgtgatctttattccccagctgattgttttcgttatcctgtttttcgcggcaacctttatcatggcgttaatcaatccgtcgatgatcgccgacttcaccgcctgcggcggcatcattatgctggcgaccggtttccgtctgtgcgggatccgtgccttccctaccgccaatatgctgccctcgctaatactggtgatgcccttctccgccgcctggcagcagtttatcgcctgagacgctaagcttttttcgcctttgccagcatcgcccgaatattagcgacgttggcctggcctttttgcatccgctcttcaggcgtaatggttttgcgtgcctgctcccagataaggtcgtcctgaggtagctccagcagaaaacgactcggttcaggacgcaccagttcgccatattgccggcgctccttacagagcgtaaaggtcagctctttctgcgcacgggtgatgccaacgtaggctaaccgtcgctcttcatcgacgttatcttcatcaatgctgctttggtgcggcagcaatccctcttccattcccaccagataaacgtaggggaactccagcccctttgacgcatggagagtcatcagctgcacctgatccagctcttcatccgattcgccgcgctccatcatgtcgcgcagggtaaagcgggtgaccacctgggtcagggtcatcggctcatcgatttcgctgccttccagcatctcggtcatccaggtaaacagctggttgacgtttttcatgcgcatttccgcggctttcgggctgggcgaggtttcatatagccaggattcgtagtcgatcccgcgaatcaaatcgcgcacggcgttgaccggctcgcgttcggccagctgctggatctcgcgtagccagtgggtgaagcgggtgagggattcatagccgcgcccggtcagcgtctggctgagacccatatcaaagctggcggtgaacaatcctttgttgcggcccatcgcccactcaccgagcttttgcagcgtcgccgggccgatctcgcgcttcggcgtgttgactatacgcaggaaggcgctgtcgtcgtccgggttggtcagcacgcgcagataggccagcagatctttaatttccggacgcgaaaagaacgacgtgccgccggagattttgtacgggatgcggttctgcatcagcatcttttcaaagacccgcgactggtgattgccgcgataaaggatcgcgtagtctttgtaattggttttattaatgaagtggtgggcgatcagctccccggccacgcgctccgcttcatgatcttcattgttggcggagagcactttcagctccgcgccatatcccagttcggagaacagccgcttttcaaagacgtgagggttattggcgatcaaaatgttggcggctttcagaatacgcccggatgagcggtagttctgctcaagcttgatcacctgcagcgccgggaagtcctggctgagcagcaccaggttctgcggccgcgcgccgcgccaggagtagatcgactggtcgtcatcgcccaccacggtaaagcgcgcccgctgacccaccagcagtttcaccagctcatactggctggtattggtatcctgatactcatctaccagcaggtagcggatcttattttgccagcgctcgcgcacctcctcgttgcgctgcagcagcagcgttggcagcaggattagatcgtcaaaatcgaggacattgcaggccttcatgtgcgcgtcgtatagcccatagcagtgggcgaaaatacgatcccgttcgcctttcgcgccagcggcggcctgcgccggggtttttagatcgtttttccagttggagatcgtcgagatcagctgctgaagcaccactttgtcatcttcgatcaacccttcggtcagttccttaagcagcgccacctggtcggtatcgtcgaataaggaaaagttagacttcatacccagcgcagcgtattcgcgcttaatgatatccagccccaaagtgtggaaggtggaaatcatcaggccacgcgcctctttgcgccccagcgtttgcccaacgcgctctttcatctcgcgcgcggctttgttggtaaaggtcacggccgcgatatggcgcgcctgatagccgcagccgcggatcaggtgggcgattttattcgtaataacgcgggtcttaccggaaccggcgcccgccagcaccaggcacggtccggtgacgaattcgacggcttgttgttggccagggtttaaacgcatgggagtcttgctcaatcttcgaacggggtggggattgtagcagaaagcggagccgagatttactgactgatggtaaagtgtcagccacgcaaaccatcctgagaatgatgtcatggcaaaaagcgcagcggccctgcatatcctggtcaaagaagagaaactggcgctggagatcctcgccaaactggagcggggcgtcagcttcgatcatctggcgaaacgctattctaaatgtccgtctggccgcaacggcggcgacttgggcgagtttcagcaaggcgcgatggtcggtccgtttgatcaagccgtcttcagctgtccgctgctcaaaccctatggcccggtgaaaaccaaattcggctaccacatcatcaaggtgctgtatcgccgctagcgcgtgatactatggcgccctgatttatcccaactcactcaaggcgcaatcatggctaaaaccgcggcagcactgcatatcctggtaaaagaagagaaactggcgctcgatctgctcgagcagctcaaaaacggcgccgatttcggcaagctggcaaagaaacactccatttgtccgtcaggcaaacgcggcggcgatctgggtgagttccgccagggccagatggtaccggccttcgataaagtggtcttctcctgccctgaactggagccaaccggcccgctgcatacccagttcggctaccacatcatcaaagtgctgtaccggaaataataaaaaaacccggggatcttaatctccgggtttttgcctgatggcgcttcgcttatcaggcctactaaacaaatccatgcctctatggatttcggcttgccggaaggcggcaaggaagtacatccccaggaacaaagattactatgtgactggggtgtacgtaccgtagccaacgcatcggcaagtcgaaagacgacgaggaattagccggctaccgcgatacgcttcatatcggtcatataaccgcgcagtttcttaccaacctgctcgatagcgtggctgcgaatcgcttcgttcacatcgcgcagctgcgcgttatctaccgcgccttcggcaatcgctgtgcccaggtcgccggtctgcagggtggtcatgaactctttcagcagcggtacgcaagcgtaagagaacaggtagttaccatattcagcggtatcggaaataaccacgttcatctcatacagacgcttacgggcgatggtgttggcgataagcggcagctcatgcagtgattcgtagtaagcagactcttcgatgatgccggaggccaccatggtttcgaaggccaattcaacgcccgctttcaccatcgcgatcatcagaacgcctttatcgaagtactcctgctcgccgattttgccttcatattgcggcgcggtttcgaaggcggttttgccggtctcttcacgccaggtaagcagtttcttatcatcattcgcccagtccgccatcatgccggaggagaattcgccggagatgatgtcgtccatgtgtttctggaacagcggcgccatgatctctttcagctgctcggacagcgcataagcgcgcagtttcgccgggttggagaggcgatccatcatcagggtgatgccgccctgcttcagcgcttcggtgatggtttcccagccgaactgaatcagtttttctgcatacgccggatcggtaccttccgccaccagcttgtcgaagcacagcagagaacccgcctgcagcatgccgcaaaggatagtttgctcgcccatcaggtcagatttcacttccgccacgaaggaagattccagcacgcccgcgcggtggccgcctgtcgccgccgcccatgctttggcaatcgccatgccttcgcctttcgggtcgttttccgggtgtaccgcgataagcgtcggtacgccgaaaccgcgtttgtactcttcacgcacttcggtgcccgggcacttcggcgccaccatcaccacggtgatgtctttacggatctgctcgcccacttccacgatgttgaagccgtgggagtaacccagcgctgcgccgtctttcatcagcggctgtacggagcgcacaacgtctgagtgctgtttgtccggcgtcaggttaaccaccaggtcggcctgcgggatcagctcttcataagtgccgactttgaagccgttttcagtcgctttacgccaggaggcgcgcttctcagcgatcgcttctttacgcagcgcataggagatatccagaccggagtcacgcatgttcagaccctggttcaggccctgcgcgccgcagccgacgatgaccacttttttaccctgaaggtagcttgcgccatcggcgaattcgtcgcgcgccataaagcggcatttgcccagctgtgccagctgctggcgcaggttcagtgtattaaagtagttagccatgtctgtaactccgtgatgttgtgtcgtgcttattgttcggttcgcttttgcgagaatgaacttactatatgacaggaattttattgcggaaattgatatattcacaacgtcacgttgcattttatgaaatacaaaaccggggagtacgcgccgtggatttacgcgatctgaaaacttttctgcatctggcggaaagccgccattttggccgcagcgcgcgggccatgcacgtcagcccgtcgacgctttcgcgccagatccaacgcctggaagaggacctcggccagccgctgttcgtgcgagataatcgcacggtgacccttaccgaagccggggaagagttacgtacctttgcccagcaaactttattgcagtaccagcagcttcgtcacgtcatcgatcagcagggcccttcgctctccggcgagctgcatatcttctgctctgtcaccgccgcctatagccatctgccgccgatcctcgaccgctttcgcgccgcgcacccctcggtggagatcaagctctcgaccggcgacgccgccgacgctatggagaaggtcgtcaccggcgaagccgacctggcgattgccggtaagccggagactctgccagggtcggtggcgttttcgatgctggagaacctcgccgtggtgttaattgccccggcccttccctgcccggtgcgcaaccaggtgaccgtcgagcgccccgactggtcgacagtgccctttatcatggccgaccaggggccggtacgtcggcgcatcgagctgtggtttcggcggcataaaatcagcaatccgtcgatctacgccaccgtcggcgggcacgaagcgatggtgtcgatggtcgccctgggatgcggcgtggcgctgctgccggaagtggtgctggagaacagtccggagccggtacgcaacagggtgatgatcctggagcgcagcgatgagcaaacgccgtttgagctgggtgtttgcgcacaaaaaaagcggctgcatgagccgcttattgatgctttctggaaaattcttcccaaccactaacccgcgaggaaaaagcggaatgccgggttatgcgtttcgtcgtggcactcatagcccagctcattgagacgagtttcaaagtccggctcgtgctcgcccaactcgaaggccgccagtacccgaccatagtcagtgccgtggctgcggtagtggaacagtgaaatattccagtgggtgccaagggtatgcaggaatttcagcagcgcccccggcgattccggaaactcgaagctgaacagccgctcctgcagcgcttttgacggccggccgccgaccatatagcgcacatgcagcttagccatctcatcatcagagagatccaccacgctgtagccgccgtcgttcagtaactggaggatctctttccgctcttccaggccacgactcaggcgtaccccgacaaaaatacaggcgtctttggcatcggcaaagcggtagttgaactccgtcaccgagcgtccccccagtagctggcaaaacttcaaaaagctacctttctcttccgggatcgtcaccgccagcagcgcttcgcgctgttccccgagctcgcagcgctcggacacgtagcgcaggccgtggaagttgacgttggccccggacagaatatgagccagacgctcgccgcggatgttatgctgggcgatatactttttcatccccgccagcgccagcgcgccggaaggctccgccaccgcccgcacatcttcgaacagatccttcatcgccgcgcagatagcatcgctatcgacggtgatgatatcgtccagatactcctggcataaacggaacgtttcatcgccgatgcgtttgaccgccacgccttcggcaaacaagccgacgcgcggcagatccaccggatggcctgcgtccagcgccgccttcaggcaagcagaatcttccgcctccaccgcgatcactttgatctgcggcatcagctgcttgatcagcaccgccacgcccgctgccagaccgccgccgcccaccgggacgaatacgcggtcaatatgggcatcctgctgcagcagctccagcgccagggttccctgtccggcgatgaccattgggtgatcgaacggcggcacccaggtaaaaccctgctgttgcgccagctcaatcgctctcgccttcgcttcgtcaaagttggcgccgtgcagcagcacttcgccgccaaagccgcgaacggcatcgactttgatatcggcggtcgctaccggcatcacgatcagcgccttaacgcccagccgcgatgcggaaaacgccacgccctgggcatggttgcccgccgaagcggtgatcaccccgtgggatttctgttcggcagtcaggctggacatcatcgcgtaagcgccgcgcagcttaaagctgtgtaccggctggcgatcttcacgcttcaccagaataacgttatccagccgcgacgagagcttatccattttttgcagcggcgttttctgcaccgcttcataaaccggcgcgcgcagcactgctcgcaggtactcggcgccctcaggggcgccggacaagggttgtgaatccgccatgattagccacccagcttggatttatcgcgtaccgcgcctttgtcggcgctggtcgccaggctggcgtaggcgcgaagggcaaaggagacctgacgctggcgattcttcggcgtccacgcctggtcgccacgcgcttcctgggcttcacgacgcgccgcaatttccgcatcgctcagctgcagctggatgctgcggttcggaatatcaatcgcgatcatgtcgccatcttcaatgagcgcaatgttgccgccgctcgccgcttccggagagacgtgaccgatagagagccctgaggtgccgccggagaaacggccatcggtgatcagcgcgcacgctttgcccagccccatcgacttcaggaagctggtggggtaaagcatctcctgcatccccggcccgcctttcggcccttcgtagcggatcaccacgacgtcgccttccacgactttaccgccgaggatggcctcaaccgcatcgtcctggctctcatatactttcgccggaccggtaaatttcaggatgctgtcgtccacgccggcggttttcacgatacaaccgttttctgcgaaattgccgtacagcaccgccaggccgccgtccttgctgtaagcgtgttccagagaacggatacagccttcggcgcgatcgtcatccagggtatcccagcggcagtcttgcgagaacgcctgggtggtacggatgcccgccgggccggcgcggaacatttttttcaccgcgtcgtcctgggtcaccatcacatcgtactgttccagggtctgcggcagcgtcaggccaaggacgtttttgacctcgcgattcagcagcccggcgcggtccagctcgcccagaatgcccagcacgccgccggcgcgatgcacatcttccatatggtatttctgcgtgctcggcgccaccttacacagctgcggcactttgcgggagagcttatcgatatcgctcatggtgaagtcgatttcagcttcctgcgccgccgccagcaggtgcagaacggtattggtggagccgcccatggcgatatccagcgtcatagcgttctcaaaggccgccttgctggcgatattgcgcggcagcgcggaagcgtcatcctgctcgtaatagcgtttggtcagctccacgatacgtttcccggcgtttaggaacagctccttacgatcggcgtgggtcgccagcagagagccgttgcccggctgcgacaggcccagcgcttcggtcaggcagttcatggagttcgccgtgaacatcccggaacaggagccgcaggtcgggcaggcggagcgttccacctgattactctgctcgtcggacactttcggatccgccccctgaatcatcgcatccaccaggtcaagcttgatgattttatctgacagcttggtcttcccggcttccatcgggccgccggacacaaagatcaccggaatgttcaggcgcagggaagccatcagcatccccggggtgattttgtcgcagttggagatacaaaccatggcatcagcgcagtgggcgttaaccatatactccaccgagtcggcgatcagctcgcgggatggcagtgaatagagcatacccccgtggcccatagcgatcccatcatccactgcgatggtgttgaattctttggccacgccaccggcggcttcaatctgctcggcaaccagtttgccgagatcgcgcaggtgcacgtgcccggggacaaactgggtaaaggagttaacgacggcgataatcggtttgccgaaatcggcatcggtcattccggttgcgcgccacaacgcgcgggcgcccgccatattgcggccatgtgtggtggtggcggaacggtacttaggcatgctctttttactcccatctgtgtttattaaatgggacggtgcgtgccgtcccatttttaattacttacttaccggatccaaccagccccatttatcttctgtttcaccggtgaagaggccaaagaaggcttcctgaatgcgtttggttaccggaccgcgacggcctgcgccgacctggatgccgtccacgctgcgcaccggggtgatttccgccgcagtgccggacatgaagacttcatccgccagatacagggattcacgggacaacacctgctcgcggacttcgataccaagatctttcgccagtttgatgatcgcgtcgcgggtaatgcccggcagcgcggaagaggtaaacggcggggtgaacagtacaccgtccttcacttcaaacaggttttcccctgcgccttcggagatatagccgttaacatcgagggcgataccttcctgataaccgtgacgacgcgcttcgctgccgaccagcagagaggagaggtagttgccgcccgctttcgccgcggttgggatggtgttcggcgccgcgcggttccaggaagagaccattgcatcgatcccctgctcaagcgcttctgcgccgaggtaggctccccatgggaacgccgcgatgatcacgtcagtgttgtaacccggaggcgggtttacccccatgccgacatcgccaacaaacaccagcggacggatataagcgctggtcagattattggttcgaatgacttcgcggcaggcttccatcagttcgtcgacgctctgggagaccgggaaacgataaattttggctgaatcatgcagacgctgcatatgttcgcgatgacggaacaccaccgggcctttgtgcgagtcgtagcaacggatcccctcgaataccgaggtaccgtagtgcagcgcatgggacatcacatgaactttcgcttcgccccacggaaccatctcgccattgaaccaaatgtaatcagcttttttcgtcgtcatttttcttcctttgcgctcaggcgcggatttgttgtgatgtgggttgctggatctcgacgcaggcaacgtcgaccagtttgcttaattgactaaacagtaattcgacgggccgcgggctggcaacggtcaattcgatatttatgttctgtgcgtccggcgcggtttccatgttcattgcgcagatgtggaaaccccggtggcggacaacgcgcagcacgcgctctaaggtttccggattgaaacgtgcctgtaaagcgacctgatgttgcatcatgataatttctccagcatttcagagttactggcgccgggcggcaccaacggccagacattctcaagttcgtcgattgagacatgaagcaggtatggcccctggctcgaaagcatggtgtcgagtgccgcttcaacctggtctttacgggtgatgtgttggccaggaataccgaaggcgctggccagcgtgaggaaatcagggttatcagtcagagtggtttcgctataacgttcctggaaaaacagctgctgccattgtcgaaccatccctaaccgctggttgtcgagtaacacgatcttcagcggtaactgcttgcgtttaacggtgcccagctcctgtacattcatcatgaaggagccgtcaccggagatacagatcaccgtatcgttagggcgcgccacctgggcgccaacggcggccggcaggccaaagcccatggtgcctaagccgctggaggtgataaagttttccgggcgggtataggtcatatgctgagccgaccacatctggtgctggccaacgtcggtggtcaccacgctgtccgccggcttgcggtcggaaagctgcttcagcagcagcggcgcgtagattgcctcaccgggatgatcgtaacgccaggcatgctcggcacgcagtgcggcactccgctcgcgccagccatcgatagctaacggctgctgcagcgccggcagcaggcagttcagatcgcctgtcagaccgatatgcgcctgacgcagcttgttcagctccgccggatcgatgtccatgtggatcactttggcatgcggtgcgaaggtattgagcttaccggtcacgcgatcgtcaaagcgcgcgccgacggcgatcagcagatcgcactcctgtactgccaggttggccgccttagtgccgtgcattcccagcatgccgagataatagggataatcagcatccaccacgcccagccctttcagggtgcaggttgccggcatcctggtcaccgccaggaattcgcgcaaagccggtaccgcctgcgccatgccgaccccgccgccaacatacagcatcggttgctgcgattgggccagcatctgcagagcctgcgccacttccgcctgcggaaatgccatctcatcggcgacggtagagaaatggggatcgaggtcgccctgcgccatctgaatatccttagggatatcaaccagcaccggacctggacggcctgagtttgccacctggaaagcctcagcaataacccgcggcagttcgtccagagactgcacaaggaaactgtgcttagtacaggccagtgacaaaccgagaacgtctacttcctggaacgcatccgtgccgatgaagggtgcggccacctggccggtgatagctacgatgggaatagagtcaagcagggcgtccgccaggccggtgatcagattggtcgcgcccgggccggacgtcgcgatacacaccccggttttaccggttgctcgcgcataaccaatggccgccatggctgccccttgctcatgccggcacagcaggtgctccacgccgccgtcatacagtgcatcgtaaaccggcataattgcgccacccggatagccaaaaactgtgtcgactccctgtgtccgcaaagcatgtaccacccactgcgcgccattcatagttagttccccgtcataaatcgggagaaacagaattttatgctaaaagtcatcatctgctcctcgcttaggttatttcagttataaaaaaacccccggacctttcggtgcgggggtcttagttcgttaaggcttgatttctaagcctttcctcgtccaagtgcagccccgcacggtgggataataatcaccaccacgctaatcacgaccaggctaatcactcgtagaagggctgtcattttctatactttctggcttcttgttcgaaggaatacctaaagagttaccacagacatcacataaagcacaagatttttttatatcttcgttgctaatcagcctaacggtttcaataaaaataattgttttatatgaaaaaaatcaaaaatgaaaaaaattcagttttctcacccctgccgcgctcttcggcgccctctttgccaacatagctctgttttgcgatcaaacgtccattttcggctaaatgtaacgatatgccgcgaaaagtatggatacgcagttctaaattcgcactttttccattctcgctttacgtcatgccaaccataattcttctctgtccaggaggttttatgtcgctcgctatcgtctatactcgcgcggcgctcggtatcgaagcgccattgattaccgttgaggttcatctcagcaacggtcttcctggtctaactatggtcgggctgccggaaaccaccgtgaaagaggcccgcgaccgggtccgcagcgccctgatcaacagcggctacgcttttcctgcgaagaagataaccattaacctggcgccagcggatctgcccaaagaaggcggacgatacgatttgcccatcgctctcgcgcttctcgttgcctcagagcagctcaacacgacgcgactgaatcaatatgagtttgtgggcgaactcgcccttacaggtgggttacgaggcgttccaggggcgatccccagcgcaatggaggccatcaaagccggccggcgcattgtcgtctcctctgacaatgcggcggaggtcggcctgatcggcggcagcgattgtctggtcgccgaccatctgcaggaggtttgcgcatttcttgcggggcagacatcgctttcgccgcctctcgccgaggcgcctgctcgggatgaacgttacgaagatctgctcgatgttatcggccagcagcagggcaaacgagcgctggagattgtggccgccggtggtcacaacctgctcctgataggcccgcccgggaccgggaaaaccatgctagccagccgactccccggtctcctgccgccattaagcaatcaggaagcgctggagagcgcggccatacagagtctggtcaacctccacaccgcaaagacgcggtggcgtcagaggccgttccgcgccccccaccatagcgcctcgctggcagcgatggtgggcggcggctcgataccggtccccggtgagatttccctggcccataatggcgtgctgtttcttgatgaactgccggagtttgagcggcgggtactggatgcgctacgcgaacccattgagtcaggcaagatccacatatcacgctcgcgcgccaaaattgactatccggcgcgctttcagcttattgcagcgatgaatccaagcccgacaggacattatcagggtaaacataatcgtgcatcgccggagcagacattgcgctaccttggacgcctatcaggccccttcctcgaccgcttcgatctttccttagagatcccattgccaccgccaggaatactgagtcagggctcgcagggcgaagaatcgagcgcaacggtccggcagcgggtgctggcggcgcgtgaacgacaaatgctcaggcaaaataaactcaatgcccatcttgagaatcgtgaaatgaagaactgctgtcgcttaaggcgggaggatgctgtctggctggaacagacgctaacgcagctggggctttctattcgcgcctggcagcgtctgttaaaggttgcgagaaccattgccgatctggcagaggttgaagagattgaacgctgtcatttgcaggaggcgctcagctatcgggcaattgatcggatgctcaaccatctgcagaaaatgatggcgtaaaaaaaagggcttacgcccttttttcttagtcatcgctttcggtgtaatcgtcagcgccttccatctgcggtttgccgccggacagagtatggaaacgcttcggccgcttgatacgcgccatatacttaatccatacgcgttctgcttccgtcaccggctcacgttcaccacggcacaccgagacaaattgtttttcatcttcggtaacaggttcgcgcttacccagttccagttcgttaaaggcataaccatgacgttccagcagttgcgcctctttgatggtgaaatcaccgtgacgggagaacccgcgtggataatttttattgtcgaaaaaacgattagtcgtcgtaaagctttccgccatcctacacgctcctgattctttggccgagctatttatggcgcggagtattagttacgcttgacagagcgtcaaacaaaacatttaaatcatcacgacaaataattttgtggagaacggtgtggatacggaattgctcaagactttcctggaagtgagtagaactcgtcactttgggcgagcagcagaggcgctttacctgacacagtcagcagtcagctttcgtattcgtcagctggaaaatcaacttggtgtgaatctgttcacccgtcatcgtaataacatccgcctgacgaccgccggcgaaaagctcctcccctatgccgaaacgctcatgaatacctggcaggctgcgcgcaaggaggtggcacactcttcgcgacataatgaattctccattggggccagcgcctccctgtgggaatgtatgcttaacagctggctcggtaccctctacagcgcaccttacaatctccagtttgaagcccgtatcgcgcagcggcagtcgttggttaaacagcttcacgaacgccagttggatctgctgatcaccaccgaatcgccgaagatggatgaattaagcagccagctgttgggtaattttactcttgccctgtattgcgcatcgcctgcaaaaaacagaaatgaattgaattacttgcgccttgaatgggggcctgattttcagcaaaacgaagtgggactgataggaagcgatgatgttccgctgctcactacctcttcagctgaactgatctatcagcaattatcgcgcctgaacggctgctgttggctacctgttcgctgggcgaaagagaagcatgggttacatacggtcatggacagcgctacgttatcccgtccactttatgcgatctggttacaaaatagcgataagcaggcgcagatccatgagatcctgaaaaaccctattctggaataaacgctactctccatggacggagatcagcaaggtattttcgtaggggatattgccaatggagattagagataaaaaaaaatcctttgcctgagcaaaggattcttataaatggcaggggcggagagactcgaactcccaacacccggttttggagaccggtgctctaccaattgaactacgcccctaaaattttcttaccactaagcctgctatttgagcaggcttaatgttaaataagtggcggaacggacgggactcgaacccgcgaccccctgcgtgacaggcaggtattctaaccgactgaactaccgctccaccgaatttcttcgctttattaccaccggttgtcaccccggcttactgcaatttgatgcctggcagttccctactctcacatggggagaccccacactaccatcggcgctacggcgtttcacttctgagttcggcatggggtcaggtgggaccaccgcgctagtgccgccaggcaaa

SEQ ID NO: 74 - DNA, 80328 bp, Unknown
  source: /note="Description of Unknown: KP2-Mcoc1 Bacteria Sequence"
ctggtcgcgggggctaggagatgcgtataagaggcagggggtacagggggcggcggcgactggccgccccctgtgcgctccaggcgccataagtgacatagcgcagaagacatatcgggagcgcaatctgcccggaaatagccctggatggtagccctgctaagcgcagcgcgggcagggacatttccggttgcgccgatatttcgccgggtggcggctggcgccttacccggcctacagggcttatccggcctgggacgactgaacccacaggcctgtagaaaaatttatccgctccgctattccagccgccagctcagcaccggccagccgtatccggcaccggccgcctgcagctgcggacagggattgaccagccgcacgcgatccgcatgcaggcacagcggcagatcgttaatggaatcggtatagaacgtcacctcgccgtcatactgcggatgcgcctcgcgccactgcgccagacgcgccaccttcccctgctgatagctggggatcccggtgatttcaccgctgtagccgccgtcgaccatcgccacgtcaatacccagcgcctgatcgatctccagcgcggcggccaccgcctgcaccagcaggctaaccgaggcggagataatcagcatctgctctccctcggcccgcagacgacgaatgagctcccacgcctgcggatagacccggggcaggatcgcctcgcgtacgcagcgggccaccagcgcgtcaacgtccgacttcggtattccggccagcggcgcctggatcagggccacataatcggcgatattcatctctccccggtcataatccgccattagccgcgcctcgcgggcaagataccccttctgcgtcgccagcccttcgcaaaccataaactggctccagaccgtactgctatcgccctgtatcagggtgttatcgagatcaaaaatcgtcagcgtgttgcccatggtacttcccttactggtcaaaataagctgccgggagcatgcgtaaaaaagatgacaggaaaatgaaccggacgccgcagcgcccggctcgccatcagccggcgcggaccttcgcggtgcggaacaccagcacgatcccgccgacgatcgccatcataccgatcatcgccgccgccggcagccggttgcccagcagcagataatccagcagcgccgtgatcgctggcaccagataaaaaaggctggtgacattgacgatatttcccgcgctcagcagacggtacagcagcagctgggcgaccaccgaaatcagcagcccgagaaacagcaccggaataatcaacccggcgttaacggtaaactggaagccgctgatcggggcaatcagcaggcacagccccagactaacggcatactgcagcggcaggacatccgccggcgcctgacggctgcgcttttgccacagcgcgccaaaggtcatcagcagcagcgccgccagcgcaaacaggatccccaccgtcgccatcggcgaggccgccaggctgcgccacaccaatagcaccagccccgccagggcaagcagcagtcctgacagccgccgcccctgcaggcggcgctccaccacgcaaagcgtaaggatgggctggatccccatgatggtggcgataagtcccggcgtcacgccgttggccatcgcctcgaagtaacagaccgaatagccgccaatcagcatcagaccggtgacagctgtctgcaggcgggtgcccggcgcgggcagccagcgccgacggacgatagccagcggcgtcagcgcgaccagggcaaccagaaaacgaaagaccagcagcgccatcggcgaggcgttatccagtccccagcgggtgaagatggccgcgctgccccacagcagcacaaaaagggccgttgtcgcctgcgaggcgagcagagaatagcgaacgtgcatagcatgctccagaacgtcaaacacaaggtatcaagcgtcataccggcaggtaagcgcctgctaaagacggcgttaagcgccgaaaactacccggtctggagggggaggcggtgggcagagcgtggcgaagcgatgatgaggcgcagacgtcatccaccccgcgtcgaaagcggcgccgggcaaagtctcgctagagatggcgtaatgcgtcatggaatgcctcgtgaaatgttcctgtcagcatcctggcacagaccgttgcggagtgacaactgccctttatggctgatccatcccgaggttgtttatttttaatcgtaaataaacgtaaaggcggcctcggcttattcagccgtggtttttaatcggctataaaacaaagcagtctgcttgctacttcgaaaataacgatatgaagccaaaactgacgcatgctctctttttaattccttttttgttgttggcaggatgctcctcctcaccgaaacaggcaaagaacacaaaatctcatgcggatatgaccattgatagcggatcggacgatctgatccctgtggtggcggccctgcatgatcagatgcacacctggcagggaaccccctatgaatggggcggtactgaacaaagcggcgtcgactgctcgggtttcgtctggcgcacgctgaaggatcgctttaacctgccaatggagcggatcaccacccgcgagctgctgcacatgggcgtgcgggtcaataagcgggatttacgtcccggcgatctggtgttcttccgcacccgggccgggatgcacgttggcttttacgataccgatcataatttccttcacgcctcgagcagccagggcgtgatgcgctcttcgctggacaacccttactgggaatcagcgttctatcaggcgcgtcgtctgccgaaggagtataacgcgcagatcaccatgaacagcgacaccctgcatttggcgaagaatcgccgctaaaaaaaagccgcagccagggctgcggcgggtggttctgcggttaatcagaactggtaggtcatacccagcgcgacgatgtcgtcatcgttgatgccgagtttgttatcgcttttcagctggttgattttgtaatccacgaaggcgttcatgtttttgttgaagtagtaggtcaggcccacgtcgatgtagttaaccagatcttcactccccaccccttcgatatccttccctttcgacagcacatagccgagggacggacgcagaccgaagtcgaactgatactgcgccaccgcttcaaagttctgcgctttgttggcaaagccgccgctgatcggggtcatcttgcgggtttcagagtacatggtcgccaggtagatattgttggcgtcatatttcaggccggtcgcccaggcttccgctttcgaaccctggccgcgggccagcaggttctgatcgttggtacggtcggagctggtgtaggccgcgctgacggcgaagtcgctgccgccgaaatcatagcttaacgaggtgccgacgccgtcgccgttctgtttcttcgcttcacggccttcgtttttaccctggtactgcagggtcagatccaggccatccaccagaccgaagaagtcggtgttgcggtaggtcgccaggccgctggcgcgcttggtcataaagttatcggtctgggcagaggaatcgccgccgaattccgggaacatatcggtccaggcttccacgtcgtacagggcgccaaggttacgaccgtaatcgaaggagccgtagttcttcagcttcacgccggcgaacgccagacgggttttctgactggagtcgctctcggttttgttaccggagaattcagattcccaacggccatagccggtcaggtcgtcgttaatctgcgtttcgcctttaataccgaaacgcacgtaggtctgatcgccatccttgctgtcatagtcgctgaaatagtgcatggctttgatcttgccgtacacatccagcttgttcgcgttcttattataaacttccgctgcctgcgtcgctgttgaagccacaaagcccatcatcattaatgccagagtactctttttcattattcagtcctggtgatttatttatacgcgctattcaattgcgggcgctcgcccatcaaaaactggaggttttttaacgccgggatattaaatatttatgacaagatggaactttttataaaaaagggtatttaaatgtatctgacatatttttgtcacattccctctccagaatgcccgatcccgcgcaataaaatggcgcgcccgccgccccgggtgttggcaagcgggccgactcctgctacaacatcagctcgatatcgatattccttttgaacggcagagaatcatgagtgaaagccagacgctggtggtaaaactgggcaccagtgttttaacaggcgggtcccgtcgcctgaaccgcgcccatatcgtcgagcttgtgcgccagtgcgcacagttgcacgccatgggacaccgtattgtcatcgtgacctccggggccattgccgccgggcgcgagcaccttggttacccggaactgcccgccaccatcgcctccaagcagctgctggcggcggtgggacaaagccgtctgatccagctgtgggaacagctgttttctatctatggcattcacgttggccagatgctgctgacccgcgccgacatggaagacagagaacggttcctcaacgcccgcgacactctgcgcgcgctgctggataacagcatcgtcccggtcattaacgaaaacgacgccgtcgctaccgcggaaatcaaagtgggcgataacgacaatctctccgcgctggccgcgatcctcgccggggcggataagctgctgctgttaaccgaccagccaggcctgttcaccgccgacccgcgcagcaacccgcaggcggagctgattaaagacgtctacggcatcgacgacgcgctgcgcgccatcgccggcgatagcgtctccggactcggcaccggcggcatgggcaccaagctgcaggccgcggacgtcgcctgccgggcggggattgataccatcatcgccgccgggaaccgtccggacgtcatcggccatgcgatggcaggcctgccggtaggtacctgcttccacgcccaggagtctccgctggagaaccgtaagcgctggatcttcggcgcgccgccggcgggggaaatcaccgtcgatgcgggcgcgacccaggcgatcctcgaaagaggcagctcgctattgccaaaaggcatcaaaatcgtcagcggcaacttctcccgcggcgaagtgatccgcatccgcaatagcgaaggacgcgacatcgctcacggcgtcagccgctacaacagcgatgcgctgcgccttatcgccggccagcactcgcagcaaatcgatgccattctgggctatgaatacggcccggtggccgtccaccgcgatgatatgatcatccgttaaggagctgaaaatgctggaacaaatgggcattgccgccaaagcggcctcctggcagctggcgttactctccagccgggaaaagaatcaggtactggaaaagatcgccgattatctggaagcgcagaccgacgatattctgcgcgccaacgcggaagatttagccgaagctcgcgccaatggcctgagtgaagcgatgctcgatcgcctcgcgctgaccccggcgcgtctgagcggcatcgccagcgatgtgcgccaggtgtgcaatctggccgatccggtcggccaggtgatcgacggcgggctgctggacagcggtctgcgtattgaacgtcgccgcgtcccgctgggggtgattggcgtgatttatgaagcgcgtcctaacgtgacggtcgacgtcgcctccctgtgtctgaaaaccggcaacgcggcgatcctgcgcggcgggaaagagacctggcgcaccaacgccgccacggtgaaggtgatccagcaggcgctgcaggagtgcggtctgccggccgccgcggtacaggctatcgagagcccggatcgcgcgctggtgggcgaaatgctgaagatggataaatacatcgatatgctgatccctcgcggcggcgcgggcctgcacaagctgtgccgtgagcagtcaacgatcccggtgatcaccggtgggattggcgtgtgccatatcttcgtggatgaaaccgccgagatcgcccccgcgctgaagatcatcgtcaacgccaagacccagcggccgagcacctgcaataccgtggaaacgctgctggtgcaccgcaacatcgccgataccttcctgccggcgttgagcaagcagatggccgagagcggcgtcaccctgcacgccgccccttccgccctccccgcgctgcaaaacggcccagcgaaggtcgagccggtgaaagcggagcagtatgacgacgagtatctgtcgctggatctgaacgtcaaagtggtggctgatatggatgaggctatcgcccatatccgcgaacatggcacccagcactccgacgccatcctgacccgcaccctgcgtaacgccaaccgctttatcaatgaagtggactcttccgcggtatatgtgaacgcctccacgcgcttcaccgacggcggccagttcggcctcggcgcggaagtggcggtcagcacccagaagctgcacgcccgcggcccgatggggctggaagcgttaaccacctataagtggattggtttcggcgacgataccattcgtgcgtaaatgagaacgggcgatgcaaaaataggcagttgattccactggctattgacgcatcgcccgctaagttctaaccttttgcctcgtgattcaccctcgtgaacacctcttgcagggccgatatagctcagttggtagagcagcgcattcgtaatgcgaaggtcgtaggttcgactcctattatcggcaccattctaacgtctccccaagtctactaaagttcactgaaaccccttatactctgcgctttacagccccttttagtatttctacgtctactaaagttccctgaaatctacattcgtttgggggtacttatgggggtatatgctgttcggtctagaggaggtacccccaaatgaaactaaacgcccggcaggtggacaccgccaaacctaaagataagccttacaagctggctgatggtggtggtttgtatctcctgattaaacctaatggcggcaaatactggcggctcaagtatcgtgtagccggcaaagagaagctgttagcgctgggtgtgtatcctgaagtcacattggccgatgctcgggcaaaacgtgaagaagccaaaaggggtatcgctgggggtatcgatcctatggaagcgaaacgggaagagaagatcgcccgtgaaacgcagttaaacaacaccttcaaagatattgcccttgagtggcacagcagcaaactaaaaaaatggtctgctgggtatgcttcagacatcctggaggctttcaacaaagatgtgttcccttacattggcaaaaaaccaatagccgatatcaaaccgcttgaactgttgaatgtgctgcggcgcattgaggggcgcggcgctacagaaaaggccaaaaaagttaggcagcgctgcggggaagttttccgttacgcaatagtcaccgggcgtgctgagtataaccccgctccggatctcaccagcgccatgcaagggcatgagtccaatcattatcctttcctcacaccgaaagaattgcctgatttcttcaaggcgttgtcaggatatacaggaagcgcgttagtagttttggctgctcgtctgctgattatcaccggcttgcgtaccggcgaactccgcggggcattttgggatgaaatcaatatcagtaaggcggtttgggaaataccagcctcacgcatgaaaatgcgtcgccctcatgtggtaccgttgtccaggcaagctcttacgcttattggccagctccaagagctaacaggcaattacccgcttatgttccctggccgtaacgatccgcgaaaaacaatgagtgaagccagcataaaccaagtctttaagcgtattggctatgacggaaaagtcaccgggcacggtttccggcacaccatgagtaccatcctgcacgaacagggctacaacaccgcgtggatagaaacgcagctggcacacgtcgacaaaaactctattcgaggaacgtacaaccacgctcagtacatagacggccggcgagaaatgcttcagtggtatgccgactatatggaagcgttggataacggtgaaaatgtagtgcatggaacattcgggaaaagcgcttaactgtatgtatagacagtgctaattgacagtagtagacttctgtagactatcgttagcaggaagcttttatgcgagaaaacatcctcaacatgccccatcatcttcgccgacaacgtgtggtcactgctgagcaggctgcaatggctatggctggcgtgtacagttgttcacgcttagatgagttgaaagctaaattccctcctgagatctacaacattgcttccagttacttgaggataattttgagtgctgtaaacgcagaagaactacatcccaagagaacatggtctagctcacctggcggagatatcactggagctgatttttattccaatgatatttggccttgggctgttaaagaaatatcagctacagatagttggtttggatgtgatccagatagctttagcgaaaagtaccagcctttacgaagcgggtggggcgagtttgctggtaaagatacagcgttaaaactgatcgctggaatggctattgcgcttgaaaaatcaggtggtaaatatgttcgcggtaaaaatttgaacaaatccgaagttgctaggagtgcttcaagaagcatattggaacatggcgatggcatcgatgtgacagataaggcattgactatgctaattaatgaagctctgaacacatacgcttccaaatagctcgtgaggatttccaaaaagtcgatctacaggttctaaaacttctgaccgtacttctatttcagtggaagagctgcttccaactgatttaccgtgacttccacaactacccgcatgtttttgctgaaatatacctcgtagaccacattagacttcgagaggtatatatgtcccattcccttatccgcttacctgaagttcagcgcagaaccggctatagcaaggcttggatctatcgactcatggctgagcaacgtttcccctcatccataaagattggttctcgagcaattgctttcattgaaagcgaaattgatgaatggattagtgagcgcattgaatcgtcacgcagccaaacgaactgagattccgtgagcagagataatttgcgagagtttgcacttcggatctcgcagaatacgtttgtcgcgacagctcactaaacaattcaaaaaggttaatgccatgaagaacaattatgcccgtctggggcagggcttcgctcaccctaaaaactccttgccttgttattcaactgaagggtatgctttaaaagcaccagcaaaatctggtgtcgggcgtgagaacccggataagcaaaaggcgataccagacgcctatagcgtctttttttgtgtcgtaaagccagtacatcttcattcagcggggaagatccgcatcgaatctatggtggcgctggcggggcagccgaaaggctggccggtatccttttgcaccggtattctcacccccgtcagtgtcaccaccctttatgagcgtgagaactcaagtggtgactccagtaagcaaaaggaggctgccacatggctactaccccaacccaaaaactgcccaaattcacctggcttttcctcggtacgccgaaaggccggacctgcactcccgttgttatccgtatcgttgccgacagtgagcaagaagcccgcgagttttattcccgctgggatcttatctttgccgccaaaattcgctctgaatgttcgctttatcagtacagtagcggcgcgtttgaactggatgttgcgaaattgggaggtagccatgcttaacctccagaccctgacagctaaagcccgcgagctgcgcggcaacgtggtaaaagccacgaccacgaaaggcacgcgcaccatgacgcccgtttacgaacgggaagagcagcgcaaactgcgcgaacgcatccagcagacccagccggactgggttttactctggtgggatattgcgaccgttaccggctggcgtaccagcgacgtgtgcaatttccgttactcctgcatcaactgggaaaccggtattgcaacgatcatcgtagcgaagcagaccaaagcagcggaagccagagcgacccggaaggggatcgagattgttcgccagcagcgcaaggacgctgcccggcttgctggcgatcacattgggtacatgcactgggatagcgtgagctgcgacgaactggccgccggcatgacgggagaagaacaggcgatcgtgtttgagctggtggcaaaggctgaagttaagcacgacaccaaacagctgccgccgggcatcatcaagcggctgcgcgaacgcatggagcgcaatcttatcggtgacgacctggtattttcccgcagccagattgaaagtaaccgttgccagtctctggaaggtagcgttagccgtcagacgatctggaagaaactgcacaacgtcatggtgtggtttacccgcgtagtaaacacgcgtctgcgcctgagcgcctattccagccgcaaaattgccgcctttaatctcatgtccgccggcggcgaacagggcttgctggtcgcctctgaaatgctcggacacagtaacccggcaatcacccggacttatctccagctggggagcaaggccgcggctatccagacacgcctcgctatggaggtgaatgcatgacaaagccaactcaaaacgaatccattgccatgctgacgaccagcgcaggccaggcgcttgaatacagccgtcaggcgcttgccgttctcgatatgtggataaacaccctggcgccggatgatgaaatggaaagctttcgtgtcgcggcggttcacagcctggtcagtcaggcatcggaatatctggtgaaagtcagggaggtcagaccatgaccgctatttataatctggtgcgctgtagcgatggcaaaactgtattcagttttccggccggcggccgctatctggtggacacgtcgaacgggttgcagtcgatgcgcccccttatggacgacgagatccttttcacggtggagagtgccgcgcgctttctgaagaagattggttatcaggtaatcccgccagcggcgtgaggtaaaaaatatgacgattaaaatttccggcttagctgctggtggccgcgctcaccctgaaatcaggccgggcgataaatggaaggacagccggggcagcatcgtaattatcgaaagttaccgattcgacagagtgacatattgccgcgaggggtacagctcaccgtgtttttgcacgccagaaagactggtgcgggaatttgaatttgtttcttccgcgccggtcgccggcgaaaaagatatcgatcggattatgcgggtacagggcatcgagcgaattcgtgtcatgcgggaaatcatcagggagcgagggaacagaaaatgaagaatgcaccaaaccttaaaaagcagccggcggatctcatggaggagtcaatcatctttgccggcgccgatgcctggacgttcgccaaagcatggcaggaaatgaacccgattggcgacacggtgccgccggttgtgctggataaaaagcagctggcggagctggagaatatccgcattgttgatgatggccggctctatgcccgggtttgccgcggcgggcatctgaccgaacggcagataaccattctcgcgacaaagctggcggtggccggcgtggagcgcgcgcaattctactctgaaggttatcagcttctggaggactggacgccgcagctgccgcgcctcaaagccgatgcggaagccggcaaaagtatggtgatcggcaaaccgctgacggatgtaaacctccgcgacctggctgataacgaaaaggcgctcatactggccgcgcgttacaccggcattgcaatcaacgaaaacagcgagggcgtgtacgtctaccgcgccggcatttgggagaaaacgtctatgctcgagctgagccgcgaaatggtggctatctacaacgagaacaaaaccaacttcagcaagcgcgcgatcaacaacgttatcgacgccctgaaaatcgttatcccggtgatgggggagccgcggcggagcctgatcccctttgcaaacggtgtctacgatatggaaaccggcattttctccgaacacagccaggacaactggctaaccaatcataacggcgtgacctacacgccagcggtaccgggcgaaaacctccgcgaccacgcgccgaacttccataaatggctaagttacgcatcagatagagacgcaattaagatgcagcgcatcgctgcagcgctctttatggtgctggcgaaccggtacgactggcagctgttcctcgagataaccggtgagggcggtagcgggaaaagtgtctttacccatatcgctacgatgctggccggtgcgcataacaccgccagcgggaacatggcggcgctcgacagcgcgcgcgggcgggcgcagttcgtcgggaaaagcatgataacgcttcctgatcagcccaaatattcaggagagggcaccgggataaaagcgataaccggcggggatgccgtggagatcgacccgaaacacgagcaccagtacaccgccgttttgcgggcggtggttgtggccacgaacaacacgccgatgattttcaccgaacgtgccggcggcgtttcccggcgacgcgtaattttccagtttaaccggcgcgtcagcgaggaggataaagatcccgacctggcagaaaagatatccgctgaaattccggtggtggttcgtcggctgctggcgaactttgcgaacccggaaaaagcgcgggcgctgctgctggagcaacggaacagcgaagaagcactggaggtgaagcagaaaacggatccgctttatgccttctgcgcgcatcttgagcggctggctgattgtgcgggaatgatggtaggaaaccgcaatccgcctcactatccgcgaatttatctctatcacgcttacctggcattcctggaagccaacggtttcgacaagccgctgacgctgaataaattcgcagaggggatggaaagcgcgatgagggagtttaatcacgagtaccgtaaggaacggagagcccgtggcatggtgaccaacgttgaactttcagagagtgcggaagactggttacctcagacgcatcctgtagccggtcataaagaatgaagttcagataaatatggagaaaggtatacatggtatacatcgagagaataatttatatataaatcagtgaaataaaccatgtataccttgttttcaggtatacacagggtgtacatggtgttcattctctcattaaccatctgatcgtttattaaacagaatgatgtataccgtgtagacctgaaatcccaaaatgtaggctggtgttcataggttaatattatgttttataagcaatttatagcctttatgaacaccatgtataccttgagggcaaattctttaaaacgcatccattcatttcacgttgtgcatcccctcgatttcattaccatcatttcattacttgcaatgattgttgtgattgttgtgattgttgcgttttttatcatgtgataaccaagggggaagcatgaaaaaggaacacgtgaaacccattcttctgagcgctgctcaggttgcggcattaaaagccatccaggagcaggaacgccagaaatccgggtttggtatcgcaccatcaatccatgatgtggcgagaaaaatatttgatgttgggctatccagaatggaggtaagccagtgagttacgaaattaaaattgggcaaagaagcattgctatcactgataacgtttctgaagtggttgcgcctaatgagcagatggcgattctttttaaagggatggcgaatatttttggtgatctgcgggccgtggcaatgttagctgaggcggaagccgatgccgtagaggttatccgcaatgatccggatttaaacgaagcagcaaaaaaccgccgggccagagatgcggcaaatagagacacactcacggctttcactagaagtacggcgatgatcagcgaacaagctgaaaatattctcaattatcttaagaccaaactggccccagttgctccgttggccgagggtgatgttgtcggatttatgcgagatagcgagctacggaatgtatttcgctcgctggatggagctgcgaaagaaaagctgatggtagcaatgtatgccgggaatcagactgatttatgtgacgccctgctacgaggtaacgccatttgctcaggcgtaacagattctcagctggagcgactgacttttgcccgtatagccacagataacggagccgttatcaaatctgtttctaacctggtaaaagccattaaccgcaacctgcagcaaatcatcgctgttcgcacatggtatgcaaatctggtatttggaagcaatgacgaccctcgcgatgtggctcctcgagtctccggtctggcgaatctgtccgagtacattgatggtatggaaaaaattaattcccgacagggtaaagcagatgatgaagatgggaaacaggccgcctgatggcggctttttcttaactggagaatgctaaataacagaagtgaggaacggtaaattatgttattgagcaaatcagcctatgccaggcacatgggagtaagccgacaaacagtttacggctggatagcacgtggtgagattgtgctatcaggcgataaagtggatgttgaagcaacacaggcgaagcaaaattctgctggtgctggtgctggtgctggtgatcatcacaatgcaatgacgtgggcgcaggccgccgcgtgggtatgggggcatgacggcgggaaagagttgccggctgatattaatgctggccagcgaatagaggcagcagccgctgagctgggttttgatgttcagcacgagcccgatgaacaattgctgattctcttccggttggatgaagaaacccacagcttctatggcaaagatcacatggctggtggtctgcgtttcctgcgttccgagctggcctatgtggccgcaatgcatcccgacacccaagatgactggagcgatacaggattaaaggcactctgtctgctggcaggtgagaaactgtaaaacccccggccaaacctaactcctctaacttgacacttttcgtgaaaaacagggaaaagtgtcaacccaacctaacggatcctaacgcctacgaacagcagctacagtagaagtgtaaagggcttgcgttgagatttgttgagccttggctgttagtatctgttagtcctgccggcaaagtgtaaaccgcgccgctttagaaaacttcaggtacacgaactcgcgaaggggaggtgttaagcacttccccaatgcaaccatcctcgagcctctttcagatcgctgttctggtttgcccgaacgctggcgttcagattgagttgtcaaaagttgtcacccaccggcagcgccagtggggatttttggcagaacgcgctctaagttacagttgcttcagtcagtaatttagatatatttagaataacttttaaccattctaaagcttgttctaagcgaccaagttgattgtctctgatgatgtagagcactagaagtgtctcttagtgctcgaatcgtttatcgtgcatcatagctatgaaactctcatcataatgtcttgttaataattaacagccttatgataacgtcactttaaaataacgggatttgattaaatggcaaagcaatttatgttgatggaaccaaaaaatgagaattttaatgaattaatcggtgggcctaacaaatatatagtgcctagattccagcgagactatgcatgggatgtaggacaatgggaggatttatggggagatataaattctcttgatgatgaaggttttcattatatgggctatattgtcctacaacaaaaagaacagtatcagcatgaaattatagatgggcaacaacgcttagttacgttatcgattatagttctggctgcaatgaaagcgatcaaaactttaattgataacggggaggatgttcagggcaatactgagcgactcgatggtataactcagaattttgtaggaagtaagaacttcgttacgcttaaagtaattaataaattagaactaaatagaaataataaaagttattttcaaagaatgtcatctcatttagaggctcaaaactctcgcggtataacatcaactaataaattgatacgcaagtgttttgactttttctgtaagaaagattacggcaaaacaggtgcggagattgctcagtttattgcagatttttcttcaagtatgatttttacaaagataattgtacaagacgatcttaatgcctataaagtttttgaaactttgaatgcgagaggggtccaattgtctactccggacctactaaaaaactatttgttttcaattgtgacgaaagatgatcaaatcggagaagaagagctcaacgatttggacgagcaatggtcagaaatgattgttcaacttggagagagcaatgtttctgattacattagatatcactataattcacagagaagaatggttactaagaacaaccttttttcctcaatgagaaaaatattaacgaaaccggaagaagcgtatcagtatttgaagtcattaattgactactcacctatctatgcatcattgatcaatcccaatgatgcatggtggggggatcaagatgtgaaatacagaaatgtattgcactatcttaatggtattagattatttaatatcaagcaaccactaacaatattcctcgctgcctttggtaatttttctccagaagagtttgttaagctcgtaaaatatatatatatattatctattcggtataatattatctgccatttatcacctagtgaacaagagaatatttataatcaaatcgcgaacaaagtttataatcgagagttcttaagagctagtcatgtgaaaaatagcgaagaatttaaacgtttgtatcctgatgataatgctttctttaatgcttttgaatttcatagaatgccaagtagacaaacagcgaaaaaaatacgttttttactttctgaaattgaaggctatttaggtaatccatgtgattatgaaaaaacgacattagagcatatttgcccttatcatccagagaaagattggaacgaatcttttggtgaaggaattaatgatgtaaaagatagacttggaaacatgatcttaatggataaagataatttaaaacgctcatcctttgaagagaagaaaaaagaatatacaaaatccggatataagttggccttaaaagtaacagaatatgcagagtggaatttagaatctgtcaatgattttcaaaagtggatgtcacaacaagcagttaacgtttggaaggttgattagtctctgtaaaaacatcaaccgtgctggcggactgtctattaggcagcccgcaacattttttactgtcagagttcagacgggatctgattgggggtacttttgggggtaccttagaaaacttaatgaatataactcactgaaaatcaattggatgtttagcgatgttatgttcctattatcgcaccatttcaacttcccccaacttccgtatttatccataactatcctgatttataacgattttactgctttttagtccatcgttgtccgtaactctccagtaaagtccgatacttaaggtatttaggattatgtatatgtccttgttcggtcctggattcctatacacctgctttttaatgagatgcagattcgctgcactaagtccgaagataaaccctatactcttggggatcggcaaggcttgtcattgtttatagaacctaatggaagcaaaagctggcggttccgctatcgctttgtcggtaagcctaaaatgatctcgcctggtgtgtatcctacgatcacacctgcagacgcccgttctcgtcgtgacgatgcccgaaaactgctcgcggaaggaaacaacccgagtaaagttcgaatagagcagaagatcgctttgcaaacggaatccgaaagtgcgttcgaaaagatagccacagagtggcatcagatgaagtccgccaaatggtcggcaggatatgcatcagatatcatggaagcgttacagaacgacattttcccgtatgtggggacaagacccatttgtgaaataaaagcgctagaactgcttaatgtgctgcgtaaaattgaaaaaacgcggggcgttagagaagatgcgcaaagtacgacagcgttgttcagaagtgtttcgttatgcaattgtaacgggtagagcggagtacaatcctgcggcagatctttccagcgctctcgaagtacaccaatccaatcatttccacttcctaaaagctgattagatacccgaatttctgcgtgccttagacagttacacaggcagtcggcttgtacaagctgctacgaaattactcatgattacgggtgtgagaaacattgaattacgtgcagcattgtggtcagaatttgatctagataacgctctttgggaaatcccagcagaaaggatgaaaatgcggagggcacaccttgtgccactatcgactcaagcgttaaatttactcaatgaactcaagattatgacgggtaagtatcgttatgtatttccgggacggaatgatccgaacaagcctatgagtgaggctagtatcaaccaagtcataaagcgaattggatatgctgggcgcgttccagggcacggattcaggcatacattgtcaacaattttacacgaaaaaggatatgagagggcagagattgaaatgcaattagcacatatcgataagaacaatattcgtgggatttataatcatgctcagtacttaaatcgtatgggggaaatgatggattggtactcatcatatatttttcaatgctagccgggctatcacccggctaaaatttaaaaaggtaaatcatctacctgaacattaacttgcacattatcggatattttaacttggccagacattctgtctgcaataccctttaattgttctactgtaaatctcggttcagaccatccctcagaaaaactcacgttctctgaccgaggtcttctatcttccggtagaaaattaattttaattctagatggtaatgcagcggcttcgccaacgaatatacattcctgctgagataagctaggcaaagacgcgactaaacctgaaaggccatccggtaaaaatgttgagacatgctgttgatccgtcgcattcgttaatcttaacacaacccatgagccgcattgggaaatgacagtgctttcaatatcagctggcctttgactgattaacattagtcccaaaccatattttctgccctcacgcgcaattcgccggattgcggattgtgcagctgcgtattgggcttcaccatggttaggaacatagcggtgagcctcttcgcagactagaagaaatggatctttatttctttcagatgctgtttgatgtattttatattgaaatagtagcctggcaagtgttgcagctaatgggccagcgacttcattgggtaggccagatatatcaatgattcgtatatctttatatttttcttcaataatgatttcgccaactagctggtctaatattttctcaagattacagtcattcttcggagaccagttttccatcatgaatttaattcttggatctcgtcttaatactgataatttatctaaaattgatttaaacttctcagcaaatgttgattctgtttctttttctattttccctgattttactctggctgcttgaatgtatcttatgtgattttcaaattcatttaaacaaaacggaattggtttatcagagtcaaatgaaagtatttcttcaatagaatgcccttctgtcggcctcggttcatctagagcttgaccatctgtcggtagaggccagttatagttatctggcgcatgagttgtaattccacacgtaaccatcctggcatgagatagcgctttgtatataatattgttttgggacgttgcttctttttcagttttgccaattattaatgttctaaactcatcacttgacattagccagtatgggagttttatgttttttttactttcatcattttcaagagcactgtaagcttgataagttatccctctatctttaaaggctaacccatattcatcatgcgggtctatcattacaattcgaggagataggattttgccctcaatgcttgagtgttctaatatgctatgaagaatagtggcgacagcaccagattttcctgatcctgtcgagcctaatactgcacaatgaagtccaaataatttgtcaatatttgccctacaaggtattgaatttgcacttgaatagtgagcgaatggcactaaagggttacacgagttgtctcttgcaccttctgcagcactgaagagctctgctgattcagaatgagttaggagataaacgccctgctgaggcaatggatatatttttacaccgcggttgaatgttaatttctgatttgatggcgaccagtaaccgtgcgagaacaactctacctccatgatacgttggtctgcttctggagggattggtagagagttaggttgtaattcatccgatctcattcttaaaagagttacaaaaccaaaaatgatatttcttccgaagtttatcttaacaatactacccagttgtcctattgcataaactttaccacaataacttctagtcaactcttctacattgctggacagttctactcttatttttgtaccggtcacttctactacgtgccctatttttaactcttctattggtttgaatttcatcatagaaccccttcttttagaactttagtcatcccagaaaaagtccaccaatcatcatattcatcctttctcttaatgggtgatttacttcctacataaagaccattttgggttgcaacataaactctttccccccaatcactgcatctccaaacatcaagcacttccggtatcttgttatcaacctcctcacaaaatgcaagcaggaccgttttattattaggattggatagcgatagattaatttcttgattgatatgctcatctccaaaactataaccacaaacaatcaatacatgataggataatgagttcagcgattttctgagtaaatcaaattgtgcagaaaagggatctttctgagttgcaatgtactttgtagattgagggtagattaatactctattgtttttaataggatatgtatcccggtctcttactctccacaaagacccatcatcattttgaaaccaatctattgaaccatgcattttaattatgtgagcctttgcatcgttcataggttcaatttgtccatattgatatgacctatacgcaacagcaccaccactaaacccatcccaatatggtattctatttaatgccaaagcatcttcaagtaatgtgtcataattcgttgtgaataaccgtattggttttcttcgttcatttataccagctcttaaactataaaaaatagtattaatgaagttaaaatgctcttttatatcgactatgaaattatctttatcaccaatgattttttcaggcttttctacatagccgtatcgtattgtatcagcaatatatttaagtattttattatgaattttttcaatgcaatctaatgtgaaattttctttgcatatttcaatttctttcttcaatgtgcgagaagcaattgcagagtagtcacctaagtgactaagtatatgttctatatggaggtttggtggaagttctgattttatttttgttataagatttacggcctcggcatcctcttggatcaactccataatcctcgaggtcagggggtacattaagggaatttttgcggaataacttatccctgcaccaagcaaccagttttgttcggggcagttcagtaattcctgaaattgctctaagtcattttctatctcactgtttttcatgggcaatccttttttgtcgctcattccgattttcagtttttgacgtcggttgacgtaagggattaaggggagattttcagatgtatcatactgatggacagataaaaagcgtcaaccaggggctttgtggggtggttaacattaatcgatgtgaatttaatatgctcggaataatcactgatattctcaagcttctcgactaaaagagcttagcgtgagcagccccggccgactgcccgcttcgcttaacagactggttttcatgcactgaacttgggtcagggtcacctgtttaacggacgacgtttccgggcgctgactgtagtggataattttagtcgggagtgtctggcgatccatgcaggaaagtcgctgaaaggtgaggatgtggtcggtgtgatggaaaggttgcgggtgctaggcaagcgcctgccggtacgtattcagacagataacggcagtctgcgggatgagtgcctgaacattcactggtttctctcgctggaagatgcgcaggacaaactcgacaactggcgcagggaatataatcatgagagaacgcattcatcattaaatgacatgactccggctgaattcatccgaagtctccagaaagacgaagatctctgatttagcactgcactgaattttggccagggtcaggtaattaaaatttatacttattaagaagatctttataacgttcgacttcttttgaataccatttgagactccatgaccagccatcctctctgggtttacaatccgtgcagttatcacaatttgattgtttgaaactattaccgaaatcatagctaccagtactatcatataattgacttaataaatttccggttccttgtgcatgtcggtgttttaagcagatcaaaagatgcataccacctagagaatgcattcttaatgattgggcaaatactccaccagggcgataatgaacaaataaatactcacaatttttcattatatttgtggggtcataattagcaaatccaattttaaggaattcatgatattctccttgtgggtcatcaggatccattcctagatttttggccatactcaagaagtattctttttgctcttcagttgtaagatcataaaaatctttttgactgtcaagacggataacatgattctctatttctgttagggcttcctcaaaatcaggaaaagttgaaagaatcatcttccgatggggttgggttgctttagggttttgttttagtaaggtggcagtaaggaagtataatttttcaattttttcaatatcttttgataatacgcaatatgtcattactaataatgacattctttcatgccaatcatctagaaaatcaattgtttccttcgaaccccgtgcttcatggattcctttgaatattaaaatagacgcatagatatcaacaaaaaaatctgcaagtatgtgatattgctggtttcttgtcatcctgttacataactcaatgatcttttgtagggatatgcagcagtctctatacattatttgagtttgatcattgaaaatataacgctctaaagatttttcttcaaagtgattgacggaatgatgggtcgcatgaagctgatccaactgagccttaaattttgctttccgtgatttaccaaaagcaattaatctgtgaatccggcttttttgctctctagctaataatattaaatgttggcaaatataaaatttttctctgtaaatttctcttttaatattagtataaggagcaatttggaatgcttgtaagtaatataaaactgctataaatctatcttttgcaggaactattggtgaatgacttatttcggtagagcgtttaaaaacagcatcatatttcctttcagataaaagattatccaactgctgatgatacgctttatataatgcttcacctatatcttcaattttcttatcgagagttgaagggctaatgattggatatctgacaacagaatctttaagtcccttaatgttcaagtaatcccaacaatctatggctgcgtctaatattttatttgctgatgctatgtcttttctgaccagtgtattttcaattgggatatgaacttgaactgtatcattctgattagattttgaagctttttttcttaatatcgcattgtttgttattgggagccaaaatattttctctgacgtaatctctaccacaactaaaataacaggcactttaaattcaaagtaatatctcaaacgctctgttttgagagtaaatgataataagctattgtcatgaataaaggttgagttctcttcacctttaatctgaactttgaaaacactctctttcccaagagctttgccactaccatctttgagttcaatttctccatcaataccaaaatcattttgatcctcttgacttcggaaaatccaatggcttggtaagttgtattcaaaaatacgcccggcttcaattccaatctctcctgcgttcatcaggcccctcaatcttgtttttttcttgtggtcttatagtaccatgctcatacaataaaacagtatctcacctatagccattgctcttacctccactaagataatgcggatggtagcaatatcaatccagtgttaggctcatgcttctgttgggcacgccactgctagacacaatcagctattgtgcggcgtgttcaaaaggagctctcggcaagtaataatctctcactacgaacacaaaaaatccattgggagtatcaacaaagatgaaacaggtaatttttattaataatcaataaaatagtgcataggtattgttcctattatcatcaatcaaaacgttacagcccccctaaagcttcactgtaatgacttcccctggcgtcgtccccctaacctcaatgtccatatcgctgagccagagcatcaaaactgtcgtcactgttcagagagagaagccccatggtctcagaaatgtcgggattatccgtggctcatagccccgttaagaaagtggctcgtctttataatattttatatccagccctccctcttcaaaccgttaatccagtaatttcatctccagcgcccggctcatcgcttgagtgcgactattcactttgagcttcgcgtagatgtttttgatgtgccatttgaccgtctcggcagaaatagcgagggagcgagcaatttctttattcatctgaccttcagcgatcagttgtaatatctgaaattctcgctcgctgagttccccttgaatatcggggcttccactattaaacggtgttccatctgcaggcgcgcgcttgtcggcccagggttcatgcactcccccttcctctttaccagccgaagaggattcattcataccggcaagcaaaggttgcaaggtatcgccagcgtcaagaaagaggcctttgagatgctggtgttcagccagctgcacgactggctgaaatgttgtgcgcgcagcggcagttttgccgctgctccacaaggctaatgaccagagcgtacgcagacgcgctgcggttaacctgtccccccggttttcctgatcagagaccatgtcagccaggagaatacaggcttgcggcgcctggcctctggcgagaagaaggcgacagtggctaagggatgcatacagaacgatagcgcgttgacagggatgttcggcatccattcggaagctggcggccatttgttcaagctgtcgttgcagttgctctgcgcctgtgaaattgccgtgctgcagtcgcactctcacctgctcggctaacatcatggcctggagccgttgccagccgcgagacacggcaagacgctgcgcatgctccagcaatcgctcggcctcatacggcatatcgccatccagggcctgacgcgcgagataggtatagcaacgactcagcgcatcgggtggactgaatcggtcgatgaattcgagccggtcggctaacagatgatcgggcgagtcaccactctgacattcataggctatctccgccagcagcggcgccagcgtcgcgccactggtcgactgggtaccggtataacattcagcctggcgcaacgttttctctgcgtaccacccggcttttcccagatcgccctgacaaagatggcactgggcaatgataaacgcgcgataaaccgagacaaacagattatctaaaggactttccggagagggcatatgctgttgaacctccagcgcgtcgtgatagcgctggttaacaacatggcaatagctgagaatattgcatatcagaccatcaacccaggtgtcgccgcagggcacttcggccagcaacggctgaactatagccagactctccgggatgttttccgcaaaggcttcgcaaattgcccgcacaacgcgcaatttacaccaggtgctgcgggttaaatcatcgcgatgatgcagtaccatctgatcgaggttatcaagcaactgcctcgactcatcaaagtggaaataatgcgccagtgcccaggccaggttaatttgcaggtcaatgcgcgacggatcggtgctgggcggtaaatgatgcatccatgaaatcagggtatcgatatccccttcttccgccagtgactgagcgcttgcgccgtcctgcacggggctatgcaccggcttgcctgcgctgagcgcatggcgtaccgcctctgaccacagcttctgttcgacgaaccactgactggctaattcatgtagctgtttgcggtcaatatcgttgttctgctgcagcatggtccgaagattttcctgcaacagaggatggtagcgaaaccagtagccttgttcgtcaagggctgacaaaaaaaggttgtgtcgctcaatccatgccagcatcgctttactatcatcacgtccagtcactgcattgcatagttcggcatttaaccgactgaggaaggacgttttcaccaggaaatcgagaacctcttccggcagcggatccagtaccacctctttcagatagcgggcaatggatcgtgttcctccatgcatattacgcaacagatgctcgggatcattctgtaattctgccgacaatgaagcgatcttcatgcccgcgatccagccctctgtcacggactgtagccgctgtgcatgatggttgctgaggggtagcgcaaccgtgcggctaaaatagtgttttgtttcttcgagcgtgaattgcaggtctcgatcatagatctccaccagttggtcctgggcctgcagctggctcagcgcaagattcgggtggaaacggctgccaatgatcagatgcaaggcggcaggcgcatgcttgattaaataccccagcgcttcatagaccccacgatcgttaatcacgtggaagtcgtcgataatcaggtacacgtcatgcgggcagtagtgtagctggttaatgagcccggccagcagttgctcggagctggagagcttctgctcttccatgtcacgccagaaatcggcgtcccagtcagcatagagtggacgcaatgcttgcagcagataaggaataaactgccatacgtcatcatcatcctcatcgaggctcagccaggcaatacgttcgccctgggcgaccatctgctgatgccattgcgccaacagcgtggttttgccaaatccagcgccggcgcagacgacgcccagccggcactgctgaacgggactgagaagctgaagcagccgggggcgctccagcaattgtattgaggagcgaggcgggacgaatttggtcaggattagcggcaagcctcgcgtcagccgcaatggcccggagaccagtgagggtgattggcgaccttctaaatccaatggcttcatccgtggtgtctactcgctttgtttttttcaattgtacgccagcccccgggatgacatggggcagccaaactttattgctacacaaaatttagaaagtttgacctcaagcatgaaaacccccacctacccccccatgaaggtggcttcgcactccctttaaccgctcgtagattcattgcatgggtgtggccagggttatccgccctgtctgttggccccgcctgggtgacctttattgaggagaattaaacgatgctcagcaaacaggcgttattgcaggcttaccgcaagatgcgggagatcagaacatttgaagagcggttgcatcaggaaaataccagcggtgatattccgggcttcattcacctttacaccggtgaggaggccatcgcggtgggggtctgcgaaaatttaacgagcgcagattttattggttcaacacaccgtggacatggccactgtattgctaaaggttgcgacattcacggcatgatggccgaaatattcggtaaggacagcgggttatgtcgcggtaagggcgggtcgatgcacattgccgatctgtcgaaaggaatgctgggggcgaacgctatcgttgggggagcccctcccctggccatcggcgccgcgctaacggcaaagacgctaaaaaccggcaacgtcggtgtctcttttacgggcgatggtggttctaatcagggcctggtctttgaagccatcaatatggccgtcgtgctccagcttccagccgtctttattttcgagaataacggttacggcgaagggaccggccatgactacgccgtgggtgggcgtgatatcgcccggcgcgccgctggcttcggcctgccggcagtgaccgtcgatggcaccgatttctttgccgtttatgaggcaacctcagaggcggtcaagcgtgcgcgagaaggcggtggcccaagcgtcattgaggccaaagccttccgctggcatggtcattttgagggcgatcccgcgctatatcgtgcggaaggtgaagtgcaacgcctgcgtgaacaacatgatccgctgaagattttcaccgctaaggtcaagcaacatatcacccaggaagaactggcggcgattgacgaggaagtagaagccctggtcaacgatgccgtattgaaggcccgcgccgctgcctacccggctccggaagacctgctgacagacgtgtacgtctcatactgagggtgataaccatgacaataaaaacctatcgtgaagcggtcaaggaagccctggctcaggaaatggaacgcgatgaacgcgtggtgctcatcggtgaagacttgcgtggcggtcatggcggaaatgcgcccgaagaggcgaaaatagaagcctttggcggtgtgctgggtgtcactaaagggctgtggacgcagttcggctccgatcgggtgatcgacacgcccattaccgagtcggccatcatcggtatggcggccggcgccgcagcgacgggtttgcggccggtcgcggaattgatgttcatggatttttttggcgtgagtcacgatgcgctgtacaaccaggcggctaagttccgctacatgtttggtggcaaagccagagctccgctggtgatgcgagggatgatcggcgcggggttttctgccgcagcccagcattcacagtcaccctataatatctttgccaccacgcctggactgaaggtggtggtgccctcgacgccttatgacgtcaagggtctgttaatccagtccattcgcgacgacgacccggtggtattctgcgagcataaaatgctgtacgacctcaagggcgaggtaccggacgagatctataccatcccgctaggtgtagccaactacactcgcgaaggggaggacgtcaccatcattgcgttgtcggcaatggtacataaagcaaaccaggtggcggacaaactggccagagaggggatctcggtcgaggtggtcgacccgcgaaccatttcgccgctggatgaggaaggtattctggaatcggtggcgtccacggggcgggtcgtgattgtcgacgaatccgctgcacgcttcggttttgctcatgatgtcgcggcgctgattgcgtcccaggcattccatttcctcaaagcgcccgttctgctggtgacgccgccacacacgccggtcccgttctcccctgctctcgaaaaactctggatccctggcgttgaacgtatcgaagccgccgtccgtcaagtgctggaggattaacctatgagcgaaatcaagacgcttgaaatgccaaagtgggggctttccatggaggaaggcttgctcgctcgatgggcaatccaggagggtgacgatttcaccagagggcaggaaatctgtgagattgaaaccagtaaaatcgtcaatgtgctggaggccccctttgccggtacgttacgtcggatactcgcccgcgagggtgagacgcttcaggtaggcgccgtgctggccctggcggctgacgcgtcggtcagcgatgctgaactggacgaatttgttgcccgcctggcgacggcgaaacccgcagccccaggcccggaggctgccgcgccggacgtagcggcacaggcaggcgctaagccagcttccgttgtttccccgccatccaacagccccgagccccctgttgggcagaccgtcatccccgtcagtctgcaaggcgtgaccgatgtgactcaggttaatgccacgccccatgcgttacgactgtctgcccgctggggtgtcgacctgaaaaaagtccgcggcagcgggcgcggggatcgtatctctgtatctgatctggaaagcgcgatcgttgccgccggcggtcgcctggcctctccgacgcctcccgttcgtcgcagcaaagcgccccgctcgcatgccgatgatagccaggtatcggccaccccgctggcgcgccgtctggccggcaaactgggtatcaacttacatgactgccgaagcagcggttcacgcggtcgggtgagtcgcgatgatgtgctggccgcggcgttgttactcgacgagcaaccgcagaccagccctgtgcaggagagtgccccggcaccctttgagagcatcccgatgtccggtatgcggcgggctatcgcttctcgcctgcaaacgtccaagcaacagtctccccatttccgtttgagcgtcgatctcgatctggagcgactgttagcgttacgtcaggacattaaccgcgaagtacccggcgtcaagatttcggtgaatgacctgctggtgaaggcctgcgccctggcgctggtggccgtgcctgacgtcaatatccagtttgatgaagcggcacaaagtatccgccgctttacggatgccgacatttcggtggccgttgcgctgcctgccgggctaattacccctattgttcgctcggcgaaccggaaatcgatcagcgacatatcgaacgaaattcactcgctggtgaccagagccaaagcgggcacgctgaagccggaagagttccagggcgggacctttagcctgtcaaatctggggatgctcggcgtccggcagtttgacgccatcatcaatccaccgcaaagcgcaatcctcgccattggcgccggagaggtccgggcggtagtacgcgacgggcaaatcgtcgcgcgccagcaaatgacggtatcgctatcctgcgatcaccgggtcatcgatggcgcggcaggtgcggcttttctccgggaactcaagcgactgattgaaaccccgaccttgatgtttatccaggagacgagctatgcacgataaatacgatgtgctgatcatcggcgggggtcctgggggatacgttgccgccatccgtgccggccagctagggcttcgtaccgtattagtggaaaaacaacatctgggcggcatctgcctgaactggggatgcattccaaccaaggcgctgctgcatggcgctgaggttgcgcacactatcacccatgccagtcagctgggcatcagcgtgggcgaggtgaacgtcgatctgcagaaactggtgcagtttagccgtaccgtatcgcaacagctcaccgctggggttgcgtacctgttgaagaaaaatggcgtgcaggtcattgatggcaccgcgcggctgcgcggcaaggggcaaatcacggtcgaggatgcccgaggggaggcgcgcgattaccgggccgatcacgtgatcctggcaaccggcgcccgaccacgcgcattgccaggcatagcgccagatggcgaacatatctggacctatttcgaggcgctgcggcctaagcttttacccaagtcgctcttaatcatcggttcaggggcaattggcgtcgagttcgccagcctctataacgatctgggctgtaaagtgacgctggtcgagctagcgtcgcagattttgccagtggaagatgccgaggtgtctgcagcagtgcgtaagtcattcgaaaaacgcgatattcagatccatacccagaccctggtgacgcaagtacagctcaccgataccggggtgcgctgcacactaaacaacaccggcggcgaatattctcaggatgtcgaacgtgtgctgctggcggttggcgtacagccgaatattgaagatctggggctggaagcactgggcgtcgagttagaccgcggttttatcaagacggacgcggcttgtcgcactaacgtattcgggctttatgccatcggcgatgtagccggcccgccgtgcctggcgcacaaggccagccacgaaggcgtgatctgcgttgagacactggccggtgtcgaaggcgcccaccctctcgatcgcgactatgtgcctggttgcacttatgcccggccccaggttgccagtctgggcctgacggaatcgacggccctggccaggggacggcccgtcaggatcggtaagttctcttatcagagcaatggtaaggcgctggccagcggcgagacagagggttttgtgaagacgattttcgatgctgaaaccggcgagttgctgggcgcgcatatggttggcgcacaggtcacggaacagatccagggctttggcatcgcccgtcacctggaggccacagacgaaagtctcctgtcgatgatctttgcgcatccgacactttccgaagcgatgcatgaatcaatcctcgcggcctgcgaccaaccgttgcatcaataaaaaataagggaggcgatagctgtgcgatacggagtaagttcccgttatccctcccgcactccccggcagaagatccccaacaacggttacggcaggatctattgatctgaaacgctaagcgccatgcgtaaattctgtatgtttagtagacaaccaaacgacaggaggagcgctctatgacacagcacgaaaggttttgccaggcctgcggaatgccgatgtccgcacccgatgcgcaaggggccagcgataaatattgcgcgtattgctgcgacagcgacggtaatttgaaatcctgggaagaggccgtatccggtctggcggcttttctcgacgcctggcaaaaggtgggcgtagcggaatcacggaaacgggcaaaacgttacctgacggcgatgcctgcctgggcgcacaaagcggacgagtaatttgcccgggcggctagaggaaatcatcccggggacagaccgccatgccgacaacattgctatagcgttttcgtacgccatccggacaggaataaatgcgcgtttggggatgacgacctgaaggctggagcatgcatggatgcgttcttcatgcggatgaaataaacgcctggcgttctccccttgtccggatgcgttattgcctggtttttaaggggtcggtttctgtatttaacccagaacttctcaggtaatacaacatattgatgtgatgaatctctcatttcaacgataccaactggacaataagttatcgcgtgtgttagttatttaatcacgcaagagaacagatttaatttaaacaaaagttaaacctttctcactttgctaaaaaattgtattgataatgctttggatccctgaaccattatcaaaagggtatgtgaacagaaagccctcagagacgcgagtctctgagggctttttttttgtttttttatctcaggagtaaacaaatgtctaaagaacgtcgtctctcaagaatattcgcaaaagacggtaaatccgtgaccttagcgctggatggctactatttttccacgaaaacaaatggtattgataatacgataaatcagctccctgctctggtggaacacggcctggattgcgcgcttgtcacgtacggcatgttgaagaattatcgggaagcactgaacagcgttcccgttgtgttacgcgtcgacagcacggtcagtatctttgacaataccgttcccgatactacccccgttttttccgtcgaagatgcgcttaaagtcgctgccgagggcgtggtctgcatgaccttccccggcgccttcaatgaagaaaaaacccacattatggcgatgcaactcgcacaggcagcggatcgctggaatgtaccgctgattgtcgaatcgctcccgtatggttatcccgtcaccagcgatgactctaacaatccggccatcatcgctgcatcggcccgcgccgcggtggagctgggcgcggacgtcatcaaaacgcgttttaccggttcaccagaggaccgactgatcgttgaagctgctggcgtgccggtgcttgccttaggagggccaaaaaccggcatcgacggttacttcaaatttgttcagcactgtatgcagatgggtgcgaaaggcgttgctgtgggaagaaacattacccaggatccgcagccggcgaaagtggtagcaggtctgaatgccatcatccatgaaaacgcaacagcggaagatgcatacagcctctacatggctaaataacatcggaaattaatatgatttcaaataacaccatcatcccttccatcaggaagtataaatactttgagaaagcattatcctgccagtcagaatatgtgctgctatccgaagcgaatatcggcaatctgcagtcgctgattggcaaatgccatcaaagcggtaagaaggtcctcgttcaccttgaattactgggcggctttaaaccggatcaggcggggatcaatctgctgaaaaattattacaaggttgatggtgttatttcttccaatctctccgcgctacgctacgccaaaaaagagggattgctgaccgtatatcgggttttacttatcgattcgcgatcgcttgatcagtcgctcgatattgttaaacacagtccaccggacgcaattgaaatcttacctgctgaatatgcctgccagtgtctggagttgattagccgaaatttgaaaggctttgatgtggtattcatcgccggaggctttgttaagcgcaaataccttgtagataaaatattccatgccggatttaaagggataaccaccagcgagcccggcttatggtaaccaataaggagtccacgcgaatgaaagatgaatacgtcatgggcatcgacaatggtggaaccgtcaccaaggcagccatctatgaccgtaaaggacaggtgctcgccatcgcctcaaaatccacgcagatgctgacacctcgggaattccacacagagcgcagtatcgatgagctgtgggccgcgaatgtcgaagtgattaaaaaagcgattgagcaatcaggtatcgacgccagccagataaaaggagtggccgtcaccggtcatggtaacggtctgtatctggtcgacgaagaaggtcacccggtgcgtaacggcattatatccaccgatagccgggcaaaagagtacgttgagagatggcaacgctcgccagaattccttaccgacattttgccaaaaacgatgcagtccatctgggccggacaacctgtcgccctgctggcatggctgaagaatttcgagcccgagacgctgcaaaaagcgcgttatatttttatggtcaaggacctgatccgtttttacctgaccggagaggcttttcttgagctgaccgatatctcagggaccaacctgatcaacgtacgtgactgcaagtatgacgatgaactactggcatggtggggacttgatgaactgcgggacaaattgccccccatcaaacgctcaacagaatgctgcggaaaaatcactgacgacgtggcccgtctgaccggtttatgcgcaggtacgccggtttctggcggggtgtttgatatctcggcctcttccattgcctcggggattaacagtctcgataagatggcgatcgtcaccggcacctggagcataaacgaatacgttaccgaccacccggttattgataaagatctgtttatgacctccatttatcccattgaaggtaaatggctcatcaccgaggccagccccacctccgcgagcaacctggagtggtttattaacaactttatggagagcgatcggaaaacctccgccgaacaaggatcgtcggtctatgacctgtgtaataagctggtttcatcaacgacgccggatgaaagccacctgctgttctttccgttcgtgtttggctctaacaccattcccgacgcctcggccggctttatcggtgtcaacagcttccataaaaaagcccattttctgcgggcgatttatgagggcgttgccttcagccatctctaccacaccgagcgcttacgcaatattaacccgaagctaagccgcactattcgtattgctggcggcgtcacgaactccccggtctggctgcagatattcgccgatatcttccaggccacgctggaaatcgttgacgtcaaagagcacgggaccctgggtaccgcgatgaccgccgccgttatggtgggctggtttgcggaggtatttgctgcctcaaacgacatggtccatgtctcacgcaccgtctcccctaatccggaaaaccaccgggtctaccagaccaaataccagctttataaaaacctgttatcagaaatgcagtcgccgtggaaaagctgcagcaactacatcgcgcactaagtgaggaaaaaatggatctgaatttaacgaatcgtacggccatcgtgacaggcggcgcaaccggcctggggaaagagtttgttctttctctcgccaaagaaggcgtcaatatctgctttacctatatgcgtgaggaagagcatcccgaacggctgatcgaaacggtgaaggccagcgcgaacgtagagatcatcgcggtcaaaaccgatctctctgacgaacagagccgggaaaatctgtttgccacctgtatcgacagactgggtaaagccgacattctggtgaataacgccgggatctggctgagcggctacgtcaccgagatcagcccgcaggactgggatctggtgatgaatgtcaatctgaaagccatcttccatctcagccagctgtttgtaaatcactgcctgcagcatgaccagatgggcagcattctgaatattacctcgcaggccgcgttccacggctccacgacgggacatgcgcactacgcggcaagtaaggccggcctggtcgcctttgctatctctctggcgcgggaagtcgccaaacaaaaaatcaatgtgaacaatatcgccgtcgggatcatggatactgcgatgatccgtaagaacattgagcaaaaccctgactattacgtcagtcgtattccggtgggccgcgtggcccagccgcaagaaattgccgacatcggtgtcttcatggtttctcctaagaccagctatatgacgggagcaactctggacgttaccggcggtatgttgatgcgttaatctagggagaatcattatgaaatgtctggcaattgccgatctgtttatcaatgcagcgatgatggaatcaggactgaaagcgctcagggataacgggattgaagtagaagtacgcgagtggtcacatggctccgttgagaaacttcaggaagataatctgcgggttgaacaggaaggagcagaagccgtggccttaccggaagcgctgcttcagggaacggatgatattgacatcctgatcactcagtttgccccggtcaatactgcggtgttcgataaactaccaaagctgaaatatgtaggcgtgctccgcggtggtgtggaaaacgtgaatcttcaggtggcgaacgcccggggcgttgaggtgatgaacaccccggggcgtaacgctcgcagcgtcgccgaattcacggtcggcatgatcctggcggaaatgcgcaatattgcccgttcacacgatgccctgcgtgacaaatactggcgtaaagacagcccgaaccatcaggcaatccctgagcttggcggaaaagtcgtggggctggttggcctcggtcatattgcccaactggtcgcgggatttctcagcggctttggcacggagattatcttttacgataagtacgttgcaggccatgaacgttatgagaaagtcgattctctggacgaactggtacaacgcgccgacgttatctcgttacatgctcgcctgacgccggaaaccgaaaatctgattaacgcacaccatttcgcgctgatgaagcgcagtgccatcattgttaacacagcacgctccgggttaatcaatgaaaaagagatgattgatgcgctcagatccgggcaaatcatgggcgccgcgcttgatacctttgatgacgagccgcttcctgacgacagtgcattctatactctgaataacgtgactattacgccgcatattgccgggagtaccattgacgcattcagtaattcgcccaaactcttcgctgagatccttttaaagaaactcagttaaatattaaaagaaccattaaaggtattaacagggcccaatgggcacgggtttactcgtgcccaattcgcccgccttttaaggaatcattatggatattatcaacagcattattagtctgggggcatcagtaatgatgccagtaatattctttattatcgcgctttgctttggcgttaaaatcggtacggcatttaaagcagggatgctggtaggcattggttttgaaggggtggggctggtgattggcctgctgctgacaaacctgggcccggcatcgcaggcgatggttgagcgtatcggcctgcagttaacggtcgttgataccggttggcctaccgcatcgaccattggttggggttcgccgctgatgctgcccgtcgtggtgggctttatcgtcatcaacctggccatgcttctgttgaaattaaccaaaacggtgaatatcgatatttttaactactggattttcctgatcatggggtctgtggtctatgccggaacgggaaattactggctttcggtcggtattacattcgctatttttgtgttgacgctattggcggcagatttaacggcgccgtatttacaaaaaaactataatcttaaagggatatcattcccccatcttacctgtatagcttacgtgccgtttggcattgcctgtaattacatcattgataagatcccgcttatcaataaaatcaatttcgacccggaaagtattaataaaaaattcggcgtttttggcgagcctgttaccctggggtttgtgctgggactgctgttggccttcctggctggatatgacgtttccgcggccgtttcactggccattaaggtttcagccgccatgctgctgctgcctaaaatgattgaaattctggtgcagggattgttgattgtccgtgatgccgctgaagcaaaactgaaggctaaattcccggggcgcgatttttacatcgggatggatacggcgttactgatcggtgaaccttcggtactggcgaccggtctgctgttaatccctatggctgtggtgctgtctatcattctgcccggcaaccgcgtactgccctttgtcgatctggcttcattaatgttcctgctggcaatggtcacgccgttctgtaaacgaaatatgttccgcatgttcataaccggaaccctgatcgtgacctgcatcctgtatgtcgggacggacatttcgcaagaatacactcaggcggcggtgaactcgcatattccggtgccggaagggatggccgagatcaccaatatcgtcggcggcgccacgacgcctgtcggctggctcgccgtcaaatttggcgagttttttagcgccacaccttagtacaaggccactcaagtaaacagagggcaaactgttgccctctgtttcttcctcttattctgtgcgctgaatagctggctcagctacgcccctggtttgaacatctgaccagcgcgtccgccccctgcgcggcgaggtggctcatttcttttgtaccccctcccgttttcaacccaacctgctatgctccttctttccctgttctctggagatcccgatgctgaccatctggggccgaaaaacctcctctaacgtgcaggcgctgatgtggtgtgttggcgagcttgggctggactatctccggttcgacgtggggcatcgctatggcggtaccgacagcgaggcgttttatcagctcaatcccaatcgtacggtgccagtgctgcaggatggcgataatccgccgctgtgggaaaccggcgcgatccttcgctatttagccagtcgctacgccgacgacgccttctggccgggcgacctgctggctcgtactgaggttgatcgctgggccgagtggtcaaagcagaatatcgccctcggctttacggcgccggtgttctggcgcgtggtgcgcacgcctgccgccgagcgggatccgcaggccatcgccgcggcggtgacggccctggagcaaaagctggcgattgccgaggcacgtctcgccggcagtcgctatctggtgggcgatacgttcaccctggccgacatccagtttggtcatgtgctgtaccgctactttgccatcgatatcacccgtcgtcccctcccccatcttgcggcgtattatgcacggctaaccgcacggcccgcctttcgccagcacgtcatggtcagctacgacgaactgaaggtctgaaggtggtcggtagcgcctcctgacgctaccgacatgccggttaacgcgccatcagaacaaacacgccccagccgagatattcccgggtccaggtgacatggtgcagcggcgcggtggtcaactgctggcgaacctccggtgcgaagtcatcgtgcggattggcctccagccagcggcgcattgtcagccatttcgccgcttcataacgatcccagccctcctggtcggccagcaccatctccaccacgtcatagcccagttcgccaaagtgggcgaccagcgccggtagcgttaggaagtcatcgggtgactgcgcgccgcaggcaatcgcctcttctgccgtggccggacgtttgcgccaccatggctcgccgataagcaacatgccgcctggggtaaggctctgcttcagcagctcgattgtgcctgccaccccgccgccgatccacgtggcccccacgcaggtggcaacatcgcacggctggctggcgacatatccgctggcatcctggtgcacaaaggttacccggtcgcttaccccgagctcctctgcccgggcggccgcctgctgactgaacagcaggctcatgtctacgccggtgccgactatctgatgatcgcgcgcccagctacagagcatctcgccggagccgctgccgaggtcaagaatggtggtgcccggcgccattcgcagcgcccgtcccagcgtggcgtacttttccggggtaaaagggttatggatacggtgctcgctttcactgatggtaaaaatgcgagggatatcgatcatgaggttttctccttgagagccaaacgcccgggcagcgaccctgcccgggtcgctatttcagcggttgtccgcttgcgcgcgaacgttattcaaaccggtcgtgttgatccggtacggctggccgttcaccgacttaatcagctttttggttttgagctttttgaagaccgcaagggtgcagtcgctcagcaacagcccttcgcgggtgtagcattcaacggcggtaatgcggccggaggtatcgcggacgtgcgcaatacggccacctttggcgagaacgtgtaaggtccgttgttcctgacgggataaattcatactgaaacctgttcattatcatgtgcgaaaacatgcctacacccgcaggtgtgtgcgtaaggtttaagcgcagcgataatcagtccggcctgggcaggtcgggaaactgattatctgataatgacattctccagcatcgaagcctcagtgagcattgaaaggtatttaccggctgaatattaacaccgtcatctggtaaggatattgtgcagattaaaaactgtgaccggtattacgatttccctcggccttatccccattttgcgctatccgccacccgctctgttccgcaactttcaccaccaccttatcccccctcccgcattgttaaataattgttgtcagatcacaaaatggaaacaaaaaggccatttcgtacgcattttataaaaatgtagatatttttaatttatggctacgaaatgaacatcaccctgaccttacagcgaggaacgatcctgatgaacgccctgaccgcagtaaaaccgacacccgcgccggtagcccagcaataccctggcttttctttcaccccttccgcccagtcgccgcgcctgctggagctcaccttttccgccgaaacgaccacgcagttcctgcagcaggtcgcgcagtggccggtgcaggcgctggagtacaaatctttcttacgcttccaggtcggcaagatcctcgacgatctgtgtggcaatcagctgcagccgttgctgatcaaaacattgctcgatcgcgcggaaggcgcgctgcttatcaacggcgaagggatcgatcacgtcagccaggccgaggagatggtcaagctggccaccgccgtcgcccacctgattggtcgttccaacttcgacgccatgagcggtcagtattacgcccgcttcgtggtgaaaaatgtcgataactcagacagctacctgcgccaaccgcaccgggtgatggagctgcacaacgacggcacctacgtcgaagagcaaaccgactacgtattaatgatgaagatcgacgagcagaacatgcagggcggcaattccctgctgctgcatctcgacgactgggagcatctcgacgaatttttccgcgacccgctggctcgccgcccaatgcgttgggccgcgccgccgagcaaaaacgtcagcaaggatgttttccacccggtgttcgacgtcgattcgctgggccgcccggtaatgcgctatatcgaccagttcgtccagccgaaagatttcgaggaaggcacctggctgagccgcctctccgacgcgctggagaccagcaaaaacatcctttccataccggtgccggtgggcaaatttctgctcattaacaccctgttctggctgcacggccgcgaccgctttacgccgcacccggacctgcgccgcgagctgatgcgccagcgcggctactttgcgtattccacgaatcattaccagactcatcaataagggttttcaggcgaaggaattgagcggatgtatgatttcgtgattatcggcggcggcatcatcggcatgtcgaccgccatgcagttaattgagatttacccggacgcccgcattgcgctgctggaaaaagaggccggcccggcctgccatcagactggccacaacagcggcgtgatccacgccggggtgtattacacgcccggcagcctcaaggcgcagttttgcctcgccggcaaccgcgccaccaaggccttttgcgagcagaacggcatccgctatgacgtctgcggcaaaatgctggtcgccacctcaccgctggagatggagcggatgcgcgccctgtgggatcgcaccgccgccaacggcctgcagcgcgagtggctaagcgccggggagctacgcgagcgcgaaccgaacattaccgggctcggcgggatcttcgtcccttccagcggcatcgtcagctaccgcgaagtggcggcggcaatggcgaagaacttcgaagcgaaaggcggaacgatcgtctacaacgccgaagtcagcgccctgaaagaacatgccagcggcgtggtgatccgcacccgccagggcggagaatatgaggcctcgacgctgatcgcctgttcgggcttgatggccgatcggctggtaaaaatgctcggcgtcgaccccgggtttatcatttgtccgttccgcggcgagtatttccagctggcgccgcagcacaaccagatcgtcaaccatttgatctatccgatccccgatccggcgatgccgttcctcggcgtccacctgacccgcatgatcgacggcagcgtcaccgtcggccccaacgccgtgctggctctgaagcgcgaaggctaccgcaagcgcgatatctcgctggccgataccctggagatcctcacctcgcccggcatccgccgggtactgcaaaacaacctgcgctccggactgggcgaaatgaagaattcgctgtgcagaagcggctatctgcggctggtgcaaaaatactgcccgagcctgacgctgagcgatttacgcccgtggccggccggcgtgcgggcgcaggcggtgtcgccgcagggcaaactgatcgacgattttctctttgtcaccaccgcgcgttccattcacacctgtaacgcgccatcgccagcggccacctccgctatcccgatcggcgcgcatatcgtcagcaaggtgcagaccctgctggccagccagagcaatcccggacgcacgctgcgtgcggcacgtagcgtggagacactacacgccgcttttacccgttaaccaccctgaagacaggaagcgtttatgcaactcaacgatatgacactgtttcgccagcaggcgatgatcgatggccagtggcgcgatgcgcccaacggcgacgtgattgcggtcaccaacccggccaacggcgagcagctcggcagtgtgccgaaaatgggcgccgatgaaacccgcgaagcgattgaagccgccaatcgcgccctacccgcctggcgcgccctgaccgccaaagagcgggcgaacattctgcgccgctggttcgatcttatgatggagaatcaggacgatctcgctcgcctgatgaccctcgagcagggaaaaccgctggcggaagccaaaggcgaaatcagctacgccgcctcctttattgagtggttcgccgaagaaggtaagcgcatctacggcgacaccattccgggccaccaggccgacaagcgcctgctggtgattaagcagcccatcggcgttaccgccgccatcacgccgtggaacttcccggcggcgatgatcacccgcaaagcgggcccggcgctggccgccggctgcaccatggtcctgaaaccggccagccagacgccgttttccgcgctggcgctggccgaactggcgaatcgcgccgggatccccgccggagtattcaacgtggtcaccggctccgccggcgcggtcggcggcgaactgaccagcaacccgctggtgcgcaagctctcctttaccggctctaccgagattggccgccagctgatggagcagtgcgcgaaagacatcaaaaaagtctccctggagctgggcggcaacgcgccgtttatcgtctttgacgatgccgacctcgataaagccgtcgagggggcgctggcgtcgaagttccgcaacgccggacagacctgcgtctgcgccaaccgcctgtacgtccaggacggggtgtatgaccgtttcgccgagaagctgcagcaggcggtggaaaaactgcgcattggcgacggcctgcaggacggcgtcaccaccggcccgctgatcgacgagaaagccgtggccaaagttgaagaacacattgccgatgccatcgccaaaggcgcgaaggtggtcaccggcggcaaaccgcacgccctgggtggcaacttcttccagccgaccatcctggtcaacgttcccgacagcgccaaagtggcgaaagaggagaccttcggcccgctggccccgctgttccgctttaaagatgaagccgacgtcattgctcaggccaacgataccgagttcggtctcgccgcctatttctacgcccgcgatctgagccgcgtcttccgcgtcggcgaagcgctggagtacggcataatcggcatcaataccggcattatctccaccgaagtcgcgccgttcggaggcgttaaggcctccggcctcggccgcgaagggtcgaagtacggcatcgaagattacttagaaatcaaatatatgtgcattggcctttaacaggagcgacggatgaacagcaataaagcaatgatggcgcgtcgcagcgacgcggtcccgcgcggcgtcggccagatccaccctatcttcgccgaacgcgcggagaactgccgggtgtgggacgtggaaggccgggaatatctcgattttgccggcggtatcgcggtgctcaataccggccacctgcatccgcaggttgtcgccgccgtcgaagaccagctgaaaaagctgtcgcatacctgcttccaggtgctggcctatgagccttatctggcgctgtgcgaaaagatgaaccagaaggtgccaggtgatttcgccaagaaaaccctgctggtcaccaccgggtcggaagcggtggagaacgcggtgaagatcgcccgcgcggcaaccgggcgcagcggcgctatcgccttcaccggcgcctatcacggccgcacccactacaccctgtcgctgaccggtaaagtgaatccttactccgccggtatgggcttaatgccgggccacgtctatcgcgccctctacccgtgcgcgctgcacggcgtcagcgatgacgaggcgatcgccagcatccatcgcatcttcaaaaacgatgccgcgccggaagatatcgccgccatcattatcgagccggtgcagggtgaaggcggattctatgccgcctccccggcctttatgcagcgcctgcgcgccctgtgcgacgagcacggcattatgctcatcgccgatgaggttcagagcggcgcgggccgcaccggtaccctgttcgccatggagcagatgggcgtcgcggcggatatcaccaccttcgccaaatccatcgccggcggtttcccgctggcgggcgtcaccggccgcgcggaggtgatggacgccatcgcccccggcggactgggcggcacctacgccggcaaccccatcgcctgcgccgccgccctggcggtattgcagattttcgagcaggaaaacctgctggaaaaagccaaccagctcggcgataccctgcgccagggcctgctggcgatcgctgaagatcatccggagatcggcgacgtgcgcggtctgggggcgatgatcgccattgagctgtttgaagagggcgaccgcagcaggccgaacgccaggctgacggcggatatcgtcgcccgcgcccgcgacaaaggcctgatcctgctctcctgcgggccgtactacaacgtgctgcgcatcctggtgccgctgaccatcgaagaggcgcagatcgagcaggggctcaagatcatcgccgactgctttaacgaggcgaaacaggcatagagaaacaggcatagaacagaacacatgcggaagcgaagtacgttcgtaagggaatgaagacgagacctgcaaaacaacaataatacgcgtgccccggcgcgggaacgtcggggcgctctcccaggtgacacacttcgagagggtaaatgatggggcaactgtcgcaatcacaggatttaggggcggggctgaagtcgcgccacgtcacgatgttatctatcgccggggtgatcggcgcgagtttatttgtcggctccagcgtcgccattgccgaggcaggcccggcggtgctgctggcctatctgtttgccgggctgctggtggtgatgattatgcgtatgctggccgaaatggcggtcgccacgccggatactggctccttttccacctacgccgataaagccatcggccgctgggcggggtataccatcggctggctgtactggtggttctgggtcctggttattccgctggaagccaatatcgcggcgattattctgcattcgtgggtgccgggcgtcccggtgtggttgttctccctggtcatcactctcgccctcaccggcagtaacctgctgagcgtcaagaactacggcgaattcgagttctggctggcgctgtgcaaagtgatcgctattctggcgtttatcgtactgggcgcggtcgccattaccggcttttatccctatgccgaagtgagcggcatttcgcggctgtgggaccacggcggctttatgcctaacggcttcggcgcggtgctgagcgcgatgctgatcaccatgttctcgtttatgggcgcggagatcgtcaccatcgccgccgccgaatcggataccccggataaacatatcgtgcgcgccaccaactcggtgatctggcgtatctctattttttatttgtgctcgatctttatcgtcgtcgccctcatcccatggaatatgccggggctgaagagcatcggctcctaccgctcggtgctcgagctgctgcatattccctatgccaagctgattatggacggcgtgatcctcctgtcggtcaccagctgtctgaactcggcactgtataccgcctcgcggatgctctactccctgagccgtcgcggcgatgcgccggccattatgggccggaccaaccgcagcaaaacgccatacgtggcggtgctgctctccaccggcgcggcgttcctcaccgtagtggtgaactactatgcccccgccaaggtgtttaaatttctcatcgacagctctggcgccatcgccctgctggtctatctggtgatcgccgtttcacaactgcggatgcgcaaaatccttcaggcgcaaggcggcgagatccgtctgagaatgtggctctatccgtacctgacctggctggtgatcgcctttatcaccttcgtgctggtggtgatgctgttccgtccggcacagcagctggaggtgatctctaccggcctgttagctctgggaattatttgtacggtaccgattatgtcacgctggaaaaagctggtattgtggcaaaaactgccgctgcaaaatacgcgttaaccctgttcccggcgcccgccgggaagagtattcaggagtaagaacatgaccgccattccccaggcgacggccattgacgggtaccgttggttaaaaaacgacatcatccgcggggtttaccaccccgatgagaagctgcggatgagcctgctgacgtcgcgctatggcctgggggtcggtccgctgcgcgaggcgctttcgcaactggtggccgagcggctggtaacggtggtcaatcagaaaggctatcgggtggcgcccatgtcggaacaggagcttctcgatatcttcgacgcgcgcgccaacatggaggccatgctggtgcgtctcgccattgagcgcggcggcgacgagtgggaagccgagctgctggcccgcgcccatctgctcaacaagctggagtcgtgcgaagcgagtgagcacctactcgatgaatgggaccagcgccatcaggcgtttcacaccgccatcgtcgccggctgcggttcgcagtatctgctgcagatgcgcgaacggctgttcgatctggcggcgcgctaccgcttcatctggctgcgcaccaccgtgctgtcggtggagatgctggaagataagcatgtccagcatcagaccctggtggacgctattctggcgcgcgacgccgaacaggccagcgcgctgatgcgtgagcacttactgactccgatcccgattattcaacaggcgatggctggcaagctgtcgccgcaggcagggtgagtcagatggaggggtggaaattacgggtatggcggcacgcatctccacgccgcacgggcgtggagaaatcgtatccgtagatcaatcaggcccgcaggcgaaccggctcgctgaaatcgtcggccggttccagcttcagattaaaggtggtcagcagcgctgctgcgcgctcgtgaaactcgcgcagcgttttttccagcctgtcgctcacttccgggtcgtcaatgtcgaccgcctgccatgatccttccttattgaacaggccaaactggtagctataggtgaaacgtgactcttgtgcttccatttccatccaccagccccagaattcacgcttctccggtgcgggcttaacattgacgcaaactgccaggcaatcgaaaaagaaacggttatcatggcactgctcttcgcgaatgtaaggccccagcgccgtgaatttcttgatcaacttacttttcaggtgtccactcggtaacgtcattgcgatctcctttagtgatgcaactgttttaccaaaccaatagaatttagcaataaattaaccaaatctatgattgatccagcgggcgatctgtcgcaatgcgtgatcaaaattgcgatacaccgggttaaacgggatctccagcagtttgccatcggcagatgacgaggtgattaaccgcgactcctcttcggggctgaacggatcgtccttccagaagccggagagcatcggcgtcgggcaacggcgccccagcagtccctgggtttttaacgaatagcggttgagctccacgcgtagcgcttcatcggacgcgtcatgcatgcccagccgcgaagccagcacgtcaagatacatctccggcacgcgcccctgatgcaggggatccaccagcagaccatgaacgaccgggcccagacaggctacagccttcagccgctgcggctccagatagcccagacgcaccgcgatattggcgccaaagcggaagccgaaagcggcgacccgggtatggtcaatccacggcacattttccagatggcgcagcgcgtgctgatgcagcaggctggtgtcctgatttagcgtccattttgacgagaagccgatggagggcatatcaatggtcagcatggcaatgccgagcggtgagaagtagttctcatacaggttgtaataatcggtctgcagcgagtccagccccccgcacatcagcaccgtcggaaacggcccctcgcctttcggcatatgcaaaaagccggttatcggcgagccgccagggatggtgaactccagctcgcgcagcgagcccggcagccgctgggcggcttcttcatacgcccggttggctaaagcctgcgcctgttccgccagctcatcgcctttaatatgcggataagcggcaatgctatacaggttcgaggcatgcagccagtggcggccgctcagcaaagaatcggcttcctgcccggccttttgctgccactgcatggcttctttcgcccactcgaagatccagttgccgccgcgataaccgatgacggtatcgaacagctcaggatcggttcgttcggcctcgctcatcacaatgcgcgcttgcacatcgaggatctcctgcggagttacgccgcgccagatccacatcaaacggttgatcagacggtaccagtgatcgacgtgattgccgctcagcgccgactgcatcgcctggggttttccggcagaaaaccgacgcaccagcgtagaagtttcgggatgtttgaagcgaggtttaaacagcgtttcgctgaggttagcctgtgacatgtgcagtctccgtcgtagtgccactccggatattgtaacctgctaaaggataaaaaaaaccacgcccggcaagccgggcgtggtaaatagcactgtcctgaagaattaacgacctgcgataggcggtacaaacaccacgcccatatcccacggctgttcaatccaggtatcctgcggaatatccacaacgtaatcgtccaccagcgggcggcctgccggcttggcgaaaatggtgacaaagtgcgctttgggatacatttcgcggatcgccacggcggtaccgccggtatccaccagatcgtcgatgacgataaagccttcgccatcgccttccgcacgtttcagcactttcagctcgcgctggttatcatggtcgtagctggagatgcatacggtatcaacatgacgaatgcccagttcacgcgccagtaaggctcccggtaccagtccgccgcggctaacggcaataatgcctttccattgctcaaccggcagcagacggctggccagtttgcgggcgtgaatctgcaacatgtcccaggtgacgacgtatttttcgctcatgtgaagtgtcccagcctgtgtaatacggcttaaataatgttcgagggggaaaatggttgcgcgagattatagagatctgacgcactaaaaaccagtgttaagcggtttgcgcaacgctttttgcgttgtttacactacctgcggcggtggaaagtggtattctcaaccccatcgcgcaagcccgggcttgttgtgtattttaacgctaaccctcgtcctgcaaccgctgtatgcaggagtctgtaaggagacttaccgtgtctgaactgtctcaactatccccgcagccgctttgggatatttttgccaagatttgctccatcccgcacccgtcctatcacgaagaacagctcgccgagcacattatgggttgggcaaaagaaaaaggcttacatgcggaacgcgaccaggttggcaacattctgattcgtaaaggcgcgactgccggtatggaaaaccgtaagccggtagcgctgcaggcgcacctcgatatggtgccgcagaaaaataacgacaccgtccacgacttcgttaaagatccgatccagccgtacattgacggcgaatgggtgaaagcgcgcggcaccacgctgggcgcggacaacggtatcggaatggcgtccgcactggcggtactggccgacgatagcgtcgctcacggcccgctggaagtgctgctgaccatgaccgaagaagccggcatggacggcgcgttcggtctgcaggccaactggctacaggccgatatcctgatcaacaccgactccgaagaagaaggcgaaatctacatgggttgcgccggcgggatcgatttcacctctaacctggcgctgacccgcgaagcgattcccgccgggttccagagctttaaagtcaccttaaaagggctgaaaggcggccactccggcggtgatattcaccttggtctgggtaacgccaacaagctgctgtcgcgcttcctcgccggccacgccgatgagctggatctgcgtctggtcgatttcaacggcggcacgttgcgcaacgccatcccgcgtgaagcttacgctactgtcgccgtcgccgcggataaagccgatgcgctgaaagcgctggtgaatacttaccaggcgctgctgaaaaacgagctggaggccaaagagaagaacctggtggtgctcgcggaagcggtcgataacgacaaagcggcgctgactcaggcttcccgcgacactttcatccgtctgctgaacgccacgccgaacggggttatccgcaactctgacgtggcgaaaggcgtcgtggaaacttcgctgaacgtcggcgtcgtcaccatgaccgatgacaacgtacagatccactgcctgatccgctcgctgatcgacagcggcaaagactacgtggtcagcatgctggattctctgggtaagctggcgggggcgaaaaccgaagccaaaggcgcctaccctggttggcaaccggacgccaattcgccggtgatgcacctggtgcgcgagacttaccagcgtctgttcaataagacgccgaacatccagatcattcacgccggtctggaatgcggtctgttcaaaaaaccgtatccggagatggacatggtctccatcgggccaaccattaccggtccgcactccccggatgagcaggtccatatcgagagcgtcggtcagtactggacgctgctgaccgagctgctgaaagccattccggctaaataagccccacaaccggcggcggcccgccgccggttttaccccgcatcaccttagcgccacgcgtttttccatccggtaattaataaaccactccccgcgcgccgccacccgctgcttagccaccaccttaaaaccatgagccgtaaaacagggctttgcggtaatgctggcgtccaccgtcaggatttgcgctggatactgagcgcagagcgcctcgataagcgcgccgccgataccctggcgggcacgatccggcgagacgaacagcaaatcgatatgcgtcccaatggcggtgataaagccaaccggctggctgttgaccacggccaccaggccgattgagtcggccagcttttgtcgccagcgcgtctcatccacctgcgcccaggccgcgatctgccccggggtatagtcccgactggcggtttcccgcaccgcgcgcagaaagatctggcagagcagtggcaaatcgctgtcgcggtaagcacgaatatgcatggctaaatccctaataaaagctgcctttccagctgcggatcgagcaacgtcacgtggagcccaaccaggcgcacgccccgtccgccgcggcgctcatcccaggctttgtgcgcggtggcgatcagatcctctttgttcagccgcggccagacgtgctcctgggtggtcagctggaaatcattgaatttcagtttaatgccctggcgggcgatcagcagatcaggtttgaccttcgccagtcgcctctccagctcgggatagaggttttcgataatcgcttcgcactccggccattcatggatatcttccgctaaggtgcgctccacgcccaccgatttacgctgccgatcgttatgaatttcccgctcatcaatcccgtggctgcgctcccacagaatacgcccgaatttaccgaagcgcttaagcagcatggccagatcgctgttctgcacatcgccacaggttcgcaggcccatattttccagcttcgctgccgataccttcccgacgccgggtattttcgccagcggcagcgcccgcacaaactctgccacctgatggggggcgataacgaactggccgttgggtttattcatatctgaagcgattttagcgagaaacttcaccggcgccacccccgccgaggcggtgaggcgcaactcccgttcgatggtctggcggatctcctgggctatcagggtggctgacccgtgacaatgctcgctgtcgctgacgtcaagataggcttcatccagcgacagcggctcaatgcgcgaggtatagcgggagaaaatttcgcggatatggttcgaggcttctttgtaggcatcgaagcggccgggaagcaacgtgagatgcgggcacagcttgagcgccgtcgccgtcggcatggcgctgcgcacaccaaacttacgcgcaggatagttcgcggtactaatcacgccacgttgtacccgactgccgcctatcgcgaggggaatatcgcgcaacgctgggttgtcgcgcatctccaccgccgcaaagaaacagtccatatcgacatggataattttacgcatcgtcagactcaacactgtatacccatacagcatagcaaaaacagatgcgaattttatgctttttttatttcatcggctaaaaaagcggttaaaacataaaactgcaataaattatgtttattttcattgagttaaaagataaatcaggaagatataatcatgaagaaaatacttaccgcgctttgcctgctggccaccgccagcgcctgggccgctccacagctgatagcccaccgcggcggcaccggcgatgcgccggaaaataccctgccggccattaagctggcgctggagaataacgccgaagccatctgggtcacggtgcagttaagccgcgacggcgtaccggtgctctaccggtcaagcgatctttccgcattgaccaatagcgagggcaaagtttccagtttgaccgccgccgagctggcgaaagtcgacgccggctggaaatggggggatgacagccacccgtggcgcggtaagcaggccaccattccgaccttgcaaagcgttttacagcaatggccgcacacttttttctatatcgatatcaaatctccggatgccgatccgaccgtgatgggccagcgcctgcttgaagtgttaaaaaccaccgatagcctcgatcgcgtgcgggtctattccaccgaagaccgctatatcgccgccctgccgccagccatccctcgctttgtcactcgcagtgaaacccgcaccaggcttgccaatatttcgctcagccatcagtgccagccagcgagtcaacgcgatggtgagcagtggtatggactggagctgaagcgcaaagtcgaggtggtggagaaattcacccttggcgaagggatctccccggcgacgctcacctgggataaagaggcaatggattgcttccgctcgcaggataaagcgcacattatcttcttcggcatcaacagtgcggaagactaccgcacggcgatagaactgggcgccgacggggtgatggtggattctccggcgcaggcgaaaagctggcagtaagggagtcaacggctaaaaaagccgcgaaagcggcctcacattgctggcatgttgttgccgggtggcggttggcgccttacccggcctacaaaaccgaagcagcagccccggcatgcgcagcgccgccgggcacggagccgctttatgccgggtggcggctggcgccttacccggcctacaaaaccgaagcagctgacccggcaagcgcagcgccgccgggcacggagccgctttatgccgggtggcggctggcgccttacccggcctacaaaactgaagcagcaggtccggcatgcgcagcgccgccgggcattacaaaatacgccgctgctgacgctgcgcctcgcgggcgaggcgctttttacgcgcgtcgcacggttccggacaatcgcagactttctccagccccagcgcggagatcccaccgcagctgccctggatgctcttgcgcttcaccaggtagcccagcgacatgccgaggatcaccagcgcaaaaatcacaaaggtcgcgataaataccgtcagcatcgtcagcctccaaagtcgtcgaggagaatattctcgtcctcgacgcccagatctttgagcatcttaattaccgcggcgttcattaccggcggcccacacatatagaactcgcagtcttccggcgccgggtgatcgcgtagatagttctcgtacagaacgttatggataaagccggtatgcccggtccagttatcttccggcagcggatcggagagcgcgacgtggaaggtaaagtttggattgtcgcgcgccagctgttcaaactcctcatcgtagaacatttcgcgcagcgaacgggcgccgtaccagaagctgattttgcgcgtgctgtgcaggcgcttgagctggtcgaaaatatgcgaacgcatcggcgccatcccggcgccgccgccgataaacaccatctcggcgtcggtttctttagcaaagaactcgccaaacggcccggaaatcgtcaccttatcgcccggcttcagcgaccagatataggatgacatgatccccggcggcgcatccgggaccttcggcggcggcgtcgcgatgcgcacgttgagcataatgatgcccttctcttccggatagttagccattgagtaggcgcgcagggtcggctctttcacctcagagacatagcgaaacaggttgaacttatcccagtctgaacggtattcatcgggaacatcaaaatctgcataggccactttatgcggcgggcattcaatctgaatatagcccccggcgcgaaacggcaccacctccccctccgggatccgcagcttgagctctttaatgaaagtggctttgttatcgttagagataacttcacactcccattttttgacgccgaaaatctcttccggcagttcaatcttcatgttctgcttcaccgccacctgacaggccagacggcaaccggctttggcatcccgcttggtaatatgcgaaagctcggtcggcaggatatccccgccgccctctttaacagttacccgacactggccgcaggagccgccgccgccgcaggcggaggagacgaagatcccgttgctggacagcgtgttcagcagtttgtcacccgccggggtgcggatctgtttatccgcttcgttattgatctcaataaccacgtcgcccgcgttcaccagctttgagcgcgctgccaggataagccccgacagcaccagcacaatcagcgtgaacatcacgacgccaagaataatttccatacttattcgcccttatagctgcacgccggagaaggacataaagcccagcgccattagtccggtggtgataaaggtgatccctaacccgcgcaaaccggcgggcacgttggcgtacttcattttttcgcggatccccgccatcgccacgatcgccagcatccagccaataccggagccgaagccgtagacgatggactccgggaagttgtaatcgcgctgcaccatgaacgacacgccgccgaaaatcgcacagttaaccgcaatcagcggcaggaagatgcccagcgcgttgtacagtgccggaaaatacttatcgaggatcatctcgaggatctgcaccagcgcggcgatcactccgataaaggtgatgaagttaagaaagctgagatccaccccctcaaccagcgcgccgtcgcgcagcaccaggttatagaccaggttattgattggcacggcaagccccagcactaccgtcaccgcgacgccgaggccgaaggcggtggagacctttttcgacaccgcaagaaaggtgcacatcccgaggaagaaggccagcgccatgttctcaacgaacaccgcgcggacaaacaggctgatgtaatgagccatcaccgattactccttttcctgctgctcaggcttccagctacgcagggcccagatcagcaaaccgataatgaagaacgcgctcggcgccagcaggaacaggccgttcggctgataccagccgccgttctgcaccgtctccagcaccgtgataccgaacagcttgccgctaccgataagctcgcgcaggaagccgacgataatcaggatcgcgccatagccgagaccgttgccaataccatccataaagctcgccagcggcggcgacttcatggcgtaggcttcggcgcggcccatcacgatgcagttggtgatgataagcccgacgaataccgacagctgtttggaggtctcataggcgaaagcccgcagcagctgatccaccacgatcaccagcgaggcgatgatcgccatctgcacgatgatgcgcacgctattgggaatatggtggcggatcatcgagataaacatgctggagaacgccgtcaccagggtcaccgcaatggtcatcacgaaggcggtttccagtttggtggttaccgccagtgcggagcagacgcccagcacctgcagggcgatggggttattggcgatgagcggccccaccagcacgcgcttcacctctttcatatcgctctgttcagccattattcagctctccctcacgaacctttttcaggaacggaccaaagcccagttcgcccatccagaaatcaaagctatgctgtacgccattggacgtcagcgtggcgccggataaaccgtcaaccgcgtggagatcgcctgcgcgcgcgccgcctttcaccaccttcagcgccggcatgccgttgtcatccagcacctgcttgccgacaaactgctggcgccagttcgggttttccacctcgccgcccagccccggcgtttcgccctgatcgtagtaagtaatgccttttaccgtgcggccatcgacgtccagcgccacgaaggcatacatcatcgaccacaggccgttgccataaatgggcagcaccaactgctcaatcttctgctgcgcgtcgcgcaccaggtaaatttccgccagattactgcgtcgctttataccagccggatcctgactggcatccagggccatactctgctgcggatccttcagcgcctgagcctgattaaatttacccgggtctttctccagcagttcgccggtggccagattcaccagtcgcggggtaatgcgcgccgcgaaggtgtccgctaccgcatccgcatccatatcggggtgcatcagccctgacactgccaggatattgcgctgcttatccaatgcccgctgcgcctgctggcgggatttcagccccacggccgagcccgccaccacgatggagcagaccagacaaagcaccagcaccaccagcagcgttttgccgatgctatcgttacttttcttctcagccacgcgacttcctccgcttaatattggcctgcaccaccagataatcgaacagcggtgcgaagaggttggcgaagaggatcgccagcatcatcccttccggataagccgggttcaccacgcggatcagcacgcacatcacgccgatcagcacgccgtaactccatttccctttatcggtaaacgaggcggataccgggtccgtcgccataaacatcatcccgaaggcgaaaccgccgagcaccagatgccagtaccatggcatagcgaacatcgggttggtgtcggagccgataacgttaaacagggtggcggtggcgatcatgccgatcattaccccggcgacgatgcgccaggacgcgacgcggccaaagaggatgatcgccccgccgatgaagatcatcagcgttgacacttcgccaattgagccgggaatattgccgaggaaggcgtccatccagctcaccggcacgccagtcgccacgttcaccagcgcttcaccgccgccgctggcccactgggagagcggcgtggcgccggagaaaccgtccgccgcggtccatacgaggtcgccggaaatctgcgccggataggcgaagaacaggaacgcgcgccccgccagcgccgggttgaggaagttgcgcccggtgccgccgaaaatctctttggcgatcaccacgccgaaggagatccccagcgccgcctgccacagcggcagcgtgggcggcacaatcaacgcgaagagaatagaggtaacgaaaaaaccttcgttaatctcatgcttgcgcacaatcgcgaacagcacttcccagaagccaccgacgataaaaacggtgatatagatcggcaggaagaagaccgcgcccagggtcatcatgctcagccagccggcgtcggcactgaagctcacccctaaccactgggcgacgctgtagtgccagttgttggcgatcgcctgctgcagctgttcggcgccgtatagcttgtgcagcgccggaatggtctgcagcccaacgttgtacatgccccagaacatcgccgggaatacggcaaaccacacgaggatcatcatccgcttcaggtcgatggcgtcgcgcacgtgcgccgcgccgcgggttacctggcccggcgtgtagaagatggtcgccgccgcctcatacagcgggtaatatttttccagcttgccgccatgcgtgaaatgcggctcaagtttctcaatcaggtgctttaagcccatctcttatccttcctgctcaatccgggttaacacgctgcgcagcgccgggccatattcatactttccagggcaaacataggtgcacagcgccagatcttcttcatccagctccagacagcccagcgcctgagcgctgtcggtgtctccggccagcagatcgcgcagcagtatggtcggcaggatatccagaggcatcacccgctcgtagttgccgatcggcaccatcgcccgctcgccgccgttggtatcggtggaaaaatgaaagcgcttgcgcttgaagaaatggcccagcgtggtgcgggtaatcgagaatttctctttgcccggcatcacccagccgaagagctctttttcccgcccttctttgaccacgctcacctgcagatggaagcgccccaggaaggcgtgagggccatgggcgcgggtgccgctaagcaccgagccggaaatgaccctgttttccccctcctgcaactcacctgccagcagatcctccaggctggcgccgagcgtcgttttgaccagccgcggagatgttacctgcgggccgccgagcgcaattatccgttcgcagtagagctccccgtcgaggaaaagcttaccaatggcgatcgcgtcctgataattgaggtgccagacctgcttattcaggctcaccggctccagaaagtgaatatgcgttcccggcagccccgccgggtgcggcccgctgaactgattgaaacagacctggccgagaggatgaccgcccagcttgccgccgctgggctggcagacgtgcactttcccgtcggtcaagcgcgtgagcacggtaagaccggcgtcgaaggcggcacgttcggccagaataatcggctgcggctccgccgccagcggattggtgtccatggcgttaacaaagatagcggcgggcgtgctccccgggagcggcgttttgctgaacggtcgggtacgcagcgccgtccattggcccgacgccagcagctgctgctgtacggtgtcgcgcggcagttcggccagcgcgtccgcggcgtaacgggtaaacgccaccgcgtcattgccctcgatatcaatcaccaccgactgcaacacgcgccgttcgccgcggtggatcgcgctgacgatcccgctcgccggggcggtaaagcagacgccagggatctttttatcttcgaacaggatctgaccttttttgacccgatcgccttctttaaccgccatcgcggggcgcatgccaacgtactcttcgccgagtagcgcgacgcgcttcaccgctggcgcgggagaaatctgctgtaatggcatgccagctatgggcaaatccagccctttcgtgattttaatcatatcgttagcaggtatccgtaacctcaaccccgacgcaggtcagggccagcttattgacagaatggcagagaagaaagggcgaaacggcgccagtagcgctcaggacggaagagaagcatcctttcttactctgatgatgaaccggcgcaagtgtaacatttcgtgagcggcggctgtagcgcaaggggcgataagtgcttctaaaatgcgagctattgcgcaaagttctcactgtgttttcgtcgctggcagggtataaagtgaggctgatttgtaaacgccgccacgtcgcccttgcgaaaaaatgccgtgatgctaatgtgagcgctctaaatccagaaaactctgatttcgggtctctcttgccgtcctggcaatgtggctattttgttttatcaaggaacaagcagtatgcgcaaaatcgcattatttattgcgatgcttctgttgccgtgcgtgtcatttgccgggctgctcagcagcaacagcccgacgacgccggttagcaaagaatataagcagcaattaatgggttcaccggtttacattgagatcttcaaagaagagcgcatgctcgacctttacgtcaaaatgggtgaaacctaccagctcctcgacagctaccggatctgcaactactccggtggcctcggtccgaaacagcgccagggcgatttcaagagtccggaagggttctataacgtcacccgcagccagctcaaacccgacagccgcttctataaagcgattaacatcggcttcccgaacgcctacgatcgcgcccatggttatgaagggaaatacctgatgatccacggcgactgcgtctcagtcggctgctacgccatgaccgacagcggtatcgatgagatcttccagttcgtgaccggcgccttagtcttcggccagccaagcgtgcaggtgagtatctatccgttccgcatgaccaacgctaacatggaacgccacaaatactcctactacgcggatttctggaaacagctcaagccaggctatgactatttccagcagacccacaaaccgccggtcgtatcagtgaccgacggccgctatgtggtgagcaagccgctcagccacgaagttgtccagccgcagctggcctcaaactacacgctccccgagacaaaataacgcccactcgcctggcatgatcttatgccaggtttcattggccgtcagcggctgcgtggcgataaccgtgaccacatcgttgggtgtggtctcgcgttgaaagtcgatctccacatcctggtccagcagttttgccacgccgaacggcgctcgccgggtgatccagtgcagattggtcgagcagaacgccattacgtagcgcccgtccgacagcagcatgttgaacacccctttctcacgtagttcacccgcgagggtggcgatatacttgaaaacgcccagcatattgcccggcgtgcgcggatagcgctcggttaaacggtgcagcagccagcaaaacgctttttcactgtcggtttcacctaccggatgaaaattaccggttttcagcgacttatagccttttagctgcccattgtgcgcataggtccagttgcgcccccacagttcgcgggtgaagggatgggtgttctccagggccaccctcccgcggttggcctgacgaatatgggcgacgacggaacaggacttaatggggtaatcctgaaccagtttcgcgatcggcgactgaaagctcggctggggatccttgaatgtgcgacagcctttaccttcatagaaggtgatgccccagccgtctttatgcggccccgtcccgccgccgcgctgcaccagcccggtaaagctaaaacagatatcggttggcacattggcgctcatcccgagcagttcgcacatagatcacctcaccctcacaaatcacgacggcgccggagcgaggccaccgtcaacagtacacactcacctgcctgttagcctttcgccatctctttttcgatcagcataatcagaatgtggatcactttgatatggatctcctggatgcggtcggcgtagccaaagtgcggcacgcgaatttccacatcagcgctaccggccattttaccgccgtctttaccggtcagggtgatcactttcatcccctgcgcccgcgcggcctcaatggccttaatcacgttgccggagttgccagacgtggagataccgagcagcacatcgcctgcgcggccaacggattcaacgtagcgggagaacacatactcatagccaaaatcattgctcacgcaggagaggtggctgacgtcggagatcgcgatggccgggtaacccgggcggttttcgcgataacgtccggtcagctcttccgcaaaatgcatcgcatcgcaatgggaaccgccgttaccgcaggacagcactttcccacccgccttaaagctatccgccagcaggacagcggcacgctggatagcatggatattggcttcgtcctgcagaaagttagccagcgtttccgcggcttcgttcagttcgttacgaataagatcctggtacatgaggataatccttcagtatgagtggaataaccccggcagtgtaccggatagccgtcgaagcgagaagcagcaggcagcgttatccctcgctcttttgattttatgtgccgcttttgcatacaacaatgtgagcaaggttgtaattattttgtaaacacattgctaaataaaaacgcatgcactacaaccaatacatcacaagtggtcagacctcctacaagctcagggagcatttctctatgatgattttgagtattgttgcaaccgtcgttttactcggcgcgctcttctatcaccgggtcagcctgctgctcagcagcgtgattttgctcgcctggaccgcggcgctcggcgcggccggagtgtggaatatctggctgctactgccgctggcgatcatactgttgccgtttaactttgcgcctatgcgtaaatccatgatttccgcaccggcgtttcgcacattccgcaaggtgatgccgccgatgtcgcgcacggaaaaagaagccatcgacgccggcaccacctggtgggaaggcgatctgtttcgcggcaatcctgactggcaaaagttacataactatccgcagccgcggctgaccgccgaagagcaagctttcctcgacggcccagttgaagaagcctgccggatggctaacgacttcgccatcacccacgaaatggccgatttgccgccggagctgtgggcctatctgaaagagcaccgcttcttcgcgatgatcattaagaaagagtatggcggacttgagttctccgcttacgctcaggcacgagtactgcagaaactctctggcgtctccggcatcctggcgatcaccgtcggcgtcccgaactcgctgggtccgggcgaactgctgcagcattacggtaccgaagaacagaagaatcattatctgccgcgtctggcacgcggcctggaaatcccttgcttcgctctcaccagcccggaagcgggctctgacgccggcgccatcccggataccggcgtggtgtgcatgggcgactggcagggtcaacaggtgctggggatgcgcctgacctggaacaaacgttatatcacgctggcgcctatcgccaccgtgctggggctggctttcaaactctctgacccggatcgtttgctgggcggagaagaagagctgggtatcacctgcgcgctgatccccacctccaccccgggcgtggaaatcggccgtcgccacttcccgctgaacgtgccgttccagaacggtccaacccgcggcaaagatatcttcgtgcctatcgattacatcatcggcggcccaagcatggccggtcagggctggcgcatgttggttgaatgtctatcggtcggccgcggtattactctgccgtccaacgccaccggtggtctgaaatccgttgccatggcgactggcgcttacgcccatattcgccgccagttcaaaatctccatcggcaaaatggaagggattgaagaggcgctggcgcgtatcgccggtaacgcctatgtgatggacgctgcggcgtcgctgatcacctacggcatcatgctcggcgagaaacctgcagtgctgtccgctatcgtgaaatatcactgcacccaccgcggccagcgctccattatcgacgcgatggatattaccggcgggaaaggcattatgctgggcgaaggcaacttcctcgcccgggcctatcagggcgcgcctatcgccatcaccgtggaaggcgcaaacattttgacccgcagcatgatgatcttcggtcagggggcgattcgctgccatccgtacgtactggaggagatggccgccgcgcagaataatgacctgaacgcctatgacaagctgctgttcaaacacatcggccatgtcggcagtaataaagtgcggagtttctggctgggcctgaccggcgggcgcaccagcagcgcgccgacccgtgacgccacccgtcgctactatcagcaaatgaaccgtctgagcgccaacctggcactgctgtcagacgtctcaatggcggtgctcggcggcagcctcaagcgacgcgaacgtatctccgcccgtctgggggatgtgttaagccagctgtacctggcctcggcggtgctgaaacgctatgacgatgaaggacgcaatgaagccgatctgccgctggttcactggggggtacaggacgcgctgcaccaggccgagcaagccattgacgatctgttggacaatttcccgaaccgtctggtggcaggcgtaatgcgcctggtcatcttcccgaccggccgtcatcatcatgcgccgtcggataggctggaccaccaggtcgccaaaattctgcaggtgcccagcgccacgcgctcccgcatcggccgcggtcagtatctgacgccgagcgagcataacccggtaggcctgctggaagaggccctgctggaagtgatggcggccgatcctatccaccagcggatctgcaaagagttgggtaaaaatctgccgttcacccgtctggatgagctggcccacaacgcgctggccaaaggattaatcagtcaggatgaggccgccattcttacccgtgcagagcatagccgtctgcgcagcattaacgtcgacgactttgcgccagaggagctggcgacaaagccggtaaagctgccggaaaaagttcgtaaagttgaagctgcataataaaaccactaccacatcacacgccgggcggggaactttccccgccttttttcgccctctcctcccctttcgtttccatcagtagcatttttttaacaaaatattccgcggaccgccgcgcggctgatatggtgttacagttaacctaaccccctcatgagaatggagttgaccattgtgcctggcctgaaaatttcgctgttgcaacaaccgctggtctggatggacggccctgccaacctgcgccattttgatcgccaactggaaggaatcaccgggcgcgatgtgattgttttaccagagatgtttaccagcggctttgccatggaagcggcaaaacagtctttacccgaggccgacgtggtggagtggatgcatgcccgggctgcgcaatcccaggcgctgattgccggcagcgctgcgctgcaaactgaacacggcgctgttaaccgcttcctgctggtcgagcctgacggtacggtgcaccattatgataaacggcacctgttccgtatggccgatgaacatcatcactatgaggccggaaaccagcgcgtggtctttgaatggcgtggatggcggatcctgccgctggtctgttacgacctgcgctttccggtatggtcgcgtaatcagaacgactatgatttggcgctgtatgtcgccaactggccggcgccacgctcgctgcactggcagtcgctgctgatcgcccgcgcgattgaaaaccaggcctatgtcgccggctgtaaccgggttggcactgacggcaacggccatcattaccgcggcgatagtcggattatcaatccccagggggagattatcgccaccgccgatccgcatcaggccactcgtcttgatgccgagctgtcgctgagcgcccttcaggaatatcgtgaaaaattccccgcctggcgcgatgccgatcctttcacgatcggctaatcacccttcgggagccgctgcgctccctttttattccaccacgatccgcacagcacagtagaccaataacgcagccagcatccagttcagttgccgcccgtacagcaaaaacaggcgttgaaacagatgccccgccagcgcccggcacagatttcccagtgcgccaatcgccgccagcagcagactcacgctgataagccaaacaggctcgcgagtaacgggcagaacaaaggtagaaagcgcggtgatgccatacagaataattttaacgttgacgaactgtagccccagactcgcccaaaagcctaccggttctacactcggcatccctgtcgccggtttgcttttggcaatctgccaggccagccacaggatgtacgccgcgccaatccatcccaataccagggtaaagcgtgagtcgagttcaaccagcgaaaaggttaaagccgcgcaaatcaacatagtgataataaacccgacgctcatcccggccagcacccgcaggctgcggcgtagaccatgggaggtgacgctgctcagcgccaggatattgttgggcccgggtgtcagggcggtgatcaaagtgtaagttaaaaaggcgctaatcagggtaggtgtcacgggttttctcctcttgtctggcagacactacccgaagctgataatttaaaaaaatgaatattttttcattctcgcttcgataacatcgatacaaagaggaaatatggatctgcgacgcttcatcaccttcaaaactgttgtcgaagaaggttcctttctgcgcgcggcgcagaaactatgctgcactcagtccaccgtgacttttcatatccagcagctggagcaggagcttgccatcccgctgtttgagaaaatcggccggcggatgtgtctcaccgccgccggtaagaagctcctgccgcatgtctacgacctgactaaagtgatggcctcgattcgtcaggcggcacgccaggacgatgagcccggcggcgaacttcgcgtcgccactggcgaaacgctgctggcgtataaaatgccgcgggtgctgcagcgttttaagcaacgcgctccgaaagtgcgcctgtcgctgcagtcgctcaactgctacagcatccgcgatgcgctgcttgccgacgaggtcgatttgggtgtgttttaccgggtgggtaacgatgacgcgctcacgataatggagcttggccagcagtcgctgacgctggtcgcatcggtcgagcaggcgccggtagacttcatgcgcccgcggcagcatatcccgctgagctttatcatcaacgaaccccagtgcgtgttccggcagatttttgaaagcaccctgcgccagcgcgaaattactctggagaacaccattgagctgtggagtattgagagtatcaagcagtgcgtggcgggaaatctgggagtgagttttctgccacgctttgcggtggaggacgagctcaagcgcgggacgctggttgagctgccattcagcgagacgccgttgacgatccatgcgctctgcgcccaccatgccgggaaggctatcagtccggcgatgcgggtatttatgcagtgcatgcaggaggaacaagaggcgcgctgaaattcggcgacgaaaacgacgaaagcctgaatcattgctgactcaggctttctgaatagtggcggaacggacgggactcgaacccgcgaccccctgcgtgacaggcaggtattctaaccgactgaactaccgctccgcgttgttgttccgttgggaacgaggcgaatattacggattcccctctaccccgtcaacgctttttctaccattttgaatcgtttgctgcaaaaatcacccaaccgcctatttttaattcattttagtggctatcaggcacgccacaggcagcttccgcctttcttttgtaccaagtcgaggcgggattcatggttcgccagttcttcatctgaggcataaaccacgcgtaactgactgccggcgcggacgacgcgctgaattcccatctctcccgcctgctgctggctttcgccttccatagagaacgccatcgaagtctggccgccggtcatcatcaaatagacatcggcaaggatctgggcatcgagcaacgccccgtgcagcgtacgcttgctgttgtctatttcgtaacgcgaacatagcgcatcgaggctgttgcgcttgcctggaaacattttccgcgccagcgccaaactgtcggtgattttacaaaaggtctcggtttttccgatgccgcggtttagcttactgaattcataatccataaagccgatatcgaacgaggcgttatggatcaccagctccgcgccgcggatgtaatccataaactcatcagccacgtcggcaaaggtaggtttatccagcaggaactcatcggcgatcccgtgtacgccgaatgcttcaggatccaccagccgatcgggcttcagatagacgtgaaaattgttaccggtcaggcggcggttgatcacctccacggcgccgatctcaatgatcttgtgtccctcgtagtgtgccccgatctggttcataccggtggtttcggtatcgagaacaatctggcgcgtaattgcagtgctcatagcggtcatttatgtcagacttatcgtttacaaatcgatttcaattacaggaagtctaccagagatgctcaaacaggtagaaattttcaccgacggctcttgcctgggtaatccaggacctggcggctacggcgccatcatgcgctaccgccagcacgaaaaaaccttcagcgctggctaccgtctgaccaccaataaccgcatggaactgatggcggcaattgttgccctggaagcgttaaaagagcattgcgaagtggtgctcagcactgacagccagtatgttcgtcaggggatcacccagtggatccacaactggaaaaagcgcggctggaaaacggcagagaaaaagccggtgaaaaatgtcgacctctggcagcggctggacgccgcgcttggccagcataaaattaaatgggaatgggtaaagggccacgccggccatcctgaaaatgaacgctgcgacgagctggcgcgcgcggcggcctcccaccccacactggacgatgtcggctacctgcctgagagttaattctgccctttgcgccactgccgggtggcgcccaccgccggccgcagctgagttttcgctttgccggatttcatcggattgagcgtcagcggaatggtccgtttgcgggcgacaatcaattgcaaacagcccagcgccggcagatgggtgctcaacaatttgccgccatggcgcgaccagggcaaaacctggtaacgtccatagtgcagcacttcaaagttgagcagcgccagccagtccagctggcgcatcagcgtaaacatacggctattataaggcgttcctttgcgcaggaccggcaccagcttacgcaaccccatcaggctgaccggattaaacccggtcaggatcatccagccatcatcgatcagtacacgatcggcttcccgcagcagacgatgcggatcgctacaccacggcagggtgtgcgccagcaggcaggcgtcaacggacttttcggcaaagggtaaatgcagcgggtcagcccggacctgcattggatttcccgccagcgagacattcacctggtgcgagatggcgcaagcttcggtattgatttccgcgctcagattgccaatcttaagcagatgaaagccatataatttagccagccacggtttcatctgctgctccagcgtttcgcgatagtattcgccccacggcatactggaccaatgctcaggcgctgtcactgtgtgaggtatccttgccggcttcattgccaccttccgctacgctttagaggtaatttatgaatcttatcagtattcccgcgtttcaggacaactacatctgggttctcagtgagaataacggcccctgcatcatcgtagatccaggcgaagccgcgccggttctggcggccatcgaggaaaaccagtggcagcccgaggctattttattgacccatcatcatcaggatcacgtcggcggcgtaaaacaattacgtgaaaaattcccttctatagtggtttacgggccggcggaaacccaggataaaggcgtcactcaggtggtaggcgatggcgatcggctgtcaattctcgggcacgatttttccattttctctacgccaggtcacacattaggacatatctgttactacagcgaaccttatctgttctgtggcgatacgatgttttccggcggctgcggaaggctgttcgaaggtacagcagagcagatgtatcaatcatttatgaaaattaatgcccttcctgaagaaaccctcatatgttgcgcacatgaatatacgttagcgaatatgaagtttgcattgagtatcctgccagatgatagggacataaacgattactatcataaagttaatgagttacgtgcaaaaaaacaaaaaacactacccgtaactctgaaaaatgagcggcgtataaatttatttttacgcgtaaatgatattgatttaattgacaaaattaacaaagaaacaaatttgcaacactctgtggcgcgatttgcatggttaaggtcaaagaaagatgacttctgatatttaattcttgtcatcggccaacttcgccgttatccttggtcgtcttttaagcaactattgacacacacatgaaggcacgagcgatattactcgcctctgtcctgctggtggggtgccaggcgtctaagcacgatggcaccgtcgaacagcgagcacagagcctttctgcggctggtcaaggggaagcaggcaagttcacaagtcaagcgcgctggttagatgatggaaccttctacgcgcaagaccaggatctgtggacttccataggcgacgagctaaagatgggaataccggataatccccggattcgcgaacagaaacagaagtacttaagaaataagagctatctccacgatgtaactttacgggcagagccgtatatgtactggatagccgggcaggttaagaaacgtaacatgccaatggaactggtattactacccatagtggagagcgcttttgacccacacgcgacgtctggcgccaatgccgcaggcatttggcagatcattccgagcacagggcgcaattatggtttaaaacagacccgcagttacgatgcgcgtcgtgatgtcgtcgcgtctactaccgcggcgctggacatgatgcaacgtctgaacaaaatgttcgacggcgactggttgttaacggtcgcagcctataacagcggcgaaggccgggtcatgaaggcagtaaaagcgaaccgttcgcgtggcaaacccaccgatttctggtcgctgtctctgccgcatgaaacgaaaatctacgtcccgaaaatgctggcattgagcgacattctcaaaaacagcaaacgttacggcgtaaagctgcctacggctgatgaaagccgtgcgctggcgcgcgttcgcctcgacagtccggttgatatttctcagctcgcggacatggccggtatgccggtcagcaagctgaagacgttcaatgcgggcgtaaaagggtcaacgctgggcgcgagcgggccaaagtacgtcatggtgccgcagaagcacgccgcacagctgcgtgaatcgctggcctctggcgacattgccgccgtgcagccgacgcagctcgcggacaatacgccgctaaccagccgtagctataaggtgcgttccggcgacaccatttccgggattgcttcccgtcttggtgtgacgacccgcgatctgcagcagtggaataacctgcgcggctctggattaaaggttgggcagaatctggttattggcgcaggcagcagcgcccagcgtctggcgaacaacagcgatagcatcacctatcgcgttcgtaaaggcgattcgctgtcgagcatcgccaaacgtcacggcgttaatattcgcgacgtgatgcgctggaacagcgataccgacaacctgcgcccaggcgatcagctaacgttgtttgtgaaaaacagcgatcgaccagagtcctgatacctctggttcgacaaaaaggcaccgacttccccggtgccttttttgttgcctaaattaaaccgctttatgcgcttcgaacagaatggtatcgctggtaaacgatccgtcctcctgtaactcgaagtacgctttgacctccgccgaagcgctctgctgatataagcgaatcgcctccaccagcggctcaggagtacgcatccgcgccacccatgaactgaactccagcggcaggcgatcggtcaacaactggttaaccaccagccccgcttcagtcgccagcgtcaaccactcgccgctggaataattacgcacatgcgaggtgtcgcgcagggcttccaccgtctgcagccagacatcacgtaccggatgacccggcgacatcacgtccatcacgataatcaccccgcccggcttgagaacacgtttcacctcacgcagcgcctggccaacgtcatgccagtggtgagcagagtagcggctaatcaccacatcaaagctggcatcagcgaacggcagcgtttcggcgtacccctgctgggtcacgatattgctaaaacctttctcctttgccgcggcggcaacgacctccagcatctggctcgataaatcataggcggtcacctcggcaacctgtcccgccgcggtaaagctggcgtgccctgccccgcagcccatatccagcactttcgcctgaggaaaatcagccagccgttccgccagccgctgcagatcgcgaccagaggcgtgtacggcgctggtcagataggcgctggcctgggagccgaactgcttttcgacgttgtcatggtgagagcgtgttgtcatgttgtcttgtccttacggttttttttgagtaataaaaggcagcaccatgcatgcgcaggcctgccccatggcaggcctgaccaaccttaaattaatcaggcttgccgggactgaattcgactagtagcgggttgtggtcggaggcgcgggtcaccagcacggaagcatcgtgcacgcttaacccacggtagaacacaaaatcgaggggacgaccaaacgcgcggcggcgctgatcgtctgagaaacgaacttcgcgtaacgacatctcacgcgcaaagcggtacagcgcattcatccgcggccggctccaggcattgaagtcgccggccatgatcaccggcccgctgtgatgggcgatctgatcgccaattggcagcagctgtttgctgtagacgtcgacgccaaggctaaagttgacggcatggatattgactaccatcaacaaccgcgcatccggcagcggataaacggtcactaacgccgatttcggcaatcgcaaaataggctcgcgctcgcgcagcggacagcaatagatggggtgcgcggaggccagcgtcattacgccggaaggatgctgcggcaataccagcgccggcacctgatcggcggccagatagtttgaagtcgcgaaccggaccagttctggggtggtttgcgcctcctgcaacaggaccaaatgcgcatctttgccgaaatttttaaggaccgattgccactctgcgcgctgctgcttgaagatattccataccagcacgcggatcttctcatcgctgcttaatggcgtaccggcgggataaaccggacttacgcccgcaaacgcccccggaggcaatattctctccgcaggttgtccggcgacatagcgcatggcgtaggtgttctttcgcaatttgggcattaatcctcgataacagaaaccagcccgacgacgactggttattctgttatagggattttcccatacactttcaatgcaaattgcgagaaacccttagccttcgggagaaagcgctgccgaacggcgtggcaatttatctaaacgtccgctcaggaccaccaacagcaaagcgaccagcacaatcatcgcgccaatccacggcgtctgcgccagaccgtaccgttcgaccgtctgtccgccgacgatcgaccccagcgcgataccgatattgaaggcggcaatattcaggccggaagcgatgtcgacagcccccggggtatactgctctgctttttgcaccacatagacctgcagacccggcacgttgccgaaggcgaaaacgcccatcaccagcactgtcgccagcgcggcatagtgaacgctggcggtcagctggaagaccagcagcagtagcaccagcgcggcgaagataaacttcagcgcggagacggcgccatgcttatcggccagtttgccgccccacacgttacctatagccaccgagacaccatagcccagcaggatccagctcaccgctgacgggctgaagccggccagctcctgcatcatcggcgcaaggaaggtaaaagcggtaaacacgccgccatagcccagcgcggtaatggcgtagatcatcagcaggcgcggatgggttaatactctcagctgatcgcgcaggctggcgctggcgcggcccggaatattattcggcaccagaagcagactgctgattagcgcaatcaccccgagaatcgataccgcgaggaaggtttcccgccagccgaaatgctggccaataaaggtgccaaagggaacgccggtcaccagcgcgaccgtcaggccgccgaacataatggcgatggccgaggccgctttctcttttgccaccaggctggtagcaattgtcgagccaatagagaagaacacgccgtgtgccaggccggtcagcagtcgcgccaggatcagcgtttcatagcccggggcctgccaggccagcacattacccgccgtaaacaggaccatcaacgccagcagcagctgtttacgcggcatacgccccgttaacgccgtcagcaccggagcgccgatagctacgcccagcgcgtagatagagaccagcagtcctgcagaaggcaaagagatagagagttgctgggcgatggtcgggaccaggccgacaatcacaaattcagtggtgccaattgcgaaggcaccgatagttaaggcaaatagcgccagtggcataatttactccgtagcatcaggattaagatgacacgtagtatgaagggttgtataaataacaaaaactatcaaagtatcaatagaattttgctataggtgcaataatgagagccacatcagaggagatcgccatctttgtggcggtggtggaaagcgggagtttcagccgggcggccgagcagctcggacaggccaactccgccgtcagccgggcggtcaaaaagctggaatcaaagctaggcgtaagcctgctcaatcggaccacccgccagctcagcctgacagaagaaggcgagcgctattttcgccggatgcaggtggtcttgcaggaaatggcggcggcagagaacgatctgctggagacgcgcacgacgccgcggggcctgctgcgggtagatgccgcgacgccggtgatgctgcattttctcatgccgctggtgaagccatttcgcgaacgctacccggaaatgacgctgtcgctcgtctcgtctgagacgtttatcaatctgattgaacggaaagtggatgtggccattcgggccgggaccttaacggattccagcctgcgcgcccgaccgctgtttaccagctatcgtaagatcgtcgcctcgcccgactatgtcgcgcgctacggtatgccgcagcatccatccgatctgaaacagcatcactgcctcggcttcaccgagccggtatcgctgaatacctggccggtctcctgttgcgatggccagctgttagagatcgaagcggcggtgtcatccaatagcggcgaaacgctcaagcagctgtgcctgaccggcaacggtattgcctgcctgtcggattacatggtggataaagagattgccagcggagagtttgtcgagctactggccgataagcgcttaccggtggaaatgcctttcagtgccgtctattacagcgaccgggcggtcagcactcgcatcagggcatttattgattttctgagcgaccacgtaaaacagctcccgaaggagctgtcgtaataccttctcgggcggcagggcgaacggcataccggtagcgagtgattaatcccactgcggcgccagaccttccgggctcaccagccgatcgttgcaatccagcgcagcgatcgcctgtcgatcttcatcatccaactgcagatccagcgccttcaggttgctggccaggttatcacgcttcgtcgaggacgggatcaccgcgtacccctcgcccatcgcccatgccaggataacctgcgccggagtcgcattatgtttcgccgcgatacgggcaatcacttcatctttcagcgccttaccataagccagcgtcatgtaagaggtgatgtggatgccgtgctcacgtgcccagtcgacgactttacggttttgcagatacggcgagagttcaatctggttggtcgcaatgttttcagcgccaacggcggcaatcgcgcgctccatcagtggaatagtgaagttggagataccaatctgacgggtcagacccagcttcttcgcttccatcagggctgccataaactcttcaacggcaaccgcatcgttcggtgacggccagtggatgagcgtcaggtcaacatagtccgtgcgcagcttctgcagactttcttgcaggctggcgatgagtttgtctttgctcaggttctcgatccagattttggtagtgatgaacagctcatcacgcggcacgccgctttcggcgatagcctgacccaccgcggcttcgttgtcatagatttgcgcggtgtcgatagcacgatagcccagctccagcgcggtttttacggatgcgataacaacatcatctttcagacggaaggtgccaagaccaaatgcagggattgccatgattttcctcgttatttcttcatttcggttaacggatgaaattatggctgatggtgtggaggggaaaaagagcgattaatgcagaggatttttgctgaattagcaataatagagaacagatcaaacaaaaaagccctgagcaaatgctcagggctcttaataagtggcggaacggacgggactcgaacccgcgaccccctgcgtgacaggcaggtattctaaccgactgaactaccgctccaccgaatttcttcgctttattaccaccggttgtcaccccggctt

SEQ ID NO: 75 - DNA, 76927 bp, Unknown
  source: /note="Description of Unknown: KP2-Mcoc1 Bacteria Sequence"
acaattcccgccagcgtatggctgagcgcgcacttaacttacagtaaaggagtctccctatgggcacagcaattatggccgctggcactgatgcatcagcgtacgcaaataattatcttccgccggtcactggcccgctcgcctgggccaatctggaaagcgatctgctgccggcaggtcggcgccttaaaaacttcggtagcctcggaggtacctttgcgctgtccggtattgctcagctggtagcaaaaggtgttgcagcggcagcgggtacggaaagccgtctgacgctgggtacctttacgccggatgcttacaccttcatcgtgctggtcgacgtgggcccggatgcagggatactgcgtcaccgcaatattcgtatcagcacgaatgccagcaaaaagcttcagcgcgtcatggatgccggtacaagcgtttcggatatcactgcgcctgcaacgggcgcgttcgccgtattcctgtgtggtgacagcaccgggcatgcgtttggtattgtgacggcttcaggtattcagaaatccacctccacggcggtgaacagcgggacgactgccacctggatgggagggaccaatcaggcaggcctggcagcagcatgggcaggctatggttcggctttctatgaccgaaagctcagtgacagtgaaatggaacgggtggcagaacgccttattaaacgggcgcgttatctgggagtaacggtgaatggctgatttgtcgatttcggttatttcagaccaggcatctgagagcaatcaggcggggtggtggcatccccttgacagctttcagggagtggaatgttacgggctgtgtaaagagtacggtaccgccggttatcatcaggtcgaaatcgttcgccgtgatgccgatggtaccctcacgcggggaatgtgtaagaacgtcgacgggacggtcgcggaatttaacaatgacgtgggccataatcagccatctgtggttgtggacggtgcgggatatatccacgtgtttacgtcgatgcacgttaacctgctgcggtactttcgcagcgcgcgccctggcgacgtgtcgcaaatggtggatgcgaccctggactttccggatgtggactgggtctggacgtacccgatcaccggcagaggtccagatggtgatgtatattgtctgatgcgggtcgccagccggagcaccaccggggaaaataaacgcgggggtatcctttaccgctttgacgtcggcacgctgcgatggacccgttatgcgcatgtggctgaaacagccaaccgcgctatttacccggatgatatagccattaacgaggacggcgtccatcttctgtttcagtggtcggcctacccgtcttctgccgtccgccatgtcggggaatatggcgtcattggtaccgatggactgatgagaacgataaataacacgcccctgccaatgccggtaacgcagggacagctggcgtataagccattgcagccgggtgaaaacccggcgataagtgacgggctgaaaatggggattcagtctgcgaaatttgcgtttgatggcgaggggttgtcgcatatcacttaccgtttcagaaccgtggatgatccttccgggacctggttcagtaagttcggggtatacgttgcgacatgggctgggtctgcgtggagcgaacagcagatcgcgtatgtcccgccggagaggggaaacacttccgcagcactggcggcaaccgttcaggggggcaagcagagggtgtatttttcggtggaatacacgtcttccgggaatactgtcgctgtcattgtcctggcggaaaatgcaggttctggatgggtctactcggtactcggcaacagcgctcccacacttctgcgcctgggtgctgcaccaggaaacggcggtgacgtgctttacgtctcggcaccgtttgaggctaaggtgtatcgctattttgtgccggaagattattccccggctcagcaattcacgagttttgatgtactgctgtcgactctggtgtaattaaaatcatcccccggcagtctccgggggtatggttaactaaaccttcccgacacagccgccatctcctccgcaatgacctgcagcgctgttttgctgaccagagtcagatcgtcaattcgcgcacggtaaaagcgacctgcaaagggtgtggtatccgccaggtttgaaccaatgccattcaggttgatagtcgccgtcggataggcaattttccccgtccagacgccctcataagcaaggaccccatccagataaaccagccccttttgctgcgtgccatcagccgactcctgatagcggacgctcaggcagtgcagattgccgtcggccagactgccgatgtaatccttaatgctgtagttaatgccacgcacgcacaccgtcagcgccgtgatcaccccagccgtgatggtaggatagacctgaatcagccggttagcggtagtggcgtaactggttgccccaatccccacccagacattactgaaaccatcagcgccagcattcgccggatcgattttcagccagaacgtatgcatgtagtctttcatggccgctgtcggaataaaccccgcaggcaggcgcaggtactggcgcgacgttttatcgaaaaccagcccaccggaagtgctgtcaaagttcagagctaccgaacccacgctggccgggtcatccagaaagcacagatttttgagctgggcaccgggagccaggttcttcgcccctcctgcccagttatgtttcacatcgatcattcccagcgtaccggcattgatggacgggaaataatataattttgacccggtgtcgttcacccagtcggtgctctgttcgaccttacccattatttaacccatcctttatgtttgagaaactggcaaacgaaatttgcgttgacttctgccccgacgtacagcgcgccactcatcagcgtctgtgacggatgcagcgtgtcgtatttcagggaagcaggtgtggtgtcgtcggcgatattctgcacatcggttgcattcgccgggttgtagtggtttttgaagttctgcagcagatcaacgccatcaatttcacagtagtactccggaaaggccgcttttagccctgcgtttatggcatggatacgctgatagccagcagaaccgcgagtttcatcaccgcgggtaaactgagggcagatacacggcagcgcaccaagcggcttcaggtaactgacgatacttttgacgttattcaccacttcgctgacgctggttgtgttgttacgcccgcaggtcaggatcagaatggcctcatcgtgctcaggatacagtacgccagcagggcgattcttcttccacgtcatgagcgccctggcggaaatggagcgagatctgatagtggagaggacacgcgctggactggcggtagcaagagagcaggggcgtatcggcggatgtagccgggtaatgacccctgatgttgtcgattgggcaagccgaatgctggagagcagtgttaaccgataataggtctccaaggtgatcgacggatgtgtgaggactatttataaatatttcccggtcaccagtaaaaatcattgtgttgtgtcggtgtagttgatcgatagacgataactgtattgatctgtattcgagatgaaactactgtgtgtgcaaccagtattgactagggggctaccatgctcctttattcaaattgatgagattattacgaaaagaaataccatcctgagccaaaacatcgtgcacgtgcaagggagtgatttttaatttggtgttgaagtagcatatgacataaatttttatcttataatcgtttattttggtgagttatgcgtaagttttgcttacgcataattattatcagcgtatttattttctgattatctaactagcaatgaaatataatttagattaatatgttattttgcttcttaatagataaaataattctgcgtagttcacaccagattcaagccccctaaaggatgctaatctccttactgcatccaatgatatcagtgagttctctacatttgacatttgagactcatgcttaccaagtattgatatctttctctcaagatgtttacttatatctacataaatagatccagatgattgactccatgatcctgaatccccccagccagcaggtggatactcatatgctattacagacttgggtgaatcagcattttttgtggtcctggtggctgcgattgagcattcataaacccatttatgctcctgatggaatgaaggtacagggatgaaaataatatctggttttatattttcaataagtaagtcaatcgcatttacacatctacttttactggatgaacacaaatcaaaatcctcattatcattaattttatttatgatatgaagagtcgccccggcttcgagcatggcgtttgtaagttctttttttctcgtttcactgctaacatagataccatttctcacatgccactcacctttaattgttactacagcaatgtgaacttctatatcattttctaccgctcttgacattgctcctccgcagcctagctcagcatcatctgcgtgcgggcttataattaaccatttttttgatgtgaagaaatcaatcatttaattaaccccgctcattttaaataccactgccggtgtttttaataaaataaatagatcgaaatataaacatccttttttataataaagaatatccattgcaactcttcgcttgtattttacctcatccctgccagaaacttgccatatcccagttatacccggcgtggactttttataatactcaattttttttccgtacttatctgcttcatattgagatataggccttgggccaacaagtgacatgtttccaaataaaacattaaatagttgaggtaattcatctatgctcgtttttcttatccattttccaaatttagttacacgtgggtcattcttcatgtggcccttagtatgtaattctttcaatatattattttgtatctctattggcaaggttgatatgtctttcattgatgtaaatttataacaattaaacatgcatccatttagcccgattcttttactcctataaataggagggtgtccacttaatgaaataattattgcaacaccaattaagacaggtgaaaccattagtatcagaagtagtgatgcacacaaatcgaaaatccttttgcttttcatgaatcccccgtgcaattatataatgattcaatatgttacaaataaacacatttatacaatagttctataaggcaaatagatcaatggtcgagtaaatggattcatgatttaatcatttaatgcgttgataattatggggaaaattaggttttggtaatcccggctgatgtgggaagggggtattgagcgaagttgcagaatgctggagaacggcgctacccggcagcaggtggctgatgtgacaggcgtggacgtgaaaacaatctacaagtacctcccggcgacttgaagacaaagatttcactacttttcctgatatgttacgtttggcttgatcaattcattcagctttgaaaacagtttggtttgtttgtgatgagtaagaaaataataagttttagagattttctaactattaaccataaccttatgcacatgtccgatacatgggctgatttgtgggcgttgattttttacacacgtttaagtgcgggaaggctgctgtcactccgttacgatgacattgatggttgttcgataatgatacgggaaccgggacatctgaaggcgctacgtgttgaatcaacccctccagtggaggggatcattgctcgtagaagagaacgctatccagaagatgtttttttatttcagagccattctaaccgtgtgaagtaccaacgccggccggtcactataattgctttcaacgccgctttacgtcgcgccgctagatcattaccagacgttaacgtaagcagtagtagcgcgagaaacataccggactaaccgcctgtccagtcgcgtgtggccgatgtgacaggcgtgggggtgaagactatttacaaatatttgccagtacaatacggcgataaaaaatccccttgagcaggcacactcaaggggaaaatactacataacatcattgctgtgtgcgtcttcgcacacccctatcttctaagaaggcgcccaaagcttccagatatttctggtctgagcagttaaaacattggatcggcggcctatgtgataagagggggtgaagacgatttataaatattttccagccggttaagtttgctcacctgcgaaccgtatgcaagagatcgcaggtgaacaatttgctatgaaggcattgccatagctgaaaaattttaacctcgcattgttcgcaaaaccatcaaacagctaaggcctgaaaacactttcagactaaccttactcgttacatcaatgtgttacgtcaatggcgtaaattgatagccagagcctatattgatatgtcgccctgttaaaactactgtatataaaaacagtgttaatctgagcgagtcaattatgcagttttacacgcccgttgagttacgtgagatcatgctgatcccgttgtacagtgaccttgtgcaatgtggttttccaagccctgcacaggattacgttgagcaacgcatcgatctgaacgagttgctcgttaaccaccccagtgcgacgtattttgtcaaagccgccggcgacagcatgaaggatgccggcataggagaaggtgatcttcttgttgtggatagctcaaggacagcagttcatggcgatatcgttatcgctgcagtggatggggaattcaccgttaagaagctgcagctgcatccgcgggttcagcttaacccaatgaaccctgcatattcgccgatagtcgtgggtagcgaggatactctcgatgtgttcggggtcgtaacttacatcatcaaatcggctggctgagatgtttgcactttgcgatgtgaactcattttacgcatcgtgtgagacggtgtttcgtcctgacctgaaagggcggccagtagtcgtcctttccaataacgacggttgtgtgattgctcgttccgctgaggcgaagcccttcgtcataatgggggagccgtacttcaaacaaaaggacatgtttcgccggcacggcattatcgcgtttagtagcaactatgagctctatgccgatatgtccaaccgagtgatgacaacgctggaggaactctctccacgctgcgaaatttacagtattgatgaggcattttgcgacctgacaggagttcggaattgtcgcgaccttaccgactttggcagggaaattcgcgagacggttctgcgcaggacgcacctcacggtcggtgtcggcatagcccagactaaaaccctagcaaagctggccaatcacgcggcgaaacagtggcagcgacagaccggaggagtggtggatctgtctaatcttgaaaggcagaggaagttgatggctttgctgccggtggatgaggtctggggcgtcgggcgccgtattagtaaaaagctggaggccatggggattaaaacggtactgcaactggcggataccgatatccgttttatccggaagcattttaatgtggttctggagcgaactgtgcgggagctgcgcggagagccatgtctcggtcttgaggagttcgcgccggtaaagcaggagattgtctgtagtcgcagctttgggcagcggatttccacctacgaagagatgcgcctggcgatatgcagctacgcctcacgtgcagcggagaaactccgtggtgagcatcagtactgccgctttatctcagcattcgttaaaaccagcccctttgcgctgaatgaaccgtattacgggaacagtgcatcggtaaagctgctaacgccgacccaggacagccgggacatcatcaccgcggcgacaaaatgtctcgatgtaatctggcgagacgggcatcgttaccagaaagcaggagtaatgctgggagatttctacagccagggcgtagcgcagctcaacctgtttgatgccaacgcgccacggaagaacagtgaaaagcttatggaagttctcgaccatctcaacgcgaaggacggaaggggaacgctgtattttgcagggcaggggatccagactgcctggcagatgaagcgtgaaatgctttctccgagatatacaacgcgtattcaagatgtgctagttgtaaaatgataggagttagtatgtaataacaccttgataatatcttatggctaacttaagtgaggtgtcatgtatatggcaaagatagggcgaaatgattcatgctggtgtgggtcaggaaagaaatataaaaaatgtcacttgggaagagaaaaggaaaaaaatatagatcgaggcgatgctaattcagttcttaaactatttacaaatgtaagtaagtgtagtgttcctgatgatttaaaacacgaatgtgagcgcaagatcgttaaggctcatacattatcaaaatcaaatagtctaaaggaaatcgcaaagaatggtcatgtattaggaacaagtaaaggttttgatgcatttgaaaggcataatggtgtgcttagttttgataaaataggaattaacaaagcatcaactttcacaggattctgttcttatcatgataaaatgcttttttcctgcattgaggatgaagagtttatagcaaataacaagcaatgcactatgcttgcttacaggcctttgatgagagaattctatgttaaagaggcaaatctaaaagttttagaggcaagcaggatattcgatagaggatgggacttccaggctcagttggcatgggcaagacaagtgaatgagaatattgaaggtacaatattaagtttaaaggatttgagttatattaaggatgaaattgagtcgtcaatcaaagataatacatttagtgcattaaagaatttaattataaaacttgaggaacccccaaaagtaatggcatgtggcatttatgccccaattgttgatattctaggtaacgaaattcaagaaataacaaaagaagacgcgagacctgaatatataatcacaaatgttttagctttagatggtaatggttacgtgattttttcatggttaccagaagataataacgtaattcaaaagtttattgcatctattaagaaatgctccagacatctcttaggtgacaaacttacaaatcatatcctttcatttatggagaatgtttttgcatcagaggagtggtgggactctcagggggataaacagggatatataaatgagttattgatgcagggagtaagaatgcatgtttatgatttaggacttatttctcatgattataataactacaatgctataacagtaaatgaaataattgaaatttaattaaagaatgtttaatttatattttttaatagttcagcgtattgatttttcacattaccaactgcgcttgaaacagggtgccaagtaaaatggtcggttggcacggcgccgtcgacggctatctcctcagcctctttccctcctatatcctgtctcatccattccctggctgcttctggtgacaacaccagcggccggcggtcgtgaatatctacgagcccttgatctgctgcggcggtcactatcaaaaacccttcggcttcgtcgccgcgctcaaaaggcacgctaccgatcgccgccatgaagattggctggccgtcggcgcgatgaataaagtaaggctgcttcttgtctccttcgcgcttccattcaaaccagccatcggcaaaacatatcgcacgaccgtgctgccacagaggtttaaactcactgctgttggctgcggtctcaaccctggcattaatcaacggtggtttatcccaccacccgggtgcgtaaccccagtgaaccggatcgaggtgcagctgttcgtctcgttcgctcaggagcaaaactttagtccccggcgccacgttataacgcccaatcggctcagggtcgtatgcgatgtcgcgctcggcttcatccgctaggtatgccagatattcttcatgggtttgggattgagcaaatcgtccgcacatggttacctccagtcttcagactgaaagtatagaaggtgtggaggaaacgtaggaggggaactccgacagccatctaactgatgactgtcggagatgacgtcaaaaacaatgtgtacaaaattgtgtattaaaatcaggaaaattgcacaatttaaaagtttaactcattgtttttaattgacaaaaataattattttgtaggtgctatcgtagggcataccattccttatgtttcagtgggttagccatggcaccgagaatatcggaaatcacgttgacaataatcaccagcgcgccaatcaccatcactccggcggagatcgccgcgtagtcctgctggcgaatagcgttgatcagccagcggcctagtccaggccagctgaacaccatctcagtgatcatcgccagggtgagcatggtggaaaactgcaggccgagacgcgggatcaccggcggcagggcgttgtgcagcacatggcgcagtagaattttgcgtcgcgacacgccgcgggtggcggccgcttttacatagttagtgtcatacacctcgctggtgctaatgcgcatcaggcggatcacttcagtggtgggggcgaccgccagggtcaataccggcagcaccatatgccgggcggcgctgacgatcatctcatggcgccacggcgagtccgaaagccaggcgtcgatcagcgcgaaaccggtgacatttttcacctcatacagcagatcgaagcgaccggagaccggaagccagccgagggtcagggaaaagaagagggtcaggagcagcgccagccagaagaccgggatcgagaaaccgaccagcgcaacggcgctgatcagggtagcgggccatttattgcgcattacgccggcgatcatccccaccggaatgcctatcagcagggcaaagccgaaggcgaggatgcacagctccatggtcgccgggaaaacctcgcgcaactgctcagaaatcagctggccgttaatgctggagacgccgaaatcccagtgcagcaccccttcaaaccagaacagccacgcattccacagagaagcgccctgcagtggggcatgaggggtgaaatagctcaggctgaaaccgacaaaggtcagaaaaaagagggtgatcagcagcagcagcaggcggcgcagggtaaaaataatcatggctttttcacctcttcggtattttcccgcgatacgccagcgaacgaagcgttaccgaaagggctgagcaccaggcctttcatatcatagcggtaggcctgcagccgcagcgacgaggccagcggcaggaccggcagttcgcgggcgaggatccgctgcgcctctttgtaagcgtccatccgcgaggagagctgctgcgagagcagcgctttttgcagcacgtcgtcaaactcccggttacaccagtgggcaaagttggtttgcgaggcgatggccgcgcagctcagcagcggtcggaagaaactgtccggatcgttactgtccgtcgcccagccggagagcgtcaggtcgtggctcatatccatcaggcgcgcctcctggaaacgtccctctaccggcacaataatcaccttaacgccaatctgcgccatatccgcctggataagctccgccgttttcagcgggctgggattccacgcctgcgagctggtgggcacccacagcttgagggtcaggttttccagccccagggctttcaggcgggcgcgggcctcctgcggattatattcggtaattttagcgtcattatcgtaggcccacgaggcccgcggcagcatggacgccgccgtctccgcggtgccatagtagatagactgcatcaggcgctggttgttaatcgccagcgccagggcatggcgcacctcagggttatccagcggcggcttggcggtgttgaaggccagccaggcgatgttcattcccgggcgcagcgtcaggcgcaggcgcgggtcgtcacgcaggatcgtcaactggctggcggctggccaggccagcacgtcgcattctccggtcagcagtttcgacaggcggccggtgccgccggagccaaggtcgaccaccacctggggcatcaacggtttgccgcgccagtagccgggggggcgctgcaggcgaacatattgtccggagcggtaatcggatagctggaacgggccggtgccaaccggctggcgatccagttgctcctggcggtcgtcctgcgttaagcgggcggcatattcggcagaggtaattgacgcatagtgggtggccagatgccagaggaacgaggcgtccggccgcttgaggcgaaactccacggtctgattatccagcttgcggacgctctccacgctgtcagcaaactgcagactgtcgaagtaggggaagctgctgccgttgacgttgtgccacggatggtcgcggttaaaaatacggccaaaggtaaaaatgacgtcatcggcattaaagtcccgcgtcggggtaaaccacgccgtgcgttgaaacgggacgtggcggcgcaggtgaaagcggtaggtggcgccgttatcgagaacttcccagctctccgccagctcggggaccagccggtaggtatagggatcgacgtcaagcagacgatcgtagagctgagcggccagcgtatcgacaatcaggccgctgctgactttctgcgggttaaaggtattaacctggccgctgacgcaatagacgaaaccgctatcgcggatatcggcgcggtcggggagcgcaggggcggcaaaagctggcccacacagcagggaaacggctgccaggagagatgacaatttcaggcgcatattttctgtttgattatagagctgaactctatcttattaagattaatagacattcaccaccgccttcaacaagcctgagggataatgcggttaccgggtgcgtatagtattcagtcaattgattaaaatagtcgcggaaccgagtctgtatagtgaaacatggtaactttttatcgccgatatcgccagtcagctctgtttggccgcggttgaccaaacggcgacgacgtgcggacgctagagaatagattcagtatagcggggagaaagccgatgacccgacgggcgactagccatacccgtcgggtgtgatacagggggagcgtgtttcgattattgtgacagtgtcactttatgatagtccatattctgcaggtcctccagcagcccggggccaaccggctgccactgcaagcgctcgcgggtccatgccgagctggcgcgcaggtcaagggcggtaaacggcgcaaaccagccgaaccaggcgtcgacctgcgagtcatccaggtgggtcagcggcaggtttaatccgtgggcaattaccgcggcaatatcgcgtaacgcgatcccctcttcggccaccgcatgatagcgctcgcctgccgcgccctgaagcagcgcgctgacatacagacgtgcgacgtcatcgacatgggcggctgaccagcggttgcttccctcgccgcgcagggctaccgccccgttggcgaccgcgcgttcgatgtagcaggtcagcagtccctgacgcacggtgtcatgcacctgcggtaagcggaccaccctgacatccactcccgcctccagcaactgctggccggcgagctctgaggcggtgcgcgggctggggtgccctgagttgaagaacgactcccgggccggggcgccgctcccgtcgtcgcccatcagcgtgccggaggtgatcaccagcggccgcgtgctgcctcgcagcgcctggcccagggccaggatcgcctggcggtctttctcgcagttagcggcaaagcggctgaagtcgtggtcgaaggcggtatggatcaccgcgtcggcgttcccgacgccagccagcagcgactccggggcatccagcgtgccgcgatgcacctcggcgccggccgccttcagggcctgtgcggtgctttcgctgcgcgcgaggccgataacctgatggcccgacgcctgcagcgccggaagaatacgtgagccgataaatccgctcgcgccggtaagaaatatacgcatcatggatctcctgaatgggtttcaggcgtatcctacctgcgatgtcatactataaaagtagagacattatcggggtataaattctaacaggcagaacccacaggcagatgatgaacacttctgacaaccatgctttaggcgattttctccgcgcccgccgccagcgtctcgatccggcaacgtttggcttcccggcgggacgccggcgcaccccggggctgcgccgcgaagaggtcgcgcagctcgccagcatcagcccgacctggtatacctggcttgaacaggggcgcggcggggcgccttcccgcgaggtgctggagcggatcgcccgcggtctgcggctgaccaccccggagcgcgagcatctgtttattctcgcctttggccatccgccgcagacgcgtctgacggtgacggatgatatgacgccgcggctgcagcgggtgcttgacgctttcaccattccggcgattatccgcaccgccagctgggacgtcatcgcctggaacgcgccggcggccagggtgctgaccgactacagccaactgccgctggcggagcgcaacgtgctgcgccgcctgtttacccggccggaggcccgctgcactctggaggactggcagagggtggggcagcttatcgtcaacgccttccgcgccgacgtcacgcggatgggcgccacgaaagaaactgaccagttgatcgccgagctcagccagcagagcgtcgagttcgcccgtttctggcaaagccatgacgtcgccggtcatggagaaggctataagcgcattaaccacccgcagatgggtccgctcgacctggaatttacctcctttgccgtggagggccgtcccgatctttccctgctggtctttaatccggcaacgactgagagccagcggaaaattcacggtttacttcagggggcgggatccgcgccggaggagagctgaggggtaaattcatacagcaccagcgcattgctctgcagcgagtcgatccgcagccaatagccatcgagcctggcttcatccacgctgagcgccggacgggcctgatgcatcagccactgataatcctcggcgtcagggccgctgcggctgcgaaaggcgtccaccagcgggaacaacgcgccgtggtgctgatcgaacaggtgctgtttgatgcgccagctgccatccaggccctgcagccgcacgctgtagggctggctgaagcgctggataaaggccgcttcgctggagagccagggattgtagaccaccgtattgcgcagcagcagctggtagtgaccctggtggtggagcagcagcaggtttttatcgtgaaccaggatctcgccgcgcagccgccgccagagccagagtacccagtaaaccgggcgcggaaggccgtgcagatagtgcagcgccaggctggaggtatcgagcttgccgttggcgcgagcttcgccctggaggcctgaatttaaccagaagcccgccagccagacctggtccgccacccccagcagattatccatcagcagcgcgccgcgaaaaaagcggccgttggtatcccgcgtatcgccggtcagcgtattccaggagagcagccacagcggcaggttgagctgacgctggcgcagggcgctgtggatctgccgcaacttgtgcagcggataatgttcactggaggccaggcggctgctgtcaacctgggccagatccagctgttcgttggcatctgcctggcaggcgagaaaatccgcctctgccagcagcggcgagtggaacagcggatcgttcccgggatcgctgggagcaaagcggtgccagatccccagctgcggctgcggcagcaggcgatgaaggaccccgcgctgctgccgccaggcggcctggcgcgcagcttcgctggcctgcggcgaccagtgccagacaaagcgccagctgttgagcgtggctggcggaaaatggttggcggcgagctgcaggaagcgctgcagcaggtcactgcgggtggtgacgccggtgtgcaggatcacctgccagcccatcgccgccagccagctaaaaatctgctgcaggttgtaccagcaggcgtagccggccatctgcggatcgtcccagccggtaccgaacagccgactgctgagaaagggatcgttgatatcgatggcatacaccggcagggcgtggtgcagctgttcgagttcccggcgcacatcttcgcgcagcagatcgtccagttcgcgcacggtcaccaccatccgggtatggcgcagcgctgcggggcgcgctggacgatcgcgcagattgatctcccgggtctgcggtgggttgatcggcagggggggactttcccggtcgcgtggttccggctcattgagtcgcgcatacagccggtcgaccgccaccggctgccagcgatcggcctgcggcgggcgcggtcgggcaagctccagaggatgctgttcacgatactggcgcggcgtcacgccgtgctggcgcttaaacaaatcgctcatcattcgcgtactggcgaatccctgttcgcgggcgatttgctggacggttttgcgggtggttaatagctggtcggcggcgtggcgcaggcgcagcgcggtgaggtactggacaaaactaaccccgacctctttgcgaaataagcgtgacagccaggcctcggagacaaattccgcggccgccacctcctgcaacgagaggcgacgctgatagttagcgtcgatccgcgccaccacgctggctattctccggctccatttttcggtatcgcgccggggcgtggaggcgatgggctggctaaagcgcgtggccagcagcagcgctatctcactcagccagcggttggcctccagtcggtaatggcctggatgattgaccaggccgctcaccagcagctggcgcatcaggcggcgcaggccgtcatcggcatcccgggtgcgcggcgttatctggtaatcgacggcaaaaaaggcattatcgaggcgggccagccagctggcggagagggtgaggatcatcacggcgttggccccggcgctgcgcaggctccagcgacggttgcggttaacgatcgccagcccgtcggcggcgagcggctgcgacgcaccttccgccaccgccagatttacgcttccctccagcacccacagcagcgtcagcagatcgctttccggctgggtcagctgacgcacatcgcgtacggtgacgctaaagtcgcctgaatggtgctccacatggctctcctctgtagacaaaaaacaaccggttgttttttgtcataaccgatatgtatgaaaaacactcattgatttttcgtcaatataaaacaaaaaagcgcgcctgcaagctgaggcacccgcataaactcgaaggtgtcgtgcaaacacaacacaggaataacaaaaatgacacatccgttgctagaagcattgcaggttaacgaggcgcaatttatcgctctgcgtcgtcggttccaccagcagccggagatcggctttgaagagcaccagaccagcagcgaggtcgcccgactgcttggcgagtggggatacgaggttcaccgcggcctggcgggcaccggagtggtgggcacgctgcgcgtcggcgaggggaaaaaacgccttggcctgcgggcggatatggatgccctgccgatgcaggagcggagcggtaagccgtgggcaagccaggttgaagggcgctttcacggctgcggccatgacgggcacaccaccacgctgctctacgcagctgaatatctggcgcgcacccgccagtttaccggcacgctgcagctgattttccagcccgcggaagagttgctgtacggcgggcgggtaatggtcgaggacggtctgtttgatcagttcccctgcgacgccatcttcggcctgcacaatatgccgggtcagccgttgggcaagatcggcctgcgcgacggggcgatgatggcctcctccgatacgctgcatattgaagtgaagggcgttggcggccacggcgcggtgccggagcatacggtggatgccacgctggtggcctgccatattaccctcgcgctacagtccattgtctcgcgcaatatcaccccgtttgaaccggcggtggtgacagtcggcagcatccaggccggtcatgcgcccaatatcattaacgatcacgtgctgatgaagctcacggtgcgcaccctcaatgagcaggtgcgcgagaccgtgctgcagcggatccatgatatcgccgtggcccaggcggagagcttcaatgccaccgccacgctgacccacgtcaacggcagtccggtgttgcgtaacgatccggcgacgaacgccatggtgcgggaggtggcgacagcgctgtttggcgcagagcaggtgggcgaggtgaagccgtttatgggcagtgaagattttgccttcatgctggagcagcacccgcatggcagctatttcaccatcggcgccggcgatgagccggatcgctgcatggtgcataacccggggtatgacttcaacgacgcgctgttgctgaccggcgcggcgctgtggtgtggcctgacggaacgctatctgcgctaatcacgagaaacgggagggccatgcgatgagcactgtcacaataagcgacaccccgtttgtcggcaacgatcgcctgctggtggggattgtgttaagcgttttaaccttctggctgttcgcccagtcggtgattaacgtggtgccggcgatgaaaagcagccttgatatctctcttgaaaccttaactctggccgtcagtctcagcgcgctgttcagcggctgcttcgtggtcgccagcggcggcctggcggacaagtttggccggatgcggatgaccaccctcgggctggggctgagtatcgtcggcagcgccatgctggtggtcgctcagggaccggggctgttcctggccggccgggtgctgcaggggctgtcggcagcctgcattatgccggcgacgctggcgctgattaagacctggtatgaggggcgtgcgcggcagcgggcggtcagcttctgggtcatcggctcgtggggcggcagcggtctctgttccttcgtcggcggggctatcgccaccggtctgggctggcgctggatcttcgtcttctcgatcgccgttgccctgctggcgctgtttttgctgcgcggcacgccggagagccgcagcgccagcgccagccagcataagctggacgtcggcggtctgctgagcctgattgttgcgctggtgctggtgaatctgtttatcagcaagggccacggctggggctggagcagcccgctgtcgttgaccatgctggccggggcgctggcggcggggacggtatttatccgcaacggcatgcgcaaaggcgaggcggcgctgattgattttgcgctgttccgcaatcgggcctacggtgcggcagtgctgtcgaactttctgctcaatggggcgattggcaccatgatgatcgccagcatctggctgcagcaagggcaccacctgacgccgctggagagcgggatgatgaccctcggctatctggtgaccgtcctggcgatgatccgggtcggcgagaagctgctgcagcgctatggcgcccggctgccgatgatggccggtccggtgttgaccgctatcgccatcgcgctgatatcctgcacctttctcgaaaaggcgctgtatatcggggtggtgttcgccagcaacgtgctgtttggcctcggactgggctgctacgccacgccatcgacggataccgcggtggccaatgccccggagaacaaaatcggcgtcgcctcggggatctataagatgggcagctcgctgggcggggcgatgggtatcgccgtgacagcgtcacttttcgcgctgtttttaccgctgggcatggcccatgccgcccagtatgccctgtggtttaacgccgtcttatgtctgggggcgatggcggtgagcgcgctgctgctgccgcgcgcctctcacagctgatgctttttcagcagcgcgcggagctggtgataggttaatcccagcagctccgccgcctgcttctgatgatacttcgcctgctccagactccgctgcagcaggcgtttttcctgctggaactggaaatcgcgcagatccagcggtagcgcgggcagctcatcgccgggcgcggcttccggcggagagccgggggactgacgaaaagggttaataataatcgcgtccagctcatgttcgctgtcgccgtggcgatacaccgagcgctcaaccacgttcttcagttcgcgaatattccccggccagcggtagccgagcagcgtcgcggtcgctcgttcgctaaagccgggaaacagcggcagaccgagttcgcggcacatctggatggcaaactggttggcgagcaacatgatgtcgctctgccggtcgcgcagcggggggagctgtaccacgtcgaaggccaggcggtcgagcaggtcggcgcgaaaatgaccttcctcgaccatctgcggcaggtcagcgttggtggcgcacaccagccggacgttaacctgcagcggctggctgccgcccacgcgctccagctcgccatattcaatcactcttaacagcttctcctgcaccagcattggggctgtcgccagctcatcgagaaacagcgtcccgcagtcggcgcgctcgaagcgcccgggatggcgcttgctggccccggtgaaagccccggcttcgtggccgaacagctccgagtcgagcagattatcgttcagcgccgcgcagttcagcgagataaacggcccctgccagcggctggagaggtagtggagacggttagcaataagctctttcccggtgccgcgctcgccgatgaccagcaccggtttatccagcggggccagccgggaaacctgttccagcacctcgagaaagctgttggcctcgcccagcagattatccttgtactgcgccatgatgaatttcgccattaagtagtgtaattaaccaggtgactgtagcaatgcccagcacgtttcgcaaccaccctgtttaaaatcaataagataaaaagttggcacgccatttgtattagctaagccacaggtgaatgcctgaaaccagaactatgaggattgaaataatgggtattttttctcgttttgccgacatcgtgaacgccaacatcaactccctgctggagaaagcggaggacccgcaaaagctggtgcgtctgatgatccaggagatggaagacacgctggttgaggtgcgttcgacatcggcccgcgcgctggcggaaaagaaacagctgtcccgtcgtattgagcaggcggtcgcccagcaggcggaatggcaggaaaaagccgagctggccctgcgcaaagagaaagaggatctggcccgggcggcgctgatcgaaaaacaaaagctgaccgaccttatcgctcagttggatcatgaagtgcagctggtggatgaaaccctggcgcggatgaaaaaagagattggcgagctggagaacaaactcagcgaaacccgcgcccgtcagcaggcgctggcgctgcgccatcaggcggcgagttcgtcccgcgatgtgcgtcgccagctggacagcggtaaactggatgaggcgatggcgcgctttgaatcctttgagcgtcgcatcgatcagatggaagcggaagcggagagccaccgctttggcaagcagcagacgctggatcagcagtttgccgaactgaaagcggacgatgaaatcagcgaggagctggcggcgttgaaagccaaaatgaatcagtccaaccagtaagtatgattgcgcggcgcggcgttgcgccgcggctcaccccctgtaaggagtacacatgagcatgctttttctcgccattccgctgacgctgtttgtgctgtttgttctgccggtctggctgtggctgcactacaacaatcgcggcgccaacggcagtctgacgcaaaatgagcagcaacggctgctgcagttgaccgatgacgcgaagcggatgcgcgaacgcattcaggcgctggaagcgatcctggacgccgaacatccgaactggagggacaaataatggccgggctggatctgaataaaaaactgtggcgtatcccgcagcgcgggatggtaaagggcgtctgcgcgggcattgctcagcatcttgatgtcccggtgaagctggtgcgcctgattaccgtgctggcgatgattttcggcctctttttctttgtcctggtggcctacatcattttgacttttgctctggatccgataccggacagcgagctgtacggtcataaagcgccgagcaatggcgatctgctggccgccgtggatgccgaactggcctccggtgaacagcgtctgcgtgaaatggagcggtatgtgacctccgacacctttacgctgcgcagccgctttcgccagctgtaaaccctgtttctaacgaatgaggcaacgcatgaatagcaaatggcaacgcgccgggcagcaggtgaaacccggtctgaaaatcgtcggtaagctggcgctgctgaccgcgctgcgttatggcccggcgggcgttgccggctgggcggttaaatcggtcgcgcgtcggccgctgaaaatgctgctggcggtggcgctggagccgctgctcagcaggctggccaaccgcgtcacgcgcgggatgaaataatgccgccgtggggaaggcgcaaaaggattaacgttgtcctgcttatccccggcagatagcttatgatgacgagacataccttcagggcataacggactggcgatgaagcgactgaaaactgaattgaatgcgctggtcaaccgcggggttgaccggcatttacgtctggcggtgaccggcctgagccggagcggtaaaacggcgtttatcaccgcgctggtcaaccagctgttgaatatccacaccggcgcccgcctgccgctgctgagcgccgcacgcgaagagcggctgctcggcgtcaagcgcgtgccgcagcgggactttggcattccccgattcacctacgacgaagggctggcccagctgtacggccagccccccatgtggccaaccccgacgcgcggggtaagcgagatccgtctcgcgctgcgctaccgttcgaattactccctgctgcgccattttaaagatacctccacgctgtatctggagattgtcgactatccgggcgagtggctgctcgacctgccgatgctggcgcaggattatctgagctggtcgcgacagatgaccgggctcctgcagggacagcgtgcggagtggtcggcccgctggcggcagctgtgcgccgggctggatccgctggcccctgccgacgaggctcggctggcggatatcgctgccgcctggacggactatctccacgcctgtaagcgcgaagggctgcactttatccaacccgggcgctttgtcctgcccggagaaatggcgggcgcgccggcgctgcagtttttcccgtggcccgacgtcgacgccgtcggcgaagccaagctggcgcaggccgataaacacagcaacgccggcatgctgcgcgaacgttacaaatactattgcgaaagggtggtgaaggggttctacaaagagcacttcctgcgcttcgaccggcagattgtgctggtggactgtctgcagccgctcaacagcgggccgcaggcgtttaacgatatgcgtctggcattgacccagctgatgcaaagtttccattacgggcagcgcaccttgtttcgccggttgttctcgcccgtcatcgacaagctgctgtttgccgccaccaaagccgatcacgtcacgatcgatcagcacagcaatatggtgtcgctcctgcagcaactgattcaggacgcgtggcagaacgccgcctttgaagggatcagtatggattgtctggggctggcgtccattcaggcgacccagagcgggctgattgaggtgaatggcgagaaaattcccgccctgcgcggcaatcgcctgagcgacggccagccgttgaccatctatcccggtgaggtgccggcgcgcctgccgggtcaggccttctggcagcagcagggatttcagtttgaaaactttcgtccgcaggtcatggatgtcgatcggcctttgccgcacattcgtctcgacgcggcgctggaatttttgattggagataaactgcgatgagcgaaccgttaaaaccgcggattgattttgatgggccgctgcaagcggagaaaattccgccgctgaaaggcgctcgcgccttcgacaccctggaggcggacaacttcgcgccagcgcggctggtgaccggcgaagaggaagagggggcggcggaagcggtggtggagtcggtcctgcgacccaaacgcagcctgtggcggcggatggtcagcgccggactggcgatcttcggcgtcagcgtcgtggcgcaaggcgtgcaatggacggctaacgcctggcagacccaggactggattgcgctgggcggctgcgtcgccggggcgctgatcgtcggagccggcgtcggatctgtagccaccgagtggcgccgtctgtggcgactgcgccagcgcgcccacgaacgcgatgaagcgcgcgatatgctgcacagtcacgcggtcggtaaagcgaaagccttttgtgagaagctggcgcagcaggccgggctggatcagtcgcatccggcgctgcagcgctggtatgccgcgatccacgaaacgcaaagcgatcgcgaagtggtgagcctttatgcgcagctggtgcagccggtgctcgatgcccaggcgcggcgggaaatcagccgttcggcggcggagtcgacgctgatgattgccgtcagcccgctggcgctggtggatatggcgtttatcgcctggcggaacctgcggctgatcaaccgaattgccacgttgtacggcattgagctcgggtattacagccgtctgcgactgtttcgcctggtgttgctcaatatcgctttcgctggcgccagcgaactggtgcgcgaggtggggatggactggatgtcgcaggatctggcggcccggctgtcggcgcgcgccgcgcagggcattggcgccggtctgctgaccgcccgtctcgggatcaaggcgatggagctgtgccgcccgctgccgtggatcgccgatgataaaccgcgactcggcgattttcgtcgcgagctgattgggcagttgaaagagaccctgcagaaaagcaaaacccgcccggagaagtaacctccgctcagagacatcgccgggcggcggcttcgccttgcccggccttcgacgtcaagctctggcacgcgcaccctggcaatattcgattaggcgcattccgccgccagccactcgctgaaggcgcgaaagcgcgggcgggaacggttctcctgcggacaaatcaggtcatagccaaagggcgagggcgcttcattttcagacaaggccaccagcctgccggcgtcgagcagcggctggatcagcgttttacgccccatcaccacgccgagtccattaagcgccatctcgatggccagcgagtggttattcaccgcgtaataccggccgtcaaaaggtaacgcctgtccgctgtgctggcaccacaggcgccattccgcaaattgatcctgtacgtcggtggattcgcacgcatggatccagacgagcgccgccgggtcgccgccgctcagcggacgatactgctggcgataacgcggggagcagaccgggagcaaactttccgccatcagccgctgttgataaagatcgggatagcgcgtggcgccgtagtaaattgccagatccacccgctcctcgttaaaatccatcaccccggcgcgcacgcgaaactgcagattcagtcccggccattgcgtctgaaagcgcggcagacgcggcattagccacagatgggccagcgtcggcgcaataccaatatgcagcgtgccgcgcagatcctgatcgcgaatatcctcaatttcatcgttaatcgcccgcagcgaatggcttaacgtcgccagcagccgcttaccttcctctgtcagcgccagtttacgcgtcatgcggataaacaggcgaaacccgatgtgcatctccagcctgcggatccgatggctgaccgctccctgggttaggttcatttcatgcgcggcaagggtaaagctcaggtgatgggcggtcacctcaaaggtctgcagcagcgcaaggatgctttgttgctcaagcacagattgtctcccttatgcattaattgagttcatgcataggccgatttaattcgtttgttaggccagttttgccggttttaaatagttatatcgtaactaaaccgaggtataccatgtcaggactcaaaattgtggtgattggcggtggctccagctacaccccggaactgattgaaggtttgctcaaccgctatcacgaaatgccggtcgcttcgctatggctggtggacattgaagagggcaaagagaaagtcgagattatcgccggactggcgcggcgaatgatcgccaaagccgggctgactattgaagtggtggccacccttgaccgggaaagcgcgctgcgcgatgccgatttcgtctgctcgcagtttcgcgccggctgccttgacgcccggatcagcgatgaacgtatctccctcaagtatggcttgatcggccaggagaccaatggccttggcggcttcgccaacgcctgtcgcaccattcccatcgccctggagatcgctgccgatatggagcgactgtgtcccgacgcctggctgctgaactttaccaacccgtcggggatggtgaccgaagcgatcctgcgccacagccgcatcaaagccgtcggcctgtgtaacgtgccggtgattatgcaaaaagggataaccactctgctgcaatgcgctgacgaaaaagaggtggtgatgcaggtcgccggcctgaaccactttatcttcgtgcgccagatcctgcacaaaggtaaagaatggctgccggaggtgatagccgagatcaacgccggtcgggatccgctggtgccgcgcaacatttcgccgttccgttggccgtcgcatctgctgcagggcttaggcatgatcccctgcgcctatctgcgttattactacatgaaagacgatctgctgcgccaggagctggcggaggcgggcggcgaaggaacccgcggggaagtggttaagcagctggaaaaaatcttgtttgaccagtaccgcgacccgcacctggcggtcaaaccgaaggcgctggaagggcgcggcggccagtactattccgaggcggcctgcgagctgatgaatgccatctacaacgacaagcggattatcatgcacgtcaacacgcgtaataacggcgccatcaatggcctgccggatgactgcgcggtagaggtcagctcgctgattaccgcttctggtccgctacctctcaatgtggcgccgttcccggaagataccctgcgtttgctgcagctgatgaaatcatttgaacggctgactatcgaggccgcgctcaccggcaaccgccataccgcatggcgtgctctgatgctgaatccgctgatcgtcagcggcgagaagctcgaactggcgttggatgaggtgatcgctgagaaccgtcagtggctgcctgctttccacgcctgacccaagactcaccggccgcctggccggtgatttaaccactgaccgtctgactttacgccacagcgcccatttttccgccacactgtcaataattgttgacagttagcttcccgaaaacccattcctggcctattattctcccgtcattggcacttttagggtgaacactcccatgcgtcttgaagtcttttgtgaagaccgtctcggtctgactcgtgaattgctcgatttgctggtgctgcgtggtattgacctgcgcggtatcgatattgaccctattggccgaatttacctcaatttcgccgaactggaattcgccacgttcagcagcctgatggctgagatccgccgtatcgccggcgtgacggacgtgcgcaccgtgccgtggatgccgtctgaacgtgaacacctggcgctcagcgcgctgctggtagcgatgccggagccggtgctgtcgctggataccaaaggtcgggtggaactggcgaaccccgccagctgcctgctgtttggccaaagccaggcgaagctgcgtaaccacccggtggcccagctgatcgccgattttaacgttcagcgctggctggagagcagcccgcaggagacgcatgcggagcatgtggtggtgaatgggcagaactacctgctggaagtgactccggtctatctggaaggcgagcataacgagcgagtgctgaccggcgccgtggcaatgttgcgctcaaccgtgcgcatgggacgccagctgcagaccatgaccagccaggataccagcgccttcagtcagatcctcgcggtggggccgaaaatgcgccacgtggtggagcaagcgcgcaagctggcgatgctcagcgcgccgctgctgattgtcggcgacaccggcaccggtaaagatctgctggcccatgcctgccatctggccagtccgcgggcgggcaaaccctatctggcgctcaactgtggctccattcccgaggacgcggtcgagagcgagctgtttggcgacgcgctgcagggcaagaagggcttctttgagcaggccaacggcggctcggtgctgctggatgaaattggcgagatgtcgccgcgcatgcagaccaagctgctgcgctttctcaacgacggcaccttccgccgcgttggcgaggatcatgaagtgcacgtcgatgtgcgggtgatctgcgcgacgcagaaaaacctgatcgagctggtgcagaaagggcttttccgcgaagatctctactatcgcctcaacgtcctgacgctgtatctgccgccgctgcgcgattgcccgcaggacatcatgccgctgacggagctgttcgtggcccgctttgccgacgagcaggggatcccgcggccgaagctctctgccgatctcagtacggtgcttacccgctacagctggcccggcaacgtccgccagctgaagaatgccgtctatcgcgcactgacccagctggaaggatttgagctgcgtccacaggacattctgctgccggaccatgacgtcgcctcgctgccggtgggcgaggaggccatggaagggtcgctggacgacatcacccgccgctttgagcgctcggtgctgacccagctctatcgcagctaccccagcacacgtaagctggcgaagcggctgggggtgtcgcataccgccatcgccaataaactgcgtgaatatggtctgagtcagaaaaagggcgacgaataatcccgccaggccggcgacccacgtcgccggcatcccggcctgcaaagcgggccaaacctgtatatactggttttttaatcctttttccggggtggtgcatcttggcgtcgcgtcgcgcgatcgggcactggctgatattgctgctgctctctgttctcttttcctcgctgctgttacgaatacacctgccggcagcgctgctgctggggccgctgatcgccggtctcattttgagcctgcgcggggtgaagttgagcatccctcgcccctgttatctggcggcgcaggccatcgtcggctgcatgatcgcccgggcgattaatccctctgtttttggcgtgctgttcaacaactgggcgctggtgctggcgatcctgttgaccaccctggcgataagcggccttaccggctggctgctggtccgctacagcgcgctgccgggcgccactggcgcctggggaagctctcccggcggcgcgtcggcaatggtggtgatggcccaggagtacggggccgatgtgcggctggtggcgctgatgcagtatctgcgggtgctgtttgtcgtcggcgcggcggcgctggtggtgcgctatgccctgggcaatgaagcacaggagatgactcaggatattgtctggtttccatcgttgaccctgaatttccctttcacgctgctgctgacggcggtggcctgttggctgggcatgcggctgcgcatcccctccggggccatgctgctgccgatgctgcttggcgccctggcccagggcggcggctggctgatgctggagctgccggagtggctgctggcgatggcctatgcggtgctgggctggacggtggggctccagtttaataaagccatttttctgctggccctcaagacgctgccgcagattatcgcctccatcatcggactgatcctgatgtgcgccctgatggcccttgccctgacccacattctgcagatggactttatgaccgcctatctggccaccagccccggcgggctggacacggtggcgattatcgccgccggcacccgggcggacatgtcgtttattatggcgctacagacgctgcggctgtttaccattttgctgaccggcccggcgatggcgcgggctatctcccgctatgcgccgcggcaataaaaagccctcgcagagcgagggctgggcagatcgaatgtccgcgagcgcgatgcgcccgggcaatctgttatcaggctttcagggcggccagcgcggcgtcgtagtccggctcttcggtgatttcgttcaccagctggctgtagacgacctgatcgttttcatcgattacgaccaccgcacgggcagccaggccagccagcggaccggtggcgatggcgacgccgtagtcagcgaggaaggacgcgccgcgcagcgtggacagggtgaccacgttgctcaggccttccgcgccgcagaagcgggactgggcgaacggcaggtcagcggaaatgcacagcactacggtgttgtccagttcagcggccagctggttgaatttacgcactgatgcggcacacacgccggtatcaatgctcgggaaaatattcagtactttacgtttgccggcgtactggctcagcgcgacgtcagagagatctttggcgaccagcgtaaacggctgcgctttagcgcctgcctgcggaatggtgccctgaacagaaacggggttgccctggaaatgcacggtttgtgacatggttatcttcctgtttacatatagttaacgtcgcgagtagtgtatgacatccgccagctacacggcaaaccctatttaacatttaccagagaggacaagggaatgcgtaacgtgcgagtgtatgaggaagcctggccgcttcataccccttttgtgatcgcccgcggtagccgcagcgaggcgaaagtggtggtagtggaactggaagaggacggcgtgaaaggggtaggcgaatgcacaccctatccccgctatggcgagagcatcgcctcggtcatggcccaggtgatggcgatcggcgagcaactggaggcggggcttacccgcgaacagctgcagcggctgctgccggcaggcgccgcgcgcaatgccattgactgcgcgctatgggatctacaggcccggcgcgaaggcaaaaccttggcccagctgttgggcgtggcgttgcctgaccgggtgattaccgcccagacggtggtcattggcacgccggatcagatggcggccagcgccgcggcgctgtggcaggcaggggcccagctgttgaaggtgaagctcgacgatcgactgatcagtgagcggctaatcgctatccgccaggcggcgccggaggctacgctgattgttgacgccaatgagtcctggcacagcgaggggctggcggcgcgctgtcagctgctggcggacctcggtgtggcgatgcttgagcagccgctccccgccgacgacgactcggcgctggaaaacttcgttcatccgctgccgatttgcgccgacgagagctgccacacccgggagagcctgccgcggctgcgcgggcgctatgagatggtcaatatcaaactggataaaacgggcggcctgaccgaagcgctggctctggccggggaggcggaacggcagggatttgaacggatgctgggctgtatgctctgcacctcgcgcgggatcgccgccgcgctccctctggcgccgctggcgcgcttcgctgacctcgacggcccgacatggctggcggtggacgttgagccggcgctgcggttcagcaccggcgtgcttcatctttaagcctgccagtgcagcagatcggtcatcgccggcaggtaacgctccgttgcctcgtctgcggagaccggcggaaactcggcggtgatgcaggggagtccgatatcggcgcaccagctgccaaaggagcccggcgtgtcgtagcccacgctgcccaccagcggcagggagaaggcgtcggccagccagcgacccagcgggctgtggcccggatcttcgatgcaggccagcggatcgtgaaaggagaccacccacgccggatgaatctgatggatcaactgacacagggcctcggtctcccgttccgaacccggctgctcgccggtcaacagcaccacgtcgcgctccgccgccgcgctattccagcggtaaaccgtttccccttgcttccagttggctgctggaaagttacggttgaggtcaacgccgcgggcattggcgcgcagcccgagctgacagccgtcaggattgaccgtcagcaccacgtggtggcggcgcagctcgggtttcagggtgcgcagggcgcaggagagggtcacaatcgacgaattctcatcaccgtgggtaccggcaataatcagcccgctacggctgtcggcctgcggcgcaggaaaccacagcagcggcgcgcccagttccgagctgccatactgccgggttcccggcggaaagtcgccgcgctgcgggcgaggacgtgaaatagacatagggcttcctgtgtgtcgttattatttagtgttggcgaaaagcgtatcgggatcaaacccattccctgaggcgtgaaatccgacggcacatcaattttctatcatatgtcgtttgcaatttcaggtgatgaaacaaataattatcgctctgttggcggtatttttttcattttaaaggggatcttatgaagtatcctgtcgctttgacatgcggcgcgctgtggttagccagcgtatcttctctggcctgggcggctgacgtaccgccgggcacggtactggcggaaaaacagctgttagtgcgccatatcaaagatgaacccgcctcgttagatcccgccaaagcggtgggcctgccggaaatccaggtgatccgcgatctgtttgaaggtttagtcaatcaggatgcgaaaggcaacctggttccaggcgtagcgacccgctggcagagcaacgataaccgcgtctggacctttaccctgcgtgataacgcccgctggtccgacggcacgccggttactgccgaagatttcgtctatagctggcagcgtctggtggatccgaaaaccacttcgccgttcgcctggttcgcggcgctggcggggatcgctaacgcgcagaacattattgacggcaaagccgcgccggagaccctgggagtcaccgccgtcgacgcccacaccctgcgggtgcagctggataaaccactgccgtggttcagcaacctgaccgccagctttgccttctatccggtgcaaaaggcgaatgtcgacagcggggcgaactggacgcggcccggcagcctggtgggcaacggcgcctatgttctgaaagaccgtgtggtcaatgagaagctggtggtggtgccgaacacgcactactgggataacgccaaaacggtgatccagcaggttacctttgtgccgattaaccaggagtccgccgccaccaagcgctatcttgcaggggatatcgatatcaccgagtctttcccgaaaaatatgtaccagaaactgctgaaggatattccggggcaggtgtataccccgccgcagctgggtacctactattacgctttcaatacccaaaaggggccgacggcggatgagcgggtacgcctggcgctgagcatgaccatcgatcgccgggtgatggcggagaaagtactggggaccggggaaaaaccggcctggcgcttctcgccggacgtgacggcgggcttcaccccccagccgtcacagtttgagagcatgagtcaggctgagcttaatgcccaggcgaaagccctgctggctgccgcgggctatggcccgaatcgtccgctgaagctgacgctgctgtataacacctctgagaaccaccagaagattgccatcgcggtggcgtcgatgtggaagaaaaacctcggcgtggaagtgaagctgcagaaccaggagtggaaaacctatatcgacagccgtaacaccggcaatttcgacgtgatccgcgcctcgtgggtgggggactacaacgagccgtccaccttcctgtcgctgctgacctccacccacagcggaaatatctcgcgctttaacgatccggcgtacgacaaaatcctcgcccaggcggcggtagagaattcggccaaagcgcgtaacgacgattacaacgcggcggaaaagatcattatggtcaaagcgccgatcgcgccgatctaccagtacactaacggccgattgattaagccgtggctgaaaggctacccgatcaccaacccggaagatgtggcctacagccgtaccatgtatatcgtgaagcactaatcggtcgtggttgcctgaagatgtcaggcaaccatcgctgatccccgagctggcgcgtcttgccgcgccagtttttcctgctctccttctcgcgccacagtagaaagtctcacttttctggcagtatggccgactgatgccaggttctaccatctggtcgcgaagcatcagaagatctcatccgccgggtttttatcatgatgctcaacgtattcggcaatcatgccatccggatgccgaaccagcatgttccagccggtgggcacggccttcaccgggttgataatcgttgccccggtggaaggcagatgtttctcccaggcggtaatgtcgtttaccaggaaagtggcctcggtggcgcgaaacggagccaggctttgctcggttccgccaattaaaagcacggaacccacctgcgccagtttgagatcgtattcgggatagtcaaaacgtaaccttgccttttgcgaaatgagatgttcataaaacgaaacggtttcttcaaagcgggcaatcagcacgcatcgacggatcaggatattgaggactttcattatatctccttcgccattttctcagagatagcgtagcagcactgaggtggaatgtaaggctcaagtagcagaagagcgtgacgtatagttgtggcctgcgtataagaagatatcggcaatgaccttgtgcgctggataagaaaagttgcagttaaaaaatatttattttgtaatgatgctgtggtgtgattgctgagcatacgattagcgggatgattaagaggggctagatggaaagtttaatttcttcgatatggaattttgatgggctgataaatagcgcgttaatttttgttacttttggtttattaggagtgtttatctggaaacgggcaggatccgcatattctttattgaaccggctatgggagttctgcctgggagggaaaacgtttcacgacggtaaaataaatgcatatttcaatgagagaaatgatgttgaacgctttaatgttttatttaatgttggcgcaaagaataaagaagagattaaatcactgattaactggacgaaaaagaaaaatatagatattcgtcatgtcacagccgcgaaaggatggtttgaaatatcaacgcttaaggcaataaaaccattatttatcgctaatgttggtgtatttgtctcttgtgtgttaactatgctgctattatcaaattttatgttgctggcattgaagccatccgcactagtacgattaggcgacgacaagtcatgggtttggattaatgatcatattgctgagagttcgatctggaccaataattaccttcccctgaactggactgagtggaagctcgataaaaaacagtgtgaaagtgaagatttcgataaaacggttttctcagaaaaagcggggataagtgtgcgctcggttgacaggatttgtgagaacttttcaagtggttcgttgagtgatactataaataatattattaaaaatcaaaaactggcatgggttttggctatttaccccttcatctttacgattatttgcttttttagcttgttacgcagaggtgctgcttctaaactttataatgaagtacataactcacaaaattaatatttatataaattcatttccgtctggcattactgtttgcatcgatcggaattaaatgacaggtccgagtacagaagctgtcaccggccactaccggttgcctgctgcctgcaggcaacctcagctacattcgcaatgtatcaatgaccgctctcagcgcgggcgacacattgcggtgcgggtaatagagaaatgaaccttccagacgctggctataacgctggagcacccggataagtgtgccctgggctagatcgtcggtaatcagctcttccgggacataggccagccccagaccgagcctcgccgctttggcctccatatagctatcggcgaaagcccactgtccctgaggtgggtgggtgatttttttgccatccacattaagttcccaggcgtaaaggctgccgtcgccgaactgataagcgatgcaggggtggacgactaaatcggcgggcgtttgtggaaagccgtagcgtcgaaaatgttccggggtacccaccaccgccatctccatatcgggcgaaatgcgtaccgcaatcatgccgcttccgacttccgggcccagacgtacgcccgtatcaaatcgctgcgcaataatatcgacaaaccggctttcgctgatcagttccagtctgatatcgggatagcgttgtttaaatactgccagcttcggcagcaggactttatcaatggcatgctggctggcattgatgcgtaccgtaccggagggcgtctgacgatagtgggccagcgtggcgagccccatatctaaggcgtcgaaaccggattcgacgttgtgatagagctgctcacctgcctgagtgagcgacaaccggcgggtggtacgcaccagaagctgaacgcccaggcgttcttcaagttcacgaaccgcacggcttaccccggactgcgccaggccaagtcgttgcgctgcggcggtaaaactgccttcccgtaccacctgcataaacagataaaggtcattatagttttcccgtttcgccattctcccgcctcgtcacccagatgccatttagaacaatatggtattaattttagcatttttcagcctctaatcagaaccattactgctggctacactaagcgcacgacaacaaagcacagcagcgttgtctactgaagacttgcattgatcacgtttatttaggggaattttgatgacggttttcaccaaaaaactgacagccgcgatacccgccatgctgctttgcgcctcattaactggagtcacaacgatgagctctgctgagacaactaacccgaatgcgcctgtttcactgattgaacaatgggataaaacgtttgctgagagcttgaaagtggatcaccgtaaggtgaccttccagaaccgctacgggataaccttagttggcgatctctacctgccgaaggatcgcggtgaacgcaaactggcagctattgccgtgagcggtcccttcggcgcggtaaaagagcagtccagcggcctgtatgcccagacgctggccgaacaggggtttgtcaccctggcgtttgacccatcctatacgggcgaaagcggtggctacccacgcaacgtagcctcaccggatatcaataccgaggatttcagtgccgcggtggactttctgggcctgcaaaaagaggtggatcgcaaccgtatcggtttgctcggcatttgcggctggggcggtatggccctgaacgacgcggcgatggacacccgcgtcaaagcggtggcgaccagcgtcatgtatgacatgagccgcgcgatggggcatggggtaggcgatggcaaagaccgctacacgacagccgaccgccgagcggtactgcagtacttgaacgcgcagcgctggaaggatgcggcaaacggcacttccgcccccggtgggcatgacatatatgttgatgataaaggcaacgtcagcgctgccgatcgtattttgccggaaagcttgcccgccaaccccaatccggtcctgaaagagttcttcgattattaccgtatgcgacgaggtttccatgcgcgttcggttaattcaaccggggcatggaatgcgacgatgccgctgtcgtttatgaatatgccgctgctgagttacgccagtgaagtgactattccgacgcttatcgtgaccggcgaaaaagcccattcacgctattttgccgaagatgcctttaaggccatcggcagtaaagagaaagcgctggtgattgtcccaggcgcaaaccacgtcgatctctatgacaacgtcgcgggcaaaattccctttgcgacgttcgcgcaattttttaaaaccaacctgaaatagatctcctgtgccggagacatccccaaagccgccacgcgcctgcgggcggctttgtcttgtcggagagaaataatgtctgcattaggtcacacccgggcacactggagcggcgtcctggcgatgacgctctgcgtatttgtgctcattgcctcagaatttatgccggtcagtctgttgacacccatcgcgggtgatttacacattaccgagggattagccggtcagggcattgcgctttctggcgcgctggcggtactgaccagcctgacgatatcccgtcttaccggatcgctggaccgtaaatggctgctgctggggctcacggcgttgatggcagcctctggggtgattattgccctggcgtccagtttcccggtttatatgctgggcagagcgctcattgggatcgtcatcggcggcttctggtcgatgtcggcggcaacggccattcggttggtgccgcaacgccaggtcccccgcgcactggccatctttaacggcggcaacgcgctggccaccgttgtggcagcgccgctgggcagctacctgggggccaccgtcggctggcgcggcgcctttttatgtcttgtcccgctggcggtgctggccttcgtctggcaatgcattagcctgccgtcgatgaaaagtccgcgcgcaccacagcggcagggatcggtgctgcgtctgttccgtctttctacgctatccctgggattgctggcctgcggactgttctttatgggacagtttaccttatttacctatgtgcgaccgtttctggagacggtgacccaggtcagtccttctggtctgtccctgatattgctgacaatgggtatcgccggttttatcggcacgctgcttattacgaccgttctgaatgcccgattttatccgacgctggtggctatcccgttgttaatggccgcaattgccggaacgcttctgctggccggacaccacacgggatcggtcgccgtactgttaagcctgtggggcctgctggcgacggcggcgcccaccggctggtggacatggattgcgcggacgctgcccgaggatgcggagacgggcggcgggctgatggtcgccgtgatccagctatcgatagccctcgggtcaacggtaggcggcctggtgtttgatagtctgggatggcacagcacttttgcactgagcggtctgttactgctgggcgcggcaggggtgacttttctgctctctgtcaaaatcagatcatctcagcgcactgcgattaatgaattgaatgcataagtcaaatcaggaatgacaggctaatcgtgaccgcgttcctgtcttaccatggtgttttaacaagaggggagcttcaccgtggaatattcagtattaagtaacgctcgcaaaatgccgatgctgggtttcggcgttttcaaggtgaccgataaagcggagtgtaagcaggcggtgttgaacgccattcgcaccggttatcgcctcatcgataccgctgccgtctacgataatgaagatgcggtgggtgaggccgtgcgcgaagccatcgccgaaggtctgtgtacccgcgaggcgctgtttattacctccaaactgtgggtccaggacatggccaacaccgggatggcgaaagccgggattgccgcgtcattaaaaaaatcgggcctggaatactttgatctttatttgctacatcaggcgatgggcgattatttcagcgcctggcgtgcgctggaagaggcctatgaggccggtaccctgaaagcgatcggcgtctccaatttttacccccatgtgttagctaacttctgcgaaactgtcagaattaaaccaatggtgaaccaggttgaactgcatccttatttcgcgcagcccgcggcgctggaagccatgaagcattatcacgttcagcctgaagcgtgggcgccgttaggcggtggcagacataatccgtatcaagatgcattgcttcgggggatcgccgatgcgcaccagaaaaccattgcgcaggttgttctgcgctggaacgtgcagcgtggcgtcacggtgatccctaaatccacccgccaggagcgcattgaagaaaattttgctatctgggatttcgtattaacagataacgaaatggcgcaaatcagcgccctggatttaggctatgttggcgaagcggtaaaacacttcaaccctgagttcgttcgcggatgtctgggggtgaaaatccacgactgaccgcggcaccgattggctccatcttcatctccccgcctgcgccgcagcgacgggctcggtatgctggttagcacccacgtgtttgccgcgacggttgtcaatgcggtagacgatcgtcacgggctgcgggccggcgggggtgacggtcaactccctgaccatttggccagcgtcgggcggcagggtcagcgaggtttctccctgagcgagcatctggccattttgcctgacctgccaggtcaggcggcaatcctcgcaggctgcccaggtatcgttaatcgcccacaggcgcaccgtcgccgggcttccctgacgccagctggcgggcaccggctcgatggacggcaggatcggctgataggcgcgctgcagggcatagtaaccggccttcggctggcgcagataatccaccaccccccagttgatggagggccatgtctcaacaaacataaagtggaacagggcggtcaccggctgataacgctgacggcgatagctctccgccgccagcgccaccagccgggcctgatatgcttgggtgttttcaatcatctcctgaatattgttgcctcgtggaataccggcaaatttaaaggtctggaaaggctgaaaattatggtacttccatcgcacccagccggggtcgtcggcagcggtggttttcggccacagcagacgggccgggataatggtcttcagggtggagagccggggcagcgcctgggcgccaaactcggtaataatcccggttttcgccggggcgagcaggtcgcgcagggtgccgaaataccagcctgcccagtagtgctcttcgacagcggaaaagcgatgcacgatgcgggaggtgtcttccgccagcgcatcgcccacccgctgcgtcagggtctggtttaaggttttacgccagtcggggaagcgtttctccatccacggcgagttccacggcggctcgttgtgaccgccccagacaataatcgccggtgaattgccgaactggtccatcatcgcccgggtctggcgcacggcgttatcggcgaaggcggcgctgtcatcataaccccactgcagcgggacatcctgccaaatcatgagtcccatctcatcggccacctcatacagcgcgcggcccgccacgtggccgtgtacacggatggcgttggcgttcatcgccgtgacaagcctgaaatcccgacggtactttttccgcgtcatggtgcttagccatggggagccaatatagttgctgcccttaatgaacagccgtctgtcgttgatgcgccagccctgattatccgccagcgcttccaccttacgtaatccggtgcgggtgacggcggtatccatgatcccccgcttatccacgagggtggcgcgcacgcggtacaggttcggtttacctgtgcccaccggccaccagagctttgccgagggcatgggcagcgagacgcgcagagtgcctgcggtattctccagggtgaccgcaaaggcctgctgaaaaggcgggccggaaaaattgtccggggtggccgtcaggcgcagcgtgacggggccgggcgtcacggcccgatagcggatttcggcacgcagcatgggcttctccagcccctgttgccagtccgggcgcaggatcacctcgtcgatagtgacgccgcggctcagatggagcttcaccggcgcccagatccccccggagttggcatcctgcccctgaaccgaccaggcgccgcccggacgggtatcgtgctgattgaggatccctttcatcagcgtcttgtgcagcggccagatcttttgcgggtcttcataggggctgtcgacccgcacggcgagctgattatggcggcgaacggccccggtgatgtccaccgggaagcgctgaaaatagccttcgtgccgggtcagcgtcttgccgttgagcgccacctcggcaaagtaatcgacgccgtcaaacaccagcgtagccatggcgtccggcgtcaggccatgcagggtaaattgatggcgataccacagggcgccctgatgatcgtatccggcgctgtaccagtttgccggtacccgcagcgtgcgccagtcgccgtccgaagcctgcgcgccggcgaaggcgctgtcgttggcgtcatgcacccgccattgtccggccagtgaccaggtcaccggcgcagaaccggcgtgcgccagcggcaggcaaatgaccagcagcagaagacgtctagcgatcatggggaacctcctgcgttctgcggcgcagccacaggtggcagcccgcgatcgcctcggtcagcgcgtcgcgcaggtcgcccggcacgctttggtctggcgaggccgcctggctctccagccgctggagcacactggcaaggcgttgaaaaccaagggtggcggcctcgccgcgcagtttgtgggcggcgcggcgccatgtctcccggtcattggcgtcaatggcgtggttgagggcggcggccgcagcattaagtcctgcagcgaagagtcccagcaactcctcgacaagctcaggatcgtcggcgcactgtttcagcaggcgggcttcgtccggcaggccttcctcttcctccggcgcgctatcttccgccgcgccgacgcgggcgatggcttcccgtagcgcctcctggctcaccggcttagcgatatagccgtcaaaacccatcgccagacagcgttctctatcgccctgcatagcgtgggcggtcatggcaatcgcgggctgatgttgcctgcccagcgcgtgggtctcttcccgcagcaggcggatggcggtttcaccgtccatctccggcatttgcagatcgatcagcagaagatcccagcaggctgcgcgccagcgctccagcgcttcccgaccattgttcactacctcgcagcgatgacccaactgctccagcagtcgtctggcgaccttctggtttaccaggttgtcctcggcgagcaggatatttagcccggtctggtccctgaccggttgcgcaacgggggcaggcgttgtcgtcgccaccggcgtgggcaccagaatgccggcgataacctgatgcagttcgcgctgtgccaccggtttatgcagatagtgggcaatgccgatgcgcttaagcatattggcgtcaaaatggcggctcatggagctgagcataacaatctggttttgcctggcttcaggcaaagcggagagctccagcgccagggatacgccgtccatatccggcatctgcgcgtccagcaggatcagcggccatggcgggccttcggcggcccggcgtagcgcctcgccagcgttgttcacgcaggttggcatcagtcccatctggcgaagcatggcgtcaagcaggcgcaggttggtgctgttgtcgtcaaccaccagcacccgctggtggttgaagcgtcccggcggggcgctaccggagacggcggcgtgcaggccttccagcggcagggtgaaggcaaattcgctgcctgccccaggctggctctccaccgtcagctcaccgcccatcaggctgaccaggcgggccgaaatggttaaccccagtccggtgccgccgtagcgacgggtggtggagctatcggcctggctgaaggcctcgaagatcgccttttgcttctccggggcaatgccgatgccggtatcgcgaatgcgaaagcgccagcggttgtcgtcctcggccggcgctatcgccagcaggacctccccctgatgagtgaacttcagggcattacccagcaggttggtcaggatttgccgcagccgggggccatcgacgatcagcacctcaggcaccgcaggggagatatccaccagcagctcaatgcccttttcgctggcggcaggcatatgcgggcggatcagcgactgaacaaaagggcggatctccagcggctctacgtccacctgcatcttgcccgactcaatgcgtgaaaaatcaagaatgtcattgataatgtgcagcagcgactgggctgagctcatcaccagcgaaaggtactctcgctgctccgcggtcagcggcgtgtcgaggcagagctgcgtcatgccgagaatgccgttcatcggggtgcggatttcgtggctcatattggcgaggaaggcgcttttcgcttcgttcgcctcgcgggcctccttcgccgcctcaatggccagcagctctgcggctttacgccgggtaatatcctgcaaggtgccgatcacccgctctgcctgctgctgcatgttaagggtgacgatctgccccgagagcagcatccagcgccagccctgcgtcgggtgctggacgcgaagctcacattcaaaaaccggcatgtgctcgttttgcgaggcgatcatcgcctgctgcagagtggcgcgatcgtcctcgtggaccaggttgagcataaagcgcagcggaaagcgccactgcgcccgcgactggccgaccatcgccagcagggtgtcattcacctgcaggctgtcgtgggagacctgccagtcccagataccgatctggatcgactccgcggtgaataaaaagtcatcatgcagttgatgacgcgaacgccgggcctcgtcaagctcggtgatgtcggtatgcaggctgacaatcccgccatccgccagccgctgatgctgaacgtaaatccggcggttgcccgactggcggacctcgcagtggttcgtctggcggcagttgcggataatcgcctcgcgcagcgtctgttgccggcctgggtcgatgttgtatccggcatcgataaacttctccgccaggctctcaagagaggcgccgacggcgagccagggcgcgatcgttggataaaacagcgccaccttatcattccaggcctgcagtcgttcgcgctcatcgtagatcatcaccgccgagggcaggaggttaaggtcgttacggttagcggcatgcatgattactggccaacagtttgatagtggagctccgcttggcggcgcagatactcgagcccaggggcgatggccattgcccatgcggtgaggatctcctcatcgcacagcggatcgcaggcgcggacggttttgagcatcgcttcccgccagagggcaaaaaaccgcggcggtagacgcaggccttcctcgctctgcgctcgcgccaaccgttccagaaaatcgggtacaaagaggtcgccgttgaccgccagcatggcgaaaaagctcttaaagatcatctgctggccttcctcgccggagcgttgggagaagtgctgctcggtttccggtgacatatggataaaggtgctgtagaaggcctggaagaagcgctgtttgtcgtgctctggtacgacgcgattcaggctggcttcaaagagatcgcgataaaacttcatggtgcgctccttatgacccgttcgcccggcaggcagcgtcggggcgggttaaattcgtccgtcgcgcggtgggcaaagtagctgttgtcatccgcgaggccgtttttgaacaacggcccggcgttgtgtttgtaaaacagcgcctccagcaccatggcgttggtggagagggtgagggtggcgttgacgtcgccggtggcctcgacccgtccttcaaaccagccgcgctgcgggtcgttaagatgggtagtgaccgccatcagcgcatcggtatactcggtttcccaaagcgtccacaggacaaagaccgctttggtggtcacctgcgccagccgggggtagtacttcccgtcgtccccgagcgtattccaggcgtagccattcccccagacggtgtcttccacgtgccagggcgcctgggtaagcgaaaaatcggcccgggcggtaagcaccttatcctgcgtccagcgcgttttctggctgagccatatcccttccgcccgctcgcgcatggctttttgcgccatctccggcacgccgggcggctgccagccgaactccagtccaggcagcatggcgggcagagtagagagcactacgggttgccaggtggttcgcgggtcgcggtcgtcaacggcgaggcggcgctgataaataatcacatggcgcgccgggggggagagggccttgccggccggaaatccccacaggcgaaacgcgctggcggcgtattcactgtctcccagccggagctcctcgcggatcgtccgctgaccgttctgcagtgaggcggaccacagctccccgtctttatcgataaccggacagaagttccagcgcaggacaattttatcaatgtattcaccatactgcggcgcgcgttcggcggtgagccgcagggcgagcatcagtcgggccatatcttttgctgaccagccgctggccgccggtttgccgctgaagtcgacaggggtcgccgtctgagtggagtatagcctgcccggcgaaccgccgtcggtcagcgtcaggcgattgagggtgccgagcaggggcgtcaggcgggcgtcgaattccgcttcctttaccaaccccagctctctggcggcgagcagggcgataagggtgtcgcccatctgccatagcgttgcgcggggctgtttgtcgctgccgttgaccaggccggtttgcggctgggtattgttctcgacgtaccgccaggcgatctgcgcccacgagcgctcctgcggcgtcaggctgctgatgcgggcagtggtgtgccagccgcctttggtcagccagcgccaccccgcgccttcgcgataaaacagcgccagggcgataagaaaaaggacgacggcgatggccagccagcgggctatggttttaagcattgcgcggtcaccggcggaagtttaacgggctcgtcagccttgcaggcggcacactggcaggcctggcaggcgggtttggtgcgctgcgtggtcccggtctgctcgcaccatgttttgacggcgggggtgttgctcaggaacgggcgattgcgcgggcctttattgggttcaaagagatccaccagcttcttgtcccacagcgacggggcgaaatcgcggtttttcgggttgtcgctggaaaactgcagcagttttccctcctttttaaatagcagtgcttccagcatgatgccgttgttgttggcggtaaactcattgattggcccgtcgccgttctcatacaacccctcgtaatagccttttcccgcttcgttcgcgttttcaatggcgtccagcagacgatcggtatagggcgagttccacagcacccacatccccatcgccgctttgagcgacacggcggcgctattcggtacgaactggcctttgtcggttatggtgttccagttaaacccgtcgctgaacacggtgtcatagacaaagtacggggatttatcgagctgatgctcggagcgggcggtgaggatcccggtgatggcgtagcgattctcctgggcctggtagacccggtcagcgaagtttttcatccagggatgggagtactcgcgcgggctgttgttccggtcaccagggttatcaaagccaaactccatgccatacagcacgtaggattcactgaccacatagttatgctggctggtttgccgtgggtcgcgcgaatcataggggaccagcacgcagtaaatctccgccagctcgtagggctgcggccggctggcctgacaggtgttaaatccccacagctgaaagcccgccgcgccgtactcctcgtatcccagacggccttcctgaacgtatttgggctggccgttttccagatacgccccgtacagcgtgccgcagggatcgacaacatggctgaagtcccaccccagcaccacgttatcgatgctgttgctgtattccggatagcgctccttgatcaccttcagccagatcagcattctgccgatatccagcgccgaaaagccgatttcacccggcttgttctggtagttaaccttttgtccgcttatcgtgttataggctttgttgggtagttcgttacggaataaatcgagcttattcaacgtggcgagaaacttcagcatccgacggtcgaactccgccttatcaataatccccaactcacgggctgcggtcatcgcggccagataggaggcgctgtcccacatggtggtggaggggtatttgtttaccgcattcaccagcccggtggtgggctgaaagttggcgacgaagtattgccaggcgtttctggcgatagtcatctctctcggcgtcagctccccgctgcgcggggcgtattccgcagccggcagaccggtcgcggcctgcgcgccggagagcgagagccacagcgccatgagtccggccagcaggggaaaacgggaaaaataggtcagcttcatggcgttgctcctgctgaggacgagggtagaggggcagggctcaggcaggccagacacagcatctgcccccgggaaatgtaggccaggctttccagcacgatcgcgttggtatcgccgtcaataacgtcgttgacgctgcggttgagatttaaccctcgctgccagcccttgcccgggacctgcagcgtctgcacctgctggcgcagcgcctcgctccagctattacggaacagagcgtaccaggcaaaggcggtgcgggtggaggtgatcgccgtttgctccggggcggcgctgcgtggggcgaaggcgctctgcggctgccggtccgccagcgcgctggcataatccggcgcgggctcggcgtagtcagtgctgatcggcggcttgctgaccctcaggctatgacggcgctgctggatttgcatgatgcgccaggcgatctccgcactctgcgcgtcaaagcccagctcaaggccggtgagcaggtacggcaggctgatcagtgaaggctgccgcccccagggcgtgcgcagcccctcgtcgggcaccatgatgccgtcgatatcgatcatctgctgcccctgcggcgggttggtcaccgccagccccgccgcgctgtcgatcaaccgcagcgtatggctggcgtacagccggtagccaaagctgtcccgcggttcatccgccgccagcgcccagtggtgcagcggcgccgcggcctggctggcggggctgttgctgatgagcgcgccgacccgccactgattaaacagatcccgcaccgcggcggcgtgctgaggatagcgccagagcagggtttgcagggcggtgagcaggcgtcccataccgatggcggaggagtccgggttgccgaggatctgcagcgtgtcggcatggtactgagcggcgggcaatccctgggcgttgaggggcagttgaccgagggtaaacagggcggcggcaatgcgctcatcaccttcggcggcggtcacaatatgcagctgctctgcggcgaccacggcgaaaagatagctgccgacgctccacaggctgagccagggttcgccatcgtgcgcgttggccaggccgtttggctgggtattgttgacataatactgccaggccacccgcgcccagatcgcctcgtcaaaggtcagctcgcgcgggggagggagcggcggaaaatcctggctcaacgtcatcccgccgctgctctcgacgcgcgcgggcatttgtttttccacccacacgacaatcgcaaaacccagcaggaagccaatgaggatagtgagatagctgcgcgcggatagcagggcgtcgcggatcctcatcggctcgcctcctgctcttcggggggcgtccacatggcggcgaagatcagtggcagcatggcggcaatattcaccgcgccccagaaaatgttgatgacgtacccggaggggtcgtcaacctgaccgcgcgccacctgaataccgccccatatcagccccgtcagggtgagcaaaacgatggcaatttgcggcttgacgagatagagaaaacggcccgtctgtcgctctttcggcgtaacgtgaaatttgatctgctccccgcgcaaaacggtgtccagcgcccgcagattcatcgagaaaaaggagaggtaagaggcccggccgtcccaggcagaaatgccccaggtgccgaacataaaggccagttcggagacaataaaaaagggtaaaaagtgcagatagaaaggggtagaccacgccgacaccggcggaatgccggtgaagagatagataacaggcgagatcaggaatacggtgttccacacgcaggccagatacgaccagaaggtggtcgcgtacatcagcgtttgcggcagcgagagtttaaagcggcgtcggttgaagatgttgtcatggaacaggatatccagcgatccggcggcgtacttaaagcgctggatcatccacgtcagcatatcctgcggagagagcattttcgactcaatccgcgggtgcattaccgagcgccagcggcgggcagcgtcgccgtgcagcaggatggaggtataaatatcttccgagacgtggaacttatagggcgtcagttcagtatcgaaggcaacgtgggggcgcatggcgtcctgcagcgcttcccgcgttgccgggtcacgaatatcccgcgtatgacgcgcgatttcggcgtcaacgctccagacgtagctgcgcagcgccgcctgcatcaccgcttcccgtcggtgaacggaggcggcgccacagcagaacgcggcgttagcccagttgcggcgccgtaaaatcacgtcgtaaaacatgcgcggatcgttgaaaaaaggatcgcgaccaatggtcaccggaccgacgattttctgcgccagccagcccacgccatagcctgcaccgcctgctttacgccgcagccagctcgccagatcctctccttccgggagatcgaaaaaccattgtggggtctgcacccaggcgacgtccggatcgcgaaaatagccgagcgtgtggctcagcagggtcgggaaaacgcgggtatcggcatcacagatgatcagaaagtcgccatcggtatgttccagcccgttgcgcaggttaccggccttgtagccgatattgctctgacgggtgatatagttcgccccctcctgctcgcagaccgccttcatctccgggcgacgcccgtcgtcaaggacatgcactttataatcgagcggaccaggataggtcatctgcatggcgtcacggatcgacagcctgaccagctccacgtcttcggaataggtggcgataaacagatcgactttaatcggcctcgactccaccgtttcatccgcgcgcagacagtcgttgatctccgtcggggggacccctggcggaggatctttttcctgccataaattaatggtgaacagaactgtgccaatccacgccagggtttccgccagcaccagagggatcgcataccacagggcgtcagtgtttaaggacgcggtccagcgccagtaaatataattggcaccaagcaccagggcggccacagctaatacctgccaaatcattctcacccagcgcggggtgctgagcggttcaggcggtcggcgatgttcaaaacgggaaaaataaaaatccatagcaaggatatcctgattccgcgctgggtttgaatgacaggtctgttatcgattgggggcgttctgcagaacgcacaggggcttataaataacagtaaagtgagtgtagatggtggcgcaaaaatttcaacagcgcgaaatgatagtcaccgggatgacttaacatagtgtgatacacgccggcggaatttataaaacgaacattgcaagatagcccattctacactatctaaataatttgtaataaatgttgcagggtagacggcaggatccctaatgagccaggttgcttcagcgatttcgcaaaaagaaactcataaatcaatgccctggcgttactctctgaccggggatcgcgacctgcgtatcgactttatgcgcggtattgctcttgtgatgatggtggtggcgcataccgaagtgatgtcgatatttaatattttcagctgggaacgatttggtttgaccaccggtgccgagggctttgtgatcctgtccggcttcatgttagggatgctaaatcgtgtcagattacaaaaggcagtattactgacggtgagctgggggctttatcttcgcgcatggaaaatatatcaggttaatattattattattgtctcttttcttttgctgagatatttgccttatcttaatgtctatgaagtcactcattttaccgaccgcttttccgggaccagttggtcgctctatccgctaaccccgcaaataaaagagacgtggtttaacattatcctctatctgcagattggcccgcatcagacgcagatcctcggactctatatttttttgttattgctcagcccgctgtttctgggaatgctgcaaaagggtcacgtctaccccttactgggcgcctcgctgctgatatacggctgctggcaacgctggccgatacgggtcacgccctgcgaatttgaattcgcctttcccctgctggcctggcaatttatctttgtgctgggcatgtgctgcggctggtacaaagcggaactgatctctttcgcccgcacgccgcccggcaaagtcgccgtggcggcgctggtgttcatcgcgcttatccttgcgtttgtcgcccagaaccataccaatccttttatgccgcccgcgctgctgttgcacgtaatcccgccggcggattttaacgccttttaccatacctgggcggcgaaaaacggcctcggtccggtacggatcctcaatgatatcagtctgatggtcaccatttatctgctattgacctggtgctggcgcccccttaaccggctggcaggctggttcctgatcccgctcgggcagcgttcgctctacacctttattttgcatgtttacatcgtgctcgccgtaagccagctggttaccttcgatctgtggcgccaggcgtggatagagaacaccttgattcatgccgccgcgctgggcgtactgtggctgatggccaaataccgcgtcgccgcacgctggatacctaactaaggaagggcaaatgcgggagaaatatatgctggcctgcgcgctatggtgcgccatcgcaggtgcggaaggcgcagagaagaacgacgcacaaccgctgcgtgataaaaatggtgaaccggtgcaggccggcgtgtttaccagccgctggggacggcttttttccgggaatgacaaggtgttttcgggagcgctgagctttagttcgggtttaaaagagcagtggatgaccgtccccaacagctcagacagcgcagaacagaagaaaaaatataatcagacgctgaatcttagcctgcaatactcgccctacagcttctggttcgccaacgtgacatcccgtttaccggtgactgacaccagccgctataccgccgattttcgctatagttttggctacgacgactggcatgccaacaccttcagcctggtttacagtaactatggcgataaccacttctggacctcgggcagcaagcgtcacacctattttgagcagggggcgattaccctggcgtataaattttcgctgccgaagcccatggagcatgcgctgttgattaacaaaggcgacgccattatctgccaggcaggctacagctgggtgccgcgttattacgatctggagagtaacgatatccgcaaaaacaaaaatgtgctgcttggggggtgtggatatacctttaaacaacatttttttgtgcgcgccaccgcgttctggtatccggacagtagtcagcagcagccgtggaatggcgattatagttacagttttggctacgcgggctatacgccgggatcgttctctgtgcagtatgccaactatgccggtacccgctacccggggcatgacagcggcagcggcaagtttcgtgaaggcacgatcagccttacctggttcttgccgatttaggaggcgcgatgtcggcacagcacgtcctgattgttgaagattcgctggtttatcgtcggctgctaagccgaatgttgacgcagtggggttatatcgttagtgaggcggaaaacggtgtcgacgcgctggcgatcctcgaaaaccagcctgtcagcctggtgataagcgactgggagatgccggagatgaatggcctgacgctatgccgggaaattcgccgtcgccagtttggtcgctatgtttatctgatattgctcaccgcccgcgaagaccctggcgatttaacgcaggggtttgaggcaggggccgatgattttctcagcaaaccggtagagcagagcgagctgcgggcgcggttgcacgccggggcgcggatcctctccctcgaggctgacctcgccgcgcgcaatgcgcggctgagcgaagcgctgcgacagattgaacaggatctggagctggcggcgcgcattcaacagtcggttctcccggctcatcagctgcgccatcagggatttttctccgactggattttcctgccctcggcctgggtgtcgggggatatttttaacgtcttcccgctgggcgatcgtctcggattttactgcgtggatgtctccggacacggcgtgggggcggcgatgatgtcgctcgccgtcgcccgccagtttttgcatggcagggccgttgagcgctttctttttacggcagacaaccagccggcgtcgccggccgaggtggtggcgatcctcaatggtcgtttttgcagtgacgaaacagagatcgtcagctatttcacgttgatctatggcgtgatcgacctgcagaccggtgcgggcaaactctgtcaggccgggcatcccacgccttttatcgttagcccggacgctaccgtccgcccggtcggcagcggcggggcgccggtggggttgatagaccatctctcgtgggcagatgtcagtttttcgctggcgccgggagagcggctgtgcctgttcagcgacggtatcaccgaatgtgaaaaccggagcggtgaacagtttggcgaggcgcgcttgcaagcgtggctgcaggacagcgtgacgcagccgctgcccgcgctgctgccgcgttttgcccggcacctgatccgctggcgcagtggcgacgcgcaggagacccaggcgatggccgatgatgtttcactcttgattattgaacgtacaggggacagtgatgaaaattgaaactgaacggcaggcctcggtgacgatcctgacgccggcggtgcgtcggctggatgcttccgtcgcggtagcctttaaggcggcaatcgcccaggagataggcgaagatagcaccgatctgattgttgatttcagtaaaatcgattttatcgacagcagcggtttgggaacgctggtttccctgatgaaaatgatgaacggtaaaggagaaatgacactgtgcgcgctgaaccccggcattcgcaatatgtttaccctgaccaggatggatcgtatttttcgtatttgcgaggatcgcacttcagcccttgcgcagttcaatccgtgacgcgcccgtgaataacgtcatgaattttcctgcccaactcagctcgctatcaacgctggcggcgtggctggctcaacaaatggcgccgctgcccgtcggggaggagtggcgcttcgcgctcgatcttgccgtctgtgagacggctaccaatatcattcgctatgcgttgcatgaggatcggcaacgtgtttttcgtgtcgaatttatcgcaacggaagaccgggtgacgctgcgctttattgatgcgggagaggtctttccggccgagcgcctggcgctggcgcgtggcgatgagcgcttcgatgtcgatccgttagcggaaagcggcagaggtttgcggcttattctgcgcgcggtggactattttaatgtggaaacccgcgccggggagaatgtgacgaccctgataaaagcgttgccggatgccgttcttcgccattccaccgacgatcgcgtcaggtgaaggaacagagcttgcccccaggtgaatccccgggggaattttcccgcccgcgttcaccctcttcatccgtcttatggctgggcctgagcggtggacagcgcgcccaggtgataagggcgaagagtatctaacgtcatcatggccgatttgcagaaaatgcatttcgcaccaaagggatttttttccgtcacgtcaaactgggacgttctgtactgggagccatggcagcatgggcatctaaaatggatatgttcaatcataatgtaaaccttgtatgggtaatgttctgttgaaaagacaatggtcgttttcagggaaattaacgcggctgatttttgttaggagtaagccgggtattgggtcagtcggagggcttgtttaacgagccaacagggggctgacagggcctgtttacagaaaaagcaaaatactaacgggactgctcaaaggaaggtggtatcagggataacgcctggagatgagaacacgtacttagataataacttttcgtctggtaaatcgacttaacgattaacgcacgagccgcaaataatagcaaacattattttagccttccggatgcctgctgcgccaggggcgccttcatcagcaccgtcacccagtcgataaatacctgtacccgggcagagagctgccggctgctggggtagagcagggagagcggcagcggcgcagggcgaaaatcagccagcacctccgttaatactccggatgccagatcggcctcaaggcgggataagggtgcctgatacaggccaaagccaagccttgacgcttcggcgccgacgtcggcatcggaggtcagcagccgacagggcaaactgacctcggtctggcgaccatccagggtaaaagtcagcggcaaggtacggtgcgtgcgcgctgaaacaaaaccgatcgccacgtgtcccgccagcccgtcaatcgtatgcggggtgccgtaccgggcgaggtaggccgggctggcgcaggtgatctcctgtagcctggcgagcggccggcaaatcatctcgctatcgggaagatggccgccgcgaatgacgcaatccaccccttcgcggaccagatcgacgtcgcgctcgctttcgcctatctgtaacgtaatggccggatagcgggcgagaaactgcggcagcgcgggcagcagcagggttcgcgccagattgcccgccacgtccacccggatggtgccggagatgctccccccggcgctgcggttggcctcctccagggccgccaggatggacacgcagcgctgataatacagcgagccctccgccgtcggctgcacgtgccgggtggtgcgctgcagcaggcgcgccccaaggctagcctccagcgccttaatggctgcagtcgccaccggccgggaaaaacccagatccgcggcggcggcgctgaacgaaccccgttcgacgatgcgcacgaacagggtcagggtatccagtttatccatggcattgttcctgctggcaaaacaatcctgtcgcgccatgcggtcttatcgtcggcattcagaggcctataatcgctcatgttttcagcagagataaaagggggaaacatgaacaatagcgcaaaaatcgccctggtgacaggcggcagccgcggcctggggcgcgcaaccgttgaagcgctggctcagcgcggcgtgaacgtggtattgacctacaacgcgcattttgccgaggcgaacgatgtggtcgcgcgggttgaagctcagggctcgcgggcgatcgcgctgcccttcagcgccggcgaaaccgacacctttgacgggtttgtcagcgcctttcaggaggcgctgacggagctgggggccgatcggtttcattacctggttaataatgccggcaatgccagcggcatggggtttctgaatgctaccgaatcggagttcgatgcgctttatcgcatccatgtgaagggggtttttttcctcagccaaaaattattgccgctgctggcggatggcgggcgaattgtgaatatctcgtccggactgacccgtatcgtgatggcgaaccgggcgccctatgcgatcatgaaatccgcggtggaaaccctgacccgttatatggcgtttgagctgggcggccgcgggatcacggtgaactgcgtagcgccgggcgccatcgccacggatttcagcggcggggtggtgcgggataacccgcaggtcgctcaggcggtagcgaacatgacggcgctgggccgacctggcctgccagaggatatcgggccgatgatcgcctcgctgttatccgatgatcatcgctgggtgaatgcccagcgcattgaggtttccgggggaatgcgcatctgagcgaagaaaaccggggctgttttcatccgtagtcaatcgatatgtcagtggatgccgatatagcgcgacgctgtggagagataaggaaattatgatctgccgcgttgctcgttaaatattagtgattgaccttattgcctgaatgcgcaagattattgttgaataaacagtcaatatgctaaatatatttaatgcacgtatgaaaggatttaagatatggattttgaaaatgaactgaccagtaagatccttgatcccattcacggcactattcgtttgacgacactcgagattgcctttatcaatcaccccctgttccagcgcttacgcaacattaaacagaactcttttttatataaggtgtttccctctgcggtgcacagccgcttcgaacactctctcggggtgctgcatttatcaagtgaaatactcaataatttacgcctgaatgcgatacggtatcaaaagaaatatgatgatggccatgtgtttggtcatatcgatcagataccaaaacacaacattcaggagttgagactcgctgccctgatgcatgacatcgggcacgggccggtatcccaccagtttgagagttttatgcctggtaagcacgaattctccgatgttctccccacagcctaccattcaatcattgatgtattaagcaagccagaacagaaagttgaacatgaacagctttcgctgttgttcagcctgatgatttaccatgatctgagaaaacaaggtaaggtcgatgacgaaataaatatcgaaaatgtgttaaaaatcatcgaaaaaagatacggtgaccaacagatcattgaggaaattaatggaaaggcaacagatatcctgccgttaatgacctcgatcatctcttcctgtccgatcgatgccgaccggatggattacttgctcagagatggctatttctccggcgtcaagtgtggcatctacgattacaatcgcttgtttatgtcaattgtcccggtcgaggaacagggaaaattgtaccttgcttacaaagagagtgggattgattcgatcgctgagtttattggggcgcgctccagccttttctcgcaggtgtattaccataaaacaaaccgcgcctttgcgacgatgttgagcacattatgtgagattatgcaaagcaaggatccacaaaatgtcattatcgctgacgttaccgaccgtatcgttgaccatagcgatgaaagcttcatcgatgcgctgaaggatttttatttggcgtgcagtgatgattattttttgaatgacaaggttggtgaatggatagatatcagcgataccgaggcggttaataaaaaaatacttgatgacattattaaccgacacccatggtcgaaggtctatgaggccaaacactctgtgtataaagctaacatcgctgacaaggaaaataaggcgtggaagagtcaactcaccgggttattgacttctgtattacagcctcatttcaaaccacatgaatttgccgttgatattgtctccgactgcgcctttaaagacctggataaaaccgaagttaagcttttggtgaaagatcttaagaaccgctacgaaataaaaccgttaattgaatgtggtgataagttaaatcagtatcaaatcatcaaatattgcattcgggtatttgttgaccgcgatatcaaagaacgcgtaactcctgaaataatctataaaatcaatgaaatagtggtcaagcagatcgcgttgctgaattgatgatgcccgtcagggcagcgataaatctttcaggggctggttttttaaccggcccctgaagataagcggtaaatcgtggcgcatccccgccatcggtataacttacaacagcgcctttacccgagactaaacaccgcgctgaggcatagattcccgcaggggagcgggtggctcaacaaaaacgccggctcagtatggttattccgccagcagggcggcgaatttcgccagccactgtggatgagccggccaggcgggggcggtaaccaggttaccgtccacatgcgcctggtcgataccaatatccgcatagtgcccgccgctcaaacgcacttccggggcgcaggcgggataggcgctgcaggtgcggccctgcagaataccggcggcggccagcagctgcgggccgtggcagacggcggcgataggtttacgcgcggcgtcgaatgcctgtaccagtttaataacctcctcgtacaggcgcagatactccggcgcccggccgccggggatcactagcgcatcgtagttctcggcctttactgcggcgaagtcagcgttcagcgtgaagcgatggcccggcttttcgctataagtctgggcgccgtcaaagtcatggattgcggtcatgacatagtcgccagcggttttatccgggcagacggcatcgacctggtggccaatcatctgcagcgcctgaaaaggaaccattgtttcgtaatcttcggcataatcgccgaccagcattaggattttcttgctcatctttgtgtctcgttgtgggcgaaaggtgtcttagatatagcctggcgacttgcagaatgcgaaccgttcaggatgccgacgacggtgtcgtgtgcgtcttgtaaccgggttcatgtttttttgctaacgacaactttgtccgacatcgcgctgtggctcgttatccgcaaaaaatcggtttgtggggagtaaggggagcagaagaatattgttaccgtttagatttcgcgcctgcactattaagcgtccgccgcgaacgggcaatcggatggaagccagatattatccctctgagtaatttattgcgttgttacgctaaatttgcataatgagcgaattatattgccccgggcgtctctatggtttcctttattcatccgcttaatgttttagcccgtcttatagtatcctttgcaaacattcctttggtgcattatttattgaatttatcattgacggctgtttcatattttaaatattgatattcatggtgcttttattttcgtggtgaaaggggatgtttatgaataaatataattattaggtggttaagttgatcgctaatccatttttgctttatcatcgtcacgtttcacatcaatatatcttcaataattattccttaaggaaaggaactgctatggctgatacgttccagaatgaagtccccagggcgcgcattaatctcaaattatctcttcataccggcggcgcgcaaaagaaggtcgaactgccgctcaaactgcttaccattggcgattttagtcatggtaaggaaaaccggcctttatcggaaagagaaaaaatcaacgtcaataaaaataactttaacagcgtactttcggaatttagcccggaagttaacctctcggtgccgaatacgctgaccggcaatggcgaagaggagaacgtcagactgcgttttaccgacatcaaagattttgaaccggagcaggttgcccggcaaattccgcaactccgcgccatgctggcgatgcgtaatttattacgcgatctcaaatccaatctgctcgataacgccactttcagaaaagagcttgaggcaatcctgaaagatccggcgctgtcccaggaattacgcgacgaaatgagtgcgcttgccccgaaataagtgcggggcaagtctgttaatggattaaccgggaaaatgctaatgtctgttaccacagaaaacgcccctgttcaggggcaaaccacgctgcaggaaaacagcgcgggcgagggcgtttacgcctcgctgtttgaaaaaattaatctcaccccggcgtctcgcctcggggatatcaacgactttctggacgatgccgcgctctccgaggcgccggcggcggaacgtctcaccgcggcgatgcaggtgtttatggaacgcatccgtcagtccggccagcgggtggaaaagctcgacaaaacgctgatcgaccaccatatcgccgagctggatttccagataagccgtcagctggacgcggtgatgcaccatcaggagtttcagcaggtcgaatccctgtggcgcggcctcaaacagctggtggacaacaccgactatcggcagaacgtcaaaacggagatcctcgacgtcgccaaagacgatctgcgccaggactttgaggacgcgccggagcttatccagagcggcctctactggcacacctataccgcggagtatgacactcccggcggcgagccgatcggctcggtgatctcggcctatgagttcgacgccagcccgcaggatgtggcgctgctgcgcaatatctcccgcgtctctgcggccgcccatatgccgtttatcggcgccgtcggcccggccttcctcctgaaagagaccatggaagaggtggctgccattaaggatatcggcaactacttcgatcgtgcggaatatatccgctggaaggcgtttcgcgaaactgacgatgcccgctacatcggcctggtgatgccgcgcgtgctgggtcgtctgccgtacggtccggacaccgtgccggtgcgcagcttcaactatgtcgagcaggtgaaaggtccggaccacgaaaagtatctctggaccagcgcggcgttctccttcgcatccaatatggtgaagagctttgtcaataacggctggtgcgtgcaaattcgcggtccgcaggcgggcggcgcggtgaaagatttgcctatccatctgtacgatctgggcaccggcaaccaggtgaagatcccttccgaggtgatgatcccggaaacgcgggagtttgagttcgccagcctgggctttatcccgctgtcgtactacaaaaatcgcgattacgcctgcttcttctcggccaactccgcgcagaaaccggtgctgtacgataccgccgacgccaccgccaacagccgtatcaacgcgcgtctgccttacatcttcctgctgtcgcgcatcgcgcactacctgaagatgatccagcgcgaaaatatcggcaccaccaaggaccggcgtctgctggagctggagctgaacacctgggtgcggagcctggtgaccgaaatgaccgaccccggcgacgagctgcaggcctcccatccgctgcgcgatgccagcgtggtggtggaagatatcgaggataacccgggcttcttccgcgtgaagctgtacgcggtgccgcacttccaggtcgaggggatggacgtcaatctgtcgctggttagccagatgccaaaggcgaaggcgtaggttcggacgatgatgaaaacggaacgtccgttgtggggccggggcattatggtgtcgcctcagcattttcaacagcaggctgcgtatgcagcctggactgcggaagtgattgcccggatgggtcttaaccacccctggggagtggttgaggcgaccttcgaaccagagatgctcaaactgggccgcctgcaggctcacaggctgcaggtccggttccaggatggcacgatgattgatacggacaatgccgatgcgctgccgtccgcgctgtcgctggacggcgcgtccggcgaggcggtgatcgtgctggcgctgcccctgatgcaggcgaatggcggcaactgtctgaagccggaggaggtggccgaaaggccggtgcgcttccgccagcgctggcgcgatgtccgcaaccagtttggggatgatacccggcagattgccgtcatacagccggagctgatcctccgcttcgcccaccaggacaacagcgattacctgacctgtccgcttgttcgcctgcagcgggactcgcagggggcctggcttatcgacgagacgtttctcccgccgctgctgcagatccagggcagccgctggctggcgacgcagcttgaacagctgctcgtccagctccgggctcgtctgacgcgcctgatggccatgcgtcgcgaaagcaatgaacggatggctgattttgccgtggctgatgtctctctgttctggttgctgaatgcgctgaacagcgccgagccggtgctggggtactttctgcgttaccggcaaagcccgccggaacgcctctacccggagctggcgcgcctggctggtagcctgctgaccttttcgctcacccatcaggcgaatgccgtcccgatctatcagcatgaccagctgaacgcggtttttccgccgctgtttgatttactgggcgacctgctggaggcgagcctgccatcgcgggtggtggcgattgcgctggagcatgatgtccggctgcacttctggcaggcgcgtctgcacgatgcccggctgcgggaaggggctgattactacctgtcggttcgttcgtcggtaccggtcgcccaactgcaggagcagtttccgcgccagtgcaaagtgggcagtccggatcatgtcaaagccatcgtcaactcctcgcggacaggggtgcccctcacgccattgcgtcatgtgccggcggcgatcccgctgcgtctggaaaatcagtatttcagcctcgatgtgtcccaccctctggcaacggaaatgctgcagagcggcacctgtatgttttacgtcccggggatgctcggtgagcctgaacttgaactttttgcggtactacgaacgtgaatgagcctaaacgcggcaacgccgcgtccattgatattgatgcgctgctgcagaacacctggctgcaggttatcagcctgcgccacggcccgcagttccgcgatgaggaagggtacacgctatggcagcgctgtattgctgatgtcgagcgcgtgcaacatgagctgaaggtgagcgggcttgatgacgccagctgtcagcatattctcaccgcccagtgcgcgctgctcgatgaagcagtgaaaggtcgcggcgtggaggatgaggcctgcctgcagtggtatgacattccgctgcaggggcacttcctcggcaccatggacgccggcgacaccctgtgcgagcggatgcgtgatgtgttgcgtgaaccggcgcccaacctggccgtggtcacctgttttcagcgggtgatgctgctgggttttattggcagctttcgctccctccacgaccccgagcgcctgaagctggtcaacgcgctcggtgagcgtgttcctccttttcagtgcccggctaccgctcccgtactggtagagagtcgcgccggtctggggataagcggctggctggccccatggccggtacgtattggcctgagcgtggtggtggtactcgccctgtggtggggactcaaccactggctcgatcacctgctgctgaccttgttaccgggggaggtgaaatgagccccgcgcagcagcgtgggctggcgctgtgggccagtctgctgagtgcgctggtgtgcctgctatttttgccggttccccgctggggggcgtggctcattctgctggtcacgctggccctgatcatcgggatctggcgcatcgccagtcgtcgtaccggacgtaacgtcgcatcaaccctggcccctctcccggagggcgcttatcgccagccggtggtcctcgtttgcggcgacctgccgtgtgtctggccgccagcgtcaccggtgcgagtcgtcaaacagggctgctggatccgcgtggaaaagacggaggagctgcagcaggtcgcgcgccaggtattgagccagcggccggaatgggggcctcagctgtcggtgctgctctgcgtctgcccgcagcggcatgcgcaaagcgatgcgctgaccagcgctctgctggccctgcgctggcaactcagccagctgcgtcagcagacggggtatgccgtaccgctggcgctgcaggggcaggtgggcagcgcgatgagtcgcgacctgttgtggcaggcggcgataccgggtgaagcggtgaaagtctggcagccctcctgcgccccctgttccgtaccggcctgggtaagcgccggtggggcggccgcgctggagcagcaggtgctgatgaacagcctgatgggctggtttgaacagcacgtccatgccgtgttgacggaagagaataccgacctgccacctctgccccctgcggccgtgctgtgggggctcgggccctcgctgcctggaaggctggcatcgtcggcctggacgacgtggttatcccgacatagcggcctgtcgcgggtagctggctggcagcctggcgagagcgacaccggggacgcttcagctttgccggaattcatcctgccgcagttaccggcgggacggggactcacgccacgaggctgggcctggcgcgcggcgctcgcgattttcaccctcgcggctgtcgccgcgctgctcagcagtggctggaacaatcgacaactgctgcagcgcgtgggcgtcgatattgcccgttatgagcggattgcgatggatgattatcgaccaaaagccagcgctgtcagggtgctgcgtgaagatgccgcgctgctcgatagctgggcgcgtaacggcgtcccgctgcgcctgagtctgggcttgtatcacggggagcagattcgcctgccgttgctggaggcgattcgcggttacgtgccgcctccgcctccgcccaggccggtgcagcacgtcgcgccggatgtcatccgccttgacagcatgtcgctattcgataccgggaaatgggtactgaagcctggttcgacaaagcggctggtcagctcgctgatggacattaaggccaggcccgggtggctgatcgtggtggcgggccacaccgacagcgtgggtgaggaaaaagccaaccagctattgtcgctgaaacgtgcggaatcggtccgcgactggatgcgcgataccggcgacgtgccggacagctgctttgccgtacagggctatggcgaaagccgaccaattgcaacaaacgatacgccggaaggccgtgcgctgaaccgtcgtgtcgaaatcagtctggtgccgcaggtagacgcctgccggttaccggaccaaccctctgcgtcatcccaggatgatggcgcttcactacacaatggagagtaattccatggcaattcctgtttatctttggctgaaagacgacggcggcgcggacattaaagggtctgtcgacgttcaggatcgtgaaggcagtatcgaagtggtggctcaggagcataacctgtacatcccgaccgataacaacactggcaaactgaccggcacgcgtattcatacgccgttcctgttcaccaaggagatcgactcctccagcccctacctgtacaaggcagtgaccactggccagaccctgaaatccgctgagttcaagtggtaccgaatcaacgatgccggccaggaagtggagtatttcaataccaaacttgagaacgtcaaggtggtgaaagtgaatcccctgatgcacgacatcaaaaaccccgcctacgagaagcacaaccatctggaacagattgagctgcgctacgagaagatcacctggacctataaagacggcaacatcattcactccgatagctggaacgaacgcgccaccgcgtaattgcccgtcatagttcgcgccgctggcgcgcaggcgacgttcgctcatcccggccgcatcgttatctttgcggccggggattattgcgggcgatcgcctgatgcgggcagcgtttctctgcccgccgttttttgctgagcgcctgagatacgggttctcagcaaagaaaaacacaatctgtctgcctgaccttgtgcgcttggggttcctgttcgggaacagcgacgggcggtagcgtgtccggaaccaataagagaggatctcatggaaaatccagccagcctgttacgccgtcttaatccctgctgtgcccgcgcaatggagggggcggcctccctgtgccagacccgggcgcatgccgagatcctgcccgagcactggctgcttaagctgctggaacagggggaaggcgatctgacggtgctggcgcggcgctatgaatgggatatggatgcgctgtggcaggatctgctgaactggctggataaacagccgcgctcggtacgtcatcgtccccagctctctgaccataccctgaggctgatgcaggaggcctggctgattgcctcgctcagcggcgaagcgcagatccgcagtgttcacctgctgatggcgctggttgaaaaacagaatctgatccagtgcgatggcctgtggccgctgttaacgctgggccagcgtcagctggaacgcctgcgccccttgcttgatgcccagtccgacgaacgtccaccagcgcagcaggaagcggcgctggcgcagccccatggcggggacgtggaatttgtggggcgtcctgcgggcaacgaactgaatgcggatgggctcaatccggcgctgcagaacgcgctggacaaattcactctcgacgtcaccgccaaagccagagacggccagattgacccggtgttcggacgcgacacggaaatccgccagatggtggatattctctcccgtcggcgaaaaaacaacccaatcctcgtcggtgagccgggcgtgggcaagaccgctctggtggaaggcctggcgctgcgcattgccgaaggcaacgtccccgacgcgctgaagccagtgtcggtgcgcacccttgacctcggtctgctgcaggccggcgccggggtcaaaggcgagttcgagcagcggctgaaaaatatcattgaggcggtacagcagtcgccttcgccggtgctgctgtttatcgacgaggcgcacacgatcatcggcgcgggtaatcaggcgggcggcgcggatgccgccaacctgttgaagccggcgctggcccggggcgaactgcggactatcgccgccaccacctggagtgaatacaagcagtacttcgagcgcgacgccgcgctggagcgccgctttcagatggtcaaggtggatgagccggacgacgacaccgcctgcctgatgctgcgcggcctgaagtcccgctatgccgaccaccacggcgtgcatatcacggatgatgcggtgcgcgccgtcgtgacgctgtcacgacgctatctcaccggtcgccagctgccggacaaggcagtggatttactcgacaccgcttccgcccgcctgcgtatgagtttggataccgtgcctgagccgctgacccgcatgaaggcgcagctcaccgcgctggcaatggagaagcaggcgctgctggaagatattgcgctgggcaacagcgcccgcggcgatcggctggcggccattgagcaggaggagatccgccttattctggcgctggatacccttgaaactcagtatggtcaggagctgcagctgacggaagcgctgctcgcctgtcgccgcgatatctcccgccaggcggaaattaacgacctgcaaaacgcgcttatcgccgtgcagcagggcaatccgctgctcgggctggacgtcgacgtccgcaccgtggcgacggtgattgccgactggaccggcgtgccgctctcctcgctaatgaaagatgagcagacggaactgctgagcctggaagagagtctcggcaaacgggtggttggccaggaggcggccctgagcgctattgcccggcgcctgcgcgccgcgaaaaccggcctgacgccggagaacggtccgcagggtgtgttcctgctggtcgggccgagcggcaccggcaaaacggaaacggcgctcgccctcgccgatgcgctgttcggcggcgagaaagcgctgatcaccatcaatctctccgagtaccaggagccgcacaccgtcagccagctgaagggttctccgcccggctacgtcggctacggccagggcgggatcctgaccgaggcggtgcgcaaacgcccctacagcgtggtgctgctcgatgaggtggaaaaggcccatcgcgatgtgatgaacctgttctaccaggtcttcgaccggggggtaatgcgcgacggcgaggggcgtgaaatcgactttcgcaacaccgtgatcctgatgaccgccaacctcggaagcgacctcctgatgcagttgctggatgaacagccggaggccagcgaatcagacctgcacgagctgctgcgcccggtgctgcgcggccacttccagccggcgctgctggcccgcttccagacggtgatataccgtccgctgccggcggcagcgctgcgcgccattgtcggcatgaagctcgggcaggtaagtcagcgtctggcttgccattacggaatcaccaccaccctcagcgagagcctgttcgacgcgctgaccgaggcctgcctgctgccggataccggcgcccgtaacgtcgacagtctgctgaatcagcagatcctgccggcgctgagtcagcagctattgagccatatggcggcggggcagaaaccgcgccaggtgacgctggggtatcacgaagaggaaggcgtcgtgatggcgtttgacgaggggacaatatccgatgagtagcgtgaaatcgttgttgttcagccataaccaccacctgctttcggtgaagggatgtgaagccgggcttgatgtgctggccttcgagggcgatgaagccctgagccagccgttccgctaccgtattgaattcaccagcgcagaccatgccatcagcaaagagatgatgctgatgaaggcagcctccctgacgctgcaggcgtcggtggctcagggcttcggcatcaatgttcagcaacccgtgcgggtgatccagggcgtggtgacggggtttgaacggctcagtacctccagggatgaaacgcactacgcgctgacgcttcagccgcgcctggcgctgcttaaccgctcgcaccagaacgccatttaccaggaccagtccgttccgcagattgtggaaaaaatcctccgcgagcgccacggcctgcgcggtcaggattttctgttctcgctgacaaaaacgtatccgcgccgcgagcaggtgatgcagtacggcgaggatgacctgcgctttatcacccgtctgctgggtgaggtggggatctggtttcgctttaccgccgacacgcggctgcacatcgacgtcgctgagttctgcgacagtcagcagggctatgagaaggggctgacgttgccttcggtcccgccgtcagggcagcagtcggccggggtggacgcggtgtgggagatggcatgtcgccaccgcgttgtggagcagcaggtcagtacccgcgactacaactaccgcgaggcgacggcggacatgaacgcgcaggtggatgtcacccgcggggagaccaccacctttggtgaggcttaccactggggagataactacctgaccgcggggaatgtccatgaccgccatccggcgccggagtccggggcgttttacgcccggcttcggcatgagcgttatcttaacggccagacccggatgcaggccaccaccagctgcccgacgctctgcccgggacaggtgctgaaggtcaccggcggagaggaggtggccggggagtttgctgatggcgtgctcatcacggcgatgcacagccacgcccggcgcgatgccgactttgcggtggagtttgccggcataccggacagcccggacgtcggctaccggcctgagcccggcgcgcgtccggtgatggccgggacgctgccggcccgcgtgaccagcacccgggaaaacgacacctacgggcatatcgacaaacacggacgctaccgggtgaatatgttgtttgatcgggcgcgctgggaaaccgggttcgagagcctgtgggtccgtcagtcgcggccgtatgccggagacacctacggcctgcacctgccgctgctggcggggacggaggtggcgattggctttgaggatggtaaccccgaccggccgtatatcgcgggcgtgctgcacgactcggcgcacggcgaccacgtcaccattcgcaatgacaaacgtaacgtcctgcgcaccccggccaacaacaaaatccgcctcgacgatgagcgcgggaaagaacatatcaaggtcagcacggagtacggcggtaagagccagctgaacctcggccatctcgtggatgctgaaaagcagccgcgcggcgaaggctttgagctgagaaccgacagctggggcgctatccgggcacagaaagggatatttatcagcgcggacggacaagtgcaggctcaggggcaggtgctggcgatggagccggcggtcagtttgctgaaaggtgcggtgaatcaggtcacggaatggggaagcattacgcaaacccatcataatgttatcccagacaccggcccattaagcgcactgaccacaggcgccagcgatcttaaacagccgacattgctgatgtcggccccgcaggggattgccgcagtcacgccggaaacaaccctcctgcacagcggtaacgggctgtatctgcagagcctgggagaggtcaacatcaccacggcacagcgctgttctctgaatgccagccaggctatttcactgctggcgcaacaggaggggatgaggctggtctccgccaaaggtccgctgcaagtagagtcgcacggcgatattctatcgctgaccgcgctaaaagatatcaccgtccagtcaacccaggggcatctgcagttgacggctaaaaatggcatcaccctgggttgcggcggcgcatatatccgtcttaccccgcagggagaggtacagatccacggaccgggggtgattagccttaaggggcagcatgatttgcaggggccggtcagcgaggagtttcccttgcctgagctaccggcatcggtgtgtaaagagtgccttaaaaaagcccaggcgctggcgcagggcttcgtgccgcgggaggcatagatgaccagacaatggattgaggaggtcgccggaacctgtcgggctttcggaacggattatctgcatgtcattatcgatcaggcgggggtggatttttccgttattccggcgctgaattcgctgtcagttgagtggcagtcgctttttcatggacttccggaagcatttattgtcgatgatgctccgctggtggcgcgctttacgcttgatgatcttgagcaaatgcgctggttacaggatatcagccagcaacttgccatccaggcgccgctgctcctgttctgcacatattggcccttttcggcgctagcgaactggctcacgcagtgtatggatattctgcaggaagggcgcagcggaattttacgcttttacgatacccgggtatttccgctgttgtttacgcacattctcagtgacgagcagcaagagccattgatgcgtccggccctgttttgggcgtggcaggatcttgacggccaggcgaaaggcatcaagggcagtggtctcccgccggaacgcgatgaaaaggcgccaaaaatagaactcagcgatcgccagcttgagcatctgatgtgtatcagcgatgtcatcgtcatgttgtcgcactgtgctccgcctgcgggcatgtttgactcaagacagtcactgttttcggcctgttaccagggcatggtggaggcgacacgccagggtcttcttctggatgacgctcgtgaagactgggtaatgaagaagtggcttgccgacgtaaaaaccagtgagagaccttcagaatgaaaagcctggtctggctgagtacacccctctcttcattaccctcaaaccgatagggagagtccaatgaaatctgcattaatcagcccgctgctggcggggttgctgctgttaactggctgcgcgcagcctgctgcccgggccggaggcggcggtggcggcaccattgacgccatcaaccacacaaaatgggcgatcaaccacttcagtatcaacggtcagtcgggcatcgacattataggtccgtttcaggggggcggtggcggctgctgcttcagcgtgcccgcccgctggacgccgggtatgacggtgcgcgttgactgggaaagtggagtcgcatttgccagagacattcctgaaattcctgaacctgcttatccgaattataaagggcaggataataaagtctggaccgaagaaatagcagaatataaccaacaaaaaagagtttggtataaaaaaatcaaagcactaaaacgtcagcacagcaaaaccgtcccgctgcccgactataacggccaggatgtgtgcggcattacggtgcactttttaccctgcgatgacgtgaaggtgaccaccagctgttacacctacggcagtccgtcctacccgataaaagagcctgtcaggatgaaggagcccgccgtatgtccgaaataaccgaaacccatgccgcctggatcccgccgccgtttccgccgcagggacgtctgccgaaccgggcgctgcaggttgggcagaactgccatcagcagaacagcgacgagcggcgctatcaccaggaactgtgccgggctgccggacgtcgcgtggagccgccgtgctgcaagacgctgcacatcagcctgtttttcgacggtacgggtaataacctgaacaatgacctgctgctctctgacccgaagcacccgaccaatatcgcgcgtttgtttcgtgccaccattggcgacggcaccgccggcggcgtcactgataccaaaaagatgccactggatggggtaaaagacagtggaggaaaatacttcaagttttatattcccggcgtgggcaccccgttcccggaagtgaatgacccggactattccaccatgggtctggtgggggcagttaagggggaggagcggattaactgggcgctgctgcggattattgatgtgctaatgcgcctgagtaaggacaaggaaaacaatagcataaagctgtccgaaggagccagccgtgaatccctcaaaaaaatgggtaccagctggaaccggctgtggtttggcggcagccataaccgctatgaagagttcactcgtttgctgaatgatttggcctctgatttgaagcccctgattattcagcctgagccgggcaagccgaaactgacaggcatcaagctgtatgtctatggtttttcccgcggcgcggcagcggcgcgcacctttgtgcgctggctgagcgaactgctgccccctccggcggcggaaggtgaaaaaccgccgcagtgcctgcagacaggcgggatgcagctgcccgtcagcgtggagtttctcgggctgctggatacggtggcctccgtcggggtggcgcatgtggtgccggttgccgacgggcatatgtcctgggcagacggcacgatggagctgccggatgatgaaacctatggcgggctgataaaaaaatgtgttcacctggtctccgggcatgagcagcgtctctgctttccgctggactcggtgcgccgggcaaacggcaaatacccgccctgtgccactgaggtggtttacccggggatgcactcggatattggtggaggatatccgccgggggagcaggggaaagcgaatggtgaggatgacagcttattgctatctcagatagttttgcatgatttgtatgcttcagcgtttttggcaggtgctccattaaaaataccaatgatagtaattccagaaggtaaattggtagatgtatggcggataatgccaattgaacttgaagagttatttctcatttcaattgaattgatcaaacgcttcaacgcctggcgtgagcttaccctgggccaaaccacgccgaaaacgttcgatcccgatgcagcctctcactacgaaccacctgccgccggcggcagtctggaaaccgtcattgctgagcagatggcctggatcaccgcctggcgcatcgaccgctatgccagaggctcgatgctgaaaacgccct

SEQ ID NO: 76 - DNA, 73577 bp, Unknown
  source: /note="Description of Unknown: KP2-Mcoc1 Bacteria Sequence"
accgcgcgcgttgccgtggaagcgggtatcgctgactactggttcaaatacgttggcctgaacggcgctatcgttggcatgaccaccttcggtgagtctgcgccggctgagcagctgttcgaggagtacggcttcaccgtcgataacgtggttgctaaagcgaaagcgctgctgtaaatccccaccgctatcgcccggcccgaagtcgggcgatacgctctctgagtaatgatcttccgatcatgagtttgtcttttcctttctgaaccatttcccactctattttgtgcgtgaccgctgatttctgtacgtttttttgtgcagaccggcaaatgtagaccagattcaataggcgcccgcacgatcgcgccgcgcccctcgattccgccggacgtctgtaaaggagaccccgccatgccgtcaccgatgatttatcaggatctcaccactgccgcgctgctcggccatgcagcgcagtatcacagcgagaccgagattgtctcggtgagtactggcggtgagaaggagcgcagctgctggggggaggtggccagccgtgctcagcggctggcatcggcgctggcgtcgctggggctgccgccgggcgcccgctgcgccacgctggcatggaacaaccgccgccatctggagatctattttgccgtcgcctccggcggctgggtgacgcacaccgtcaatccgcggctgtcggttgaccatctgcggtatatcctcaacgacgctgccgatgaagtgctgttttttgaccagacctttttgccgctggtagcgcagctgctgccgcagctgccgacggtgaaacacgtcgtgctgatggagtcccgcagcgaagcggcgctcagccagctgccctcattgctgttttatgacgatctgttgcagcaggggatggcagactatcgctggccgcagctcaatgaactgactccggcttcgctctgctacacctcgggaaccaccggccggccgaaaggggtgttgaatacccatcgttcgctggtcctgcacgccctgagcggcaaccagccggacgccgccggcatatcggcgaaggacagcctgttgccggtggtgccgatgttccatgtcaacgcgtgggggacgccgtttatcgccgccatggtcggcgcgcggctggtgctgccggggccgcacctcgatggcgacagcctgctgcagctgctggccgccgagaaggtgacggtggggtttggcgtgccggtgatctgggccggcttgctggcggcgatgcgccggacagaggtccggctgcctgaatttaaacgtgcgctggtcggcggctccgcgctgccgccgtcgatggccgaggcctttcagcgtgattacggcattgcgctgacccacgcctggggaatgaccgaaacatcgcccatcggcaccatcaacacaccgttgagcaaacatgacgcgctcccggcacaggagcagcaaaagcagcgcgccggtcaggggcggcccattttcggcatcgaactgcaggtggtggacgtggatggcgaaccgttgccccgggatggtcaaagccagggttatctgcaggtcagagggcactgggtggtagagcaatactatggtcaggacgcgagcgccctgaccgcggcaggctggtttgataccggtgatatcggtacgctcgacgccaatggttatctggtgatcagcgatcgggcaaaggatattatcaagtccggtggcgagtggatctccaccgttgagctggagaatatcgccatcgcgcatccgggggtgcgcagcgcggcggccatcgccgcccgccatccgcgctgggacgagcggccggtgctgctgtgcgtccgtgcggaagggggcgaagtggaggagaccgatctgctgagctggtttgagaagcgggtgcctaaatggcagatcccggaccgggtgatatttgtcgatgcgctgccggtcagcgccacgggtaaggtgctcaaaaatcagctgcgccaggcctacggagagattttaatgagtgagggaaaatgagccatgcgcgacccggtctgacgacctgttctcagtatgatgcggccctgcacgccttgtcggcggcgcgccagcgctgggcggaaacctcagtgaaccgtcgtctggcgctcctgcgccagatcaaggatgccctggccggcattgccccggcgtgggtggccgcggcagcggcggccaaagggctgccggcgggcgatccgctggcgggggaagagtggctggcgggcccctgcgcgctaatggtcggctgcaacgggcttatcgccaccctggagcaactggaggagaagacctttctgcggcggatcccactgcggacgctggcggacggccgcctggcgctgcgggtggtgcccggcacgctctgggatcggctgcttctgtctggtgttcgcgctgagatatggatgcagccaggcgtcacccgggcccatctcgaccgctatgcggcgcgggcatacgacatcccgcctgccgcgcggcagggcaagctggcgctggtgcttggcgccggcaatgtggcctcgattgcgccactggatgtgctacacaagctgtttattgagaatcaggtctgcctgctgaagctcaatccggtgaatgattatctgcacgatctgctggcccaggccctggcgccgctgattgccatggatgcgctccgcatcgtcaccggcgacgcccgggcgggggcgtggctgaccacccatcccgctgtcgatgagatccatatcaccggctcccgcgagacccatgacgtcatcgtctggggcgagggtgaggcggctcgccagcgtcgggccgccgggacgccgctgaacccgcgtcgggtgacctcggagctgggcggcgtcagccccaccattatcgtacccgggccgtggagcgaggcggacatcgcttttcaggcgcagcagctggcgacgcagaagatgaacaacggcgggtttaactgcgtggccagccaggtgctgatcctgcagcaaggctgggagcctgcgacggccttgctgaatcagctgtaccgactgatcgccgcgaatacccgcccggactactaccccggcgctgaaaaccggctgacagactttcgcctgcgcgcccgtcagccgctggagatagcccgcggtgacgcgctgccgttgattgtggcgaataccgacgatgatcccgggttctgccagcaggaggtctttggcccggggctgtcggtcacccgtcttgaggccgatagtgcggaaagctttctgcgccaggcgatcggctatgcgaatcagcggctgcagggcacgctaggggccaatattgtgatccacccgcgcacccgcaaagcgattggacgtaagcgttttaatgcgctgatcgccgagctgcgctacggcacggtggcgatcaactgctggagcggggtggccttcctgttagccccttgcccgtggggggcgtttcccggccacacgctcgacgatattcagagcgggcggggcaaggtgcataacagctttatgctggagaaaaccgagcgcacggtgattgaggcgccgtttcggccgtttccgcgtagtctttggcatggcgaactgacgctgatgcccctgccgccctggttcatcacccaccgggggcaggaagcggtggcgcagcggctggtggatttttaccatcggccgcgctggcgcaaattgccggcgctcctctggcgcgcgctgcggggctaaggtgagagcaaaaaaaagggcggaaccgcggttccgccctgcgggattaacggcccgctttcagcttctggtaatactcttcataaatggcgctggcgctgccgacgtcattctgccattcgcctttctcaatggttgcggcgtccggatagagcgatttatcgttggccactgccgggctgagcatcttgcgcgccgcaaggttcggcgtcggataaccgatggtttcagcgacctgtttggcgacatccgggcgcagcaggaagttaatcagcttcagcgcgccgtcgacgtttttggcgttcgccgggatcgacaggctgtccatccagaagatgccgccctctttcggccagatcacttccagcggggtaccggcctggcgggcgacgtaagccgagccgttccataccatcccgaggttcacttcgccttccatatacgggttcgccgggttatcagagttaaacgctgcgacgttgggcatcagctttttcagctcgttataggcggcttcaatctctttcgggtcggtggtgttgccggaatagcccagcttacgcagcgccatctggaacacttcgcgcgcgtcgtcggtcagcagcaggctgcttttgtattccggcttccacaggtcggcccagctggtgatagttttcgggtcaatcgcctcgctgttgacgccgatggccgtcgccccccagatataggggatggagtagtcgttattcggatcgaacggtttattcagcatctgcggatcgaggttgctgaagttagtcagcttgctcttatcgatcttctgcagcatgccttctttgcgcatcttgtcgacaaagtaggtcgacgggacgaccaggtcgtacgcgccgtctttataggttttgagcttggcgtacatggtttcgttcgactcgtaggtcgaatagataaccttgatgccggtctctttggtgaactgctccagcaggcccggcggcacatactcggtccagttatagaaatagagcgttttgctatcgtccgcgtgcgcagcgcccatgccgattgccagagcgctcgccgcgagcaggtggcgtgaccattttttcattttaacgtcccctgagttttatcacgtgcaattaactgactggcgatgaccatcaccagcgacagaaccaacaaaatcgtggccagagcgttcacctctggcgaaacgccaaccttgaccatcgaatagatcttcagtggcaggatttcataccccggaccggtcacgaacgaggagactaccacgtcatccatcgacagggtgaagctcagcaaccacccagcggctaccgccggcagggccagcggcaggataattttgcgcaggatggtcatctcgctggcgcccagatctttcgccgcctccagcatccgcacgtcaaagcctttcaggcgggagtaaacggtgaccaccacaaacggcaggcagaaggtgatatgcgaaaacagcagcgaccagaaaccaagctggacgccgatcagcataaacagcaccagcagagagatggccatcacaatatctggcgacatcatcaccacaaacagcatgccgctgacaaacggtttgccgcgaaagcggtaacggtacagcgccacggcggtcagcgagccgataagggtggcgaaggtcgccgacagcaccgccatggtcagcgagtgctgggcggcctgcagcaggctatcgttgttcatcagcaggctataccagtcggtggtgaacccctgccagttgatgccgaagcgcgaccggttaaacgagttaacgatcagaataataatagggatgtagagatacgtgtagatggcggtcataaagccgccgcgcagcagtcgaccgatcattccagctccacctttttattcagcaggcgcgccgcgcgccagtaaatcaacagcatcaggcccatcaccagggttaaggtaatgctggttgccgcgccgaacggccagtcacggatattgaggaactggcttttgatcacgttgccgatcagcaggttcttggcgccgcccatcaggtcggaaacgtagaacaaccccatcgccggcagcatcaccagcagacagccggcgatgatccccggcatggtcagcgggatgataatgcggataaaggtctgcagcttgctggcgccgagatctttcgccgcttccagcagcgggcgatccagtttctcaatgctggagtagagcggcatcaccataaacggcagcaggatgtacaccaggccgatgatcaccgccgagggggtgaacataatgcgtatcggggtgtcgatcacccccagccacagcagaaactcgttcaggtaacctttagtgctgaggaaaatcttcagcccgtagatgcggatcaacgagttggtccaaaaagggacgatcagcaggaacagcagcaggggccgtaccttctgcggcagccgggcgaggaaccacgcaaacggatagccaagcgccaggcaggcgagggtcgccagcagcgccatgtttagcgaatgcagcagaacgtcataatagagcggatccagtagccgcgaatagttatccagcgtgaagaccagtttgacgaagttggcatcgtcgcgggtcaaaaagctggtggcgatgatcatcaggttgggcaggaagacaaacagcaccagccaaccgacgatagtggcgatcaccacattctggaatttactggtgttcttcatcggccagcaccacctcccagctttccacccaattgatagacattttctggtcaagagagtggtcgaaatccgggtcgtcttcgttaaagaactcgctgaccatcaccattttgccgttctccagttccaccaccgactccagagtcatgcctttatagttgcgctcgcggacatagccgatcaggccatcggcgtcgctgttatggtggatctcgtcgacgcgcagatcttccgggcgcagcaggacatgcagacgctggccggcctccacggcaaaattgacggtgatgttgcattctcgtccttcaacgctggcgcgcacgcgctgttcgtcgagacgttcaattaccgtggcgtcaaagatattgatctcgccgataaagctggcgacaaacaggttcttcggctcttcgtagatctctcgcggggtgccgtcctgttcgattttgccatcacgcatcaccacgatgcgatcggacatggtcagagcctcttcctgatcgtgggtgacgaagacgaaggtgatcccgagcttacgctgcagcgctttcagttcgttctgcatctgcttgcgcagcttgtaatccagtgccgaaagagactcatcgagcagcagcagacgcggtttgttgaccaccgcgcgggcgatggccacgcgctgctgctggccgccggagagctggtgcggtttgcgctgggcaaacgcctccagctgcaccatttttaaggcatccatcacccgtggggtgatttccgccgccggggttttctgcatccgcaggccaaaggcgacgttctcgaacaccgtcatatgcggaaacagggcgtagctttggaatacggtattgacgtggcggttttccgccggaacatgagtgatatcgtgatcttcgagatggatccgtccgctgtcgacgttttccaggccggcaataaggcgcagaacggtggttttaccgcagccagaggggccaagcagagtgagaaactcaccattgttgatggtcaggttaaggttgtcgatgaccgttttaccatcaaagctcttgcgaattcccgccagatgcaccagcggcgaacgcgaacgcggttgtatattcaatttttgactctgtcccatgtagacgcaacggcaaatttccggccgctgcggggtttgtgattaaccacctttggggttgcacgtttttaataagggccagcattctacggcaaacgagggtaatcgccaatccttgatacgcccgcatagtctacctttacaccataacgtcggttccgttattaaatttcgctttacgggctaaaaatgacctgacgcaatatttgtcttttctggcttatgaataatgttgtcacaaaagaagagggtggctacatggataaattgcttgagcgttttttgcagtacgtttctttggacacgcagtcaaagcctggcgttcgtcaggtccccagcacggaagggcagtggaagctgttacgcctgttgcaggcgcagctggaagaaatgggactggtcaaggtaacgctgagtgaaaaagggacggtaatgggaactttgcccgctaacgttgagggcgatatcccggccatcggttttatctcccacgtcgacacctccccggatttcagtggtaaaaacgttaatccgcagattgttgaaaactatcgcggcggcgatatcgcgctgggtatcggcgatgaggtgctctccccggtgatgttcccggttctgcatcagcttttgggacagacgctgatcaccaccgacgggaaaacgctgctcggggcggacgacaaagccggcattgccgaaattatgaccgcgctggcgaccctgcaggcgaaaaatattcctcatggcgatatccgcgtggccttcacccctgatgaagaggtgggtaaaggggcgaagcatttcgacgtcgaggcctttgacgcccgctgggcctataccgtcgacggcggcggggtcggcgaactggagtttgaaaacttcaacgccgcctcggtgacgataaaaattgtcggtaataacgtgcaccccggcaccgcgaaaggggtgatggtcaacgcgctgtcgctggccgcgcgcattcatgccgaagtaccggccgatgaagcgccggagaccactgaaggctatgaaggtttttatcacctcaccagcatgaaaggcagcgtcgatcgggccgagatgcattacatcatccgcgattttgaccgtaagcacttcgaggcgcgcaagcgcaagatgatggagatcgccaaaaaggtcggcaagggactgcacccggactgttatattgagctggtgatcgaggacagttattacaacatgcatgagcaggtgatcgcccatccgcacgtggtcgatattgcccgccaggcgatggtggactgcgatattgaaccgcagatgaagccgatccgcggcggcaccgacggcgcgcagctctcatttatgggactgccgtgcccaaacctgtttaccggtggctacaactatcacggcaaacatgagtttgtcaccctggaaggaatggagaaagcggtgcaggtgatcgtgcgtatcgccgagctgacggcggcacgcaaagggcattaatcttctcaggcggcccggtagggccgcgtgtcggacaagatgccggatggcggcttcgccttatccggcctacggtccagccggtgagcgcggaacccgtaggcccggcaagcgcagcgccgccgggcaggatgatggctcagtcgccaaagaaccagtaaccgctgttgaccagcgctgccagcatggcgaggaaagaaggatcttccagcgcatcgccaaaatggtcggcgcgcagcgtcagatgggtggctaaggcgtccagcgccggacggtgcggggagttgatcttctcgccgttaacgaatacctcgccgtcaatgcgcagcacccgcaggccgcccaggcgttccagggtatcgccctgctgcagggcatcgtaaatctcatctggctgatacggcggctccggcggcgcgacgtcgagctcatgacgcgactgggtgataaactcgccgaaccactgcttaaagtgctccggttggttaatcagacccagcatcatctcgcgcaggcggtcgagttcggtcggtaaaatatccgccggatggtcgcgggacggcacgtccggatcggcgtagcgctggctgcccagttcgcgctggaggacatagtcggcaaagccgctaaacagctcgcgggcattcggcgcgcgatagccgaccgaatagttaagcgagttttccagcgaataaccctcatgcgggaatcccggcggaatatagagaatatcgcccggctccatctcttcatcgatgatcgcctcgaaggggtcaacctgcagcaggtccggatgcgggcagtgctgtttcatcggcaccttttccccaacgcgccagcgccgacggccggtgccctgaatgataaacacatcatactgatccagatgcgggccgacgccgcctcccggcaccgagaaggagatcatcaggtcgtcgatacgccagtccggcagagcacggaacggatgcatcagcgctgcggacggttcatgccagtggttaaccgcctgcaccagcagggaccagttgttttcgctcaggtgatcgtagctttcgaaaggaccgtgactgacctgccattttccatcctgatggctgacaaggcggctatcgacctcgctctccatggccagtcctgccagttcgtccgggcttagggggtcgataaaattggcgaagccgcgcttcaataccaccggccgtttttgccagtagcgttcgataaagtcgggccagttaagcgttaattgataatccatattgatattccactgcaggtgtctgacagggattataacggatgcggcgccctggcgatgcaggcgccgtgaaaaatctcaacgattaactctgtttatcttccatctgctggcggccaaacaccacctccatgcaggcgccgccgagcaggctttccccggcgatgatctctccatcatattgttcgacaatttcacgcgcaacggagagccctaccccctggccgggacgcagggtatcagcccgctggccgcggtcgaaaacggcccggcgctggctctgcgggatccccggcccatcgtcttccaccaggatgtgcagatggctgtcggtggtctggcgcacggaaacttccacgaactccagacaatacttacaggcgttatcaagaacgttacccatcacttccataaaatcgttctgctcgccgacaaaagtgatctccggcgagatgtcgagcgagatattgacccctttgcgctgatagaccttgttgagagcggaagtcaggctgtcaagcaggggggcgatcgggtgtaattcccggctcaagagggtgccgccgctgcgcatgctggcgcgatgcaggtaataaccaatctgctgcgagatgcggcttatctgctccagcatcaccggctccgcctcgtcgacgctgatcttctcgccgcgcagcgagcgcagtgtactctgcatcaccgccagcggcgttttcagactgtgagtgagatcggtgagggtagtgcggtatttgtcatagcgttcgcgctcgctgcgaaccaggcggttgaggttgctgaccagccgggtcagctcgcgagtggtgttgggattgagcttttcgcggtgatgttcctccagttcgcgcacctctttggccagcgactcaatgggccgcaggctccaccaggcggcgacccacagcagggggatcaccagcagcaggttggcggccagcacatagacaaaccagctccacaccatatagctgcgcttgagctccaccggaatggtgtcgaccaccacaatgctgagctgaggcattttgctggtggccgggtagaggttgatcgccaccgagtgggtcatctcagagtcgtcgccctgttcgcggatagcgtccagctgttcctgaatctcatggttattgcgcaacagcatactgctgctgtcgacatcggcttcaatctcatggaagccattgcgtttcagccattccggttgaatgcgtttcgccagccatggaacatcacgctgcgcccacagcagtttgccctgctcatcgtagataagggtcaccgtcgggctttccatattcaggttttccgggatatcgacgtcaatagcgccgttttcccatctcgccagcatataaaagagattgctctcgccgcgcagcaggcgaaaggtggttttatcgaagctaacgctatagcccaccagggccaccatgccgtaggccagggagagcaccagcaccaccccggcggtcgccagcaggaagcgaacccgtaatgacagcgggaagatatgtcgcaacagtcccttcatcagcgcaattcgaacagatagccctggccgcgcaccgtggtgatgacgtcctgtgggtattcagcctgaattttcttgcgcagccgacccatcagcacgtcgatggtgtggctttctcgcagttcggcatccgggtaaagctggagcatcagcgaatctttgctgaccactttgccgcggttacggatcagggtttccataatggtgtattcaaaggcggtcagcttgatcggctggtcattcaccgacagctcgcgccgggagaggtcgacctggaacggcggcagggagatcacctgcgaggccagaccgctgttacggcgcagcagcgcctgcatgcgggcggcaacctcttcaatatggaaaggcttggtgacgtaatcatccgccccggcgctcagcacttccactttatcctgccatccttcgcgggcggtcagcaccagcaccggcagcgacacgtcgtggctgcgccagcggcggatcagtgataaaccgtcttcatccggcaggccgagatcgacgatggcgatatccgggagatgttcgcccagatagtagtccgcttccctggcatcttccgccgcatcgacctgatggcccagctcctgcagctgaactttgaggtggtgacgcagcagggcattatcctcaaccacgagtacgcgcatggctgttctccctagcattttcgatagtagtctgacgctcattatatacgcaaaatataaacggctgttaaataaagctttttataaaaagggcccctggtgcccccgggctggccagcattctgcggcgccctttgcgcatactgcatggaactccttcattctatgcgtaatttcagtaaacgcccagcggcaggatgcgaacggcgagcgggttggtgatgttaattttttgtgtaatagtgctggaatcacccctcaagaacgtcgcaggttatccattatgtctcagcagcagagcgcggactgggtcaggctggcgcaatcgcccagccggacggaacgcatcgaagccttcttcggcggccacggctacgaaccgcaccggcatgatacctacgccatcggccagacgatcgccggcgtgcagagctttcactatcgcggcggactccagcacagcctgcccggcggaacgatggtgcttcatccggacgaaatacacgatggcgaggcgggcaccgaggcggggtttcactaccgtatggtttatatcgaaccggcgctgatccagaagatactcggcggcaggccgctaccgtttatccccgacggcttgtcggcggatccacggctacgtcacgccgcgcagccgctgttgaaagcggtcacggataccttcgagccgctggaggaagaggatgctctgtacgacctggcgcagaccctggccgttgtcggcggccaacgttcccgtcgccaggcgtttgattatcaggcggcggagagggcccgggagtatattcatgcctgttttatgcaggatatgaccctcgacaccctgtcgcaggtcagcggccgggaccgctggagcctgagccgggatttcagaacgctgtacggcaccagcccgtggcgttacgtcatgatgcgtcggctcgatttttgccgccagcggatgcgcgccggggaacgtctggtggatattgccgccgacgcgggctttgccgaccagagccacatgacgcgccagtttatcagccgctttggcctctctccggggcgctggctgcgggctatccgcggataaggcggcgcaggttgcacaatcgttcaagcgtcaacgcggcgaggcgaactatgctgactgcctttatcataaggagacagcccatgtttcaactcgttaatcttgctcataaattttccctgttcagcgaacaatggcagcccaaagtggtggctgaaatgaacgactatcagttcaaggtcgtgcgcatcgccggcgactttatctggcacagccacccggaaaccgatgagacattgatggtggtggagggggtattgcgcgtggacttccgcgacgggcatgtgctggtgaaggccggggagatgatcgtcgtgccgcgcggggtggaacataagacctcggcggagacggaagcgaagctgatgctgattgagccgcgcggggtgttgaataccggccacgagggcggcgagcggacggcggtgaacgacgtttggatctgatcgctttccggcgataaaacgcccctctttccggcggaaagaggggcagggcgattacttcagctcgtcaaccatgctggttgcccgaccgatatagttggccggggtcatcgctttgagacgcactttttcctcttccggcagggcgaggctgtcaataaactgcttcatcccttccgcgtccacgcgtttgccgcgggtcagctctttcagcttctcgtacggtttttcgataccgtaacgacgcatcacggtctggatcggctcagccagtacttcccagttgtgatccagttcgtccagcaggcgatcctggttcagctccagcttgctgatccctttgagggtggactgataggcgatcagcgcatagccgatgcccacgccgaggttacgcagaacggtggagtcggtcaggtcgcgctgccagcgggaaaccggcagtttgctggccaggtgctgcatgaccgcattggccaggccgagattgccttcggagttttcgaagtcaatcgggttcaccttgtgcggcatggtggaggagccgatttccccggcgatggtcttctgtttgaagtggttgagcgcgatgtagccccacacgtcgcgatcgaagtcgatcagaatggtgttgaagcgcgcgatgcagtcaaacagctcagcgatatagtcatgcggctcgatctgcgtggtgtacgggttccactgaatacccagcgaggtaacgaactcttcgctgaactgatgccagtcgacttccgggtaggcggcgatgtgggcgttgtagttacccaccgcgccgttgattttaccgaggatttccacctggttcagttgacgatactggcgctccatacggtaggcgacgttcgccatctctttacccatggtggacggcgttgccggctggccgtgggtacgggagagcagcggcacatcgcggtactgggtcgccagatcttttaccgcgtcaatcagtttgcgccagtaaggcagaaccacttcgtcgcgggcggttttcagcatcagcgcgtgggagaggttattgatgtcttcagacgtacaggcgaagtgaataaactctgataccgcgtgcagctcggcgacgtcagcgactttctctttcaggaaatactctaccgctttcacgtcgtggttagtggtgcgctcgatggttttgatgcgctccgcgtcttcaacgctgaaatcggcgacgattttatcaaggaaaccgtttgcgtcggcagcaaaagcaggaacttccttgatcgctgcgtgggcggccagtttttgcagccaacgtacttccacctgaacgcggaatttcagcaaaccgaattcgctgaagataccgcgcagcgcgctgactttatcgccgtagcggccgtctacaggggaaacggcggtcagtgaggataattccatagatcacaactccggggttaaatgagcaagaatttgctttgcctggttaaccagacgattacgggaaaacataagctgcagacgtccgccgcccacctgatgccagagcaccgcggcgcgaatacccgccagcagcgctgagcgaactttcgcctgcacctgcgggctttgcagcacggcaggggagccggtcacctgaatacgcggccccagcgggcttatcacatcgacatagatgcccgccatggcgctgagcagcgtttcggactgcaggtcaaagtgttccagctgacggtgcaggccggcgatgcggttgccgagcgtgtccatcgcccctttactggcggcgagcttgcgctccagcaccatcaggctcagggtatagcgcgtcagttcagcattgaggccctgacggctgctggtattgagcaccccgagcagcgtttcaagaccgaggcgaagattggcttcactgccaccgaacaccgccagcgtcgactcaggatcgaggtcgatgatgctgttcagcgacacatgcagggcatcgctgtcgcaatgtccctgatgcgccagttgctgaaccagtcgcgccgcctggcaaacgccagccagcgccagggtgatgtcatagtaattcttcgccacacatactccttgtcagccgccagggcggttcgtcccggcggaaataacgcgcgttcaggactgcagaggcagtcgttgttcaataattccgccgccgaggcacacttcccctaaatagaacactgcggactggcccggggtcaccgccgcgaccggctcatcgaagcggacttcgatacggtcttcatccagcgcggtaacggtgcaggggatatcggtctggcgatagcgggttttcaccgtgcagcgcagggtgccctgcagcggttcacggtttacccagtgcagctgttgggcaatcagaccgacggacatcaggcgcgggtggtcatggccctgggcgacgataagaatattattctcaacgtctttatcgaccacgtaccatggatcttcgctaccctctttggtgccgccgatacccagccctttacgctggcccagggtgtggtacatcagcccctgatgagtaccgatctcctcgccgtcgacggtgaggattttgcccggctgcgccggcagatagcggccaaggaaatcgcggaatttacgctcgccgataaagcagatgccggtggaatcttttttcttcgcggtgatcagatccagctcttcggcgatcttacgcacctgcggtttttccagctcacccaccgggaacaggctctgggcaatctgctcgtggctaagggtgtagaggaagtagctctgatctttgttgccgtcgaggccgcgcagcagctggcttttaccgtcgacatcggcgcggcgcacatagtgcccggtggcgatgtagtcggcgccgaggtcttcggcagcaaactcgaggaaggctttaaatttgatctctttattgcacagaatatccgggttcggcgtgcggccggctttgtactcttccaggaagagctcaaagacgttatcccaatattcggcggcaaagttaacggtgtgcagttcaatgcccagcttatcgcagaccgcttgcgcatcggcaaggtcggcggcggcggtgcagtattcctcgccgtcgtcttcctcccagttcttcatgaacaggccttccaccttatacccttgctgcagcagcaggtacgcggagaccgaggagtcgacgccgccggacatgccgacgatcacttttttctggctttctgacatggaaatactcgctacattgaacttcgaggcggcgtattctagcacgcgctcaccgttcattcaccccctgtgaacggccagttaaatgcgccaatcagcgacagcggctgccccgggtcctgcaggtagcagcgaatgctttcggcaaccagcggcgagcgcaggttcggcgcgttaagaatttcctcagcactgagccacaggcagcgatcgatatcgctgtcgtgtggttcagtggcgcacagatcgctaagttcgatggcgaacaggaagcgcagaaacggcgtgttatcgggagccagccactgatgcatgcggatgaagtgctgcggcgtggcgcgaatgccggtctcttcccacagttcacgttcggcggcctgcagcagcgtttcattggcctcgagatggcccgccggctggttccacagcgctttgccgttaatggtttcttcgacgatgagaaatttatcctgggcgtgaaccacgcaggcaacggtgacatgaggtttaaacatcgcttttccttttcagttattcggctttgcgccagtcgccgttgggcagtccgtcgagggtatagccgcccatggcgtagcggatcagccgcagggtggggaagccgacgtgggcggtcatccggcgaacctggcggttgcgtccctcgtagagcgtgattttcaaccagcgggtgggaatcgatttgcgctcacgaatcggcgggttgcgcggccacagccagacgggttcctcgacaagttctacgccggcaggcagggtggggccgtcgttaagggtgacgccgtcgcgcaaggcggtcagcgcctcgggcgtgggttcgccttccacctgaacatagtagatcttgccggtgcgcttacccggctgggtcagcttcgcctgcagcgcgccgtcgttggtcagcaccagcaggccttcgctgtcgcgatcgagccgacctgcggcgtagacgcccgccaccggaataaaatctttcagcgtgctgcgcccggcttcatcggtaaattgcggcaacacatcatagggtttattgaacaagatcacagtttttggctggcgttctttacgttgtctggtgacttgttgtgtgctgaatcgctcaacgcgatgttttctaaatgaagttttctgcatggtattttcaggctttatcaattgccgcattatagcctaattacgaatgcctttcatggacgcaaacattcaggtagtattgacatgctcattacaaattattaacaaaaaattgctcaaaccgattcgcactacaggcaggaaggcgacacggacgcgatagctccggttagcgggaagacccggtacgccgaagctggccgactcagccaacaccaggctcgcgtgaagagggaagagcagaaccagaagcgctcgaaggagaggttaatggaaagcaaagtagtagttccggcggaaggtcaaaaaatcaccctgcaaaacggcaaactgaacgtccctcacaatccgattatcccgttcattgaaggtgacggtatcggcgttgacgttaccccagcgatgctgaaagtggttgatgccgccgttgagaaagcctataagggcgagcgtaaaatttcctggatggaagtttacaccggtgagaaatcaacccacgtctatggccaggacgtctggctgccagctgaaaccctcgatctgattcgtgactaccgcgttgctatcaaaggtcctctgaccaccccagtcggcggcggcattcgttctctgaacgtggcgctgcgccaggagctggatctttacgtctgcctgcgtccggtacgttactaccagggcaccccgagcccggttaaacacccggaactgaccgacatggttatcttccgtgaaaactcagaagatatctatgcgggtatcgagtggaaagccgactctgcggaagcagacaaagtgatcaaattcctgcgcgatgagatgggtgtgaagaaaattcgcttcccggaacattgcggcatcggcatcaagccgtgctctgaagaaggcaccaaacgcctggtgcgcgccgcgattgaatacgcgatcaccaacgatcgtgattccgtcactctggtgcacaaaggcaacatcatgaagttcaccgaaggcgcgttcaaagactggggctaccagctggctcgcgaagagttcggcggcgagctgatcgacggcggtccgtgggtgaaaatcaagaacccgaacaccggcaaagagatcgtggtgaaagacgtgatcgccgatgcgttcctgcagcagatcctgctgcgtccggcggaatacgacgttatcgcctgtatgaacctgaacggcgactatatctctgacgccctggcggcacaggttggcggtatcggtatcgccccgggcgccaacatcggcgacgagtgcgcgctgttcgaagcgactcacggtactgcgccgaagtatgccggccaggacaaagtgaacccgggctccatcatcctgtccgcagagatgatgctgcgccacatgcagtggttcgaagccgcagacctgatcgtcaaaggcatggaaggcgctatcgccgccaagaccgtgacctatgacttcgaacgtctgatggaaggcgctaaactgctgaaatgtagcgagtttggcgacgcgattatcgcgaatatgtaatcccattgatggattaagtaaaagcgggagccgatgggctcccgttttttttcgccttcaggcaattattctgccggacgcttgaagcattaggcgatggcgaatgtcccgcagcgcaacgttcaacaaagctatatacctcatgacagggagagatccatttgccgtaagagctcgcatgaaaacggattgcacgccaggcgtcatactgatggcccgaccggcttaaaccggggccgttcggcgaaaatgtgctgtagcctaaactcaggctatccgcgcactttcagattaaacagccgggacagcgccgctttgccgctatccgtcacttgtacttcccgatatcccggtgcgcgcgttatccatcctttttgcaggaacagcgtcattagcgccgagccggcgtcgcctcccagatgaaaacgtctttcgctccagtcgagacaggggcagcagggcttacgccgtgggcgggcgttcagtactgcgccaaggcgttcaagctgggttttaccggctgacgtcagggccaggccatctgccgccagccatttttccctcagcataaattcataaatattgaccgccagctcgcccgccagatggtcgtagcaggtgcgtgcgtaacgaagattaaccggcgtgctggggagaagcgtcttatgcgcctgcatagagacgcccatcaggttttccagcagcccggcaatatgcgagcccgccaggcggtaatagcggtggcgcccctgcgcgagacacaccaccagtccgttgctgagcagccgggcaagatggccgctggtggtggaggcggacacctcggcgaccgtactgagttcggttgccgtccatgcgcgcccgtccatcagcgcgcagagaatactgacccttgacgagtcagagagggcggaggccaccatcgccatagcggtttccagcgcctcctctggctcactgtcttgctgcggtttcaggagattcattcagaaagtatggcccattttttggtcacttccgctgcccgggcgtcatcatcggtaaggagaatgagccggttacggtggtcgctgtactgtaccagaatattaataccattatgggccagggtgtccgcgatgtctcccagttccccaggacgttcctgaggtaactttcgtatcagaggacggcatacattgctgaccgtaaagccggcctcggtcagcaccctgcgggctgtctcaccgtcttccaccagaaaatgcgcatgtcctgcatcaggcgtggtgaatacgccgccgccttcgagccccacgccgttgttacccagcgccatacccattgcgccaagcgagcccggcgagttgctgagaatcacgtgaatgtcatacatctgactgtgctccccgatccgatgcgtaatcccggaacacgcgggctacgcgtattctgtaatatgaaaaaatcgatgctttgccttcgcgctgggcagccagatgccgctcattttgctgccagttggccaccgaggcttcatcttcccaccaggatagcgagaggattttgccgggcgtactcaggctctgaaagcgctcaatggcaataaaccccggcgtgtctgaaagcaaaggcgtcagcccggccgccagctgaagatatctttcctgtgcttgtggtaaggcgtcggcctcaaaaagtaccgcaatcataagtctgctccgtggtgaatttcccggcagtctactgacggccagagcaggaagcttcggtgtgcagcgaaatatgcctggcaggagatcaacgattgcaacggaaatgctcccaggcgttattgcgatggtgaataaaaaagaacgccagccatgcgatacggcagcctgagcgcacagggctggctgagttttagtgaaatcgcgatgtggggagataaaccctgacggctgcggctatcgatgaaagcgatcgccgacgggcagtacgggcgggaaagccgttttactgacatgcagaatatgaacccggaaacgctcgcccggactagcgaagcgccgccgggcgataatcgaaagagcacgttgtctgccaccggtcacgccttcaggctccgcgctctcctcgggcgtggatttttaccttagccgggagacctgcgtctcgcctactgtgcatggcggcgcagggtggaggcggggtggcgccgcagcgcctcttcgggacgcacagggcgccgcaccagttcgccgccgcagttcgggcaatgtccgttcagtcgcgtcgtcatgcagtcccggcaaaaggtgcactcgaacgaacagataaacgcctcgggtgagtctggcggcagatctttatcacagcattcgcaattcggacgtaactcgagcatcaacttctcctctggtgaacggctatatcagcgacggcgggccaaagcacgctatgtttatatcatgccgcgatcggtccgccgagaatttccttgcgcggtaatcgccttctcagagggtcgctttcccgggctgcattcccggtacgaggatcactttgcggcacgcctcttcacgtttctcaaagatctgatagccgcgcgcggcctcctccagcggcatatggtgagtgacaatctcctccggggtaagcagcccttgctcaataagcgccagcagatccggcagccaggcgtggacgtgggtttgtcccatcctgaaggtcagtcctttatcaaaggcatcgccaaacataaagccgtggatgaaaccggcgtaaaccccgggtacgctgacgatgccgccgcggcgcacggcggcgatgcactggcgcagggcttttccgctgctcccctcgattttcagggtgctgaggacggtttccgtaaggctacctttcgcctcgaagcccacggcgtcgatcaccgcgtcgacaccgcgatggcccggcgtgttatcgataatccactgcgcaggatcgtcatggtggtcaaagtttatcgggatcgcgccatagcgttgttgcgcgaaatcgagtcggtaatcgttatgatcgatgataaatatctgttctgcgccattgagcctggcgcaggaggcgcagagcaggcctaccgggccggcgccaaaaatagccacgctactgccgggtttgacctcggcgtttttaaccgcctgccaggcggtgggcagaatatctgacagaaacagcaccttttcatcgggtaaggtgtctggcactttaaacggtccggtattggctttggggacccgtacatattccgcctggccgcccgggatcccgccgtacaaatcgctatagccaaacagcgccgccggtggcgaaatgccttttcgattgagcgtcgctccctggccgctattggtgctttcgcaggcggcatactgctgcaagcgacaaaagaagcagtctccgcaggcgatgacaaacgggataaccacccggtcgcctttgcggaccgcggtgacctcggaaccggcttccaccacttcccccataaattcatggccgaaaatatcaccatggtgcgtgccggggatctttccgcggtacagatgcagatcggaaccgcaaatcgctgtcgcggtgacgcgcagaataatatcgtccgctgcctcaagagccgggtcaggcatgttgtcgacgctgacatgatgcgggccgtgataagtgagtgctttcatagaatattctcctcgagagaaaggttgacagcatgcggttcttcggcctggtgaacggctgctatcgtcaccgataaatcatcgtaaaaaataaagcgtagagtactaataatggaactgcgtgatattccaggggctgaatatattccacgcttcgcttatttcccggctggtctgttcgagttatttgcctattgcccttatgtgtgccagtattaatcgggcatgatattcgctccattttgtttgctagccgcttccccagcggcttttttttattcgtaaaatcagggaaaattcttaatttccgtctggcaaaggacaatgctgccgcttcgttatataacccaacggtagtaatcctccggtatagataattctttgccgcagaggtgatctgcatacattatttccctgaacacagtgagttagcggcaaggtgccgtctggttatttttgaggtgtcttgtagaattattccgaattactgctaaaaggtgtcgaaaaaacggaataataatttgactaaccagcattacccgctagatttaaatatcgaacgacgagtgatacggaatattttcgtatcgtactgacataaccgatatacatgaggtgaaatatggcagagcatcgtggtggttccggtaattttgctgaagaccgtgaaaaagcttctgaagcaggtcgtaaaggtggtcagcacagcggcgggaactttaaaaatgatccgcagcgtgcgtccgaagcgggtaaaaaaggcggacagaatagccacggcggtggccgcaagtccgataattcctgattatccttttccttgcaccctgaagtgaaagtatctcctgcgagtctgtcacagactcgcagttattttctgactccagaaggtatttctatgaatatgaaaagcattgaagatgtatttattcacctgctctcagatacctacagcgcagagaaacaattaacccgcgggctggctaaactagccagagcggcgtccagtgaaaaactcagcgcggcgttcaatgctcatcttgaagaaacccagggccagatcgaacgtatcgaccagattattgaacaggaatccaacctgaaaatcaaacgcatgaaatgcgtggccatggaaggattaatcgaagaagctaatgaagtcgttgagagcacggaaaaaaatgaggtacgtgatgctgcattaattgccgctgcgcaaaaggtcgagcattacgaaattgccagttacggtactctggtcaccctggcagagcagttgggctataaaaaagcagccaaactgcttgccgaaaccctggaagaagaaaaacaaaccgatgtgaaattaaccgatctggcggtaggtaatattaataagaaagcggaaaaataaactctccctgacacgaggaaatcacgatgaatcacgttgaacattaccatgactggctacgagatgcgcatgccatggaaaaacaggcagagtccatgctggaatcaatggctggccgtatcgataattatccggatctccgtgccagaatcgaacagcatgttaacgagaccaaacggcaaattaccgtgctggaagagatccttgaccgcaatgagatttcgcgctcggtgattaaagattcgatgagtaaaatggcggctctcggccagtccatcggcgggatgtttccttccgatgaaatcgtcaaaggctcgatcagcgggtacgttttcgagcagtttgaaatcgcctgctatacctctctgctggcggccgctgaaaaagcgggcgataccgcctccatcccagccattgaagccatcctggcggaagagcgggaaatggccgactggctgattaaacatattcctcagaccacggagcagtttctcctgcgttcagatgctgacggcgtagaagcgaaaaaataacccaggaggcaggcctatgtttcgtcatgtgaaacaactgcagtataccgtacgcgttgctgaaccgaatccggggctcgcgaatttactgctcgaacagtttggcggccctcagggcgagctggccgccgcgtgtcgttatttcacccagggattaagcgatgacgatcccggccgcaaagatatgctgatggatatcgcgacagaggagttgagccatctggagatcattggcactttggtcggcatgctgaataaaggcgccaaaggagccctggcggagggcaccgagagcgaggcggaactctatcgttcgctcaccgccaacggcaatgacagccatattacatccctgctgtacggcggcggtaccccgctgaccaactcggcgggcgtgccgtggacggcggcctacattgatactatcggcgaacccaccgccgacctgcggtcgaatgtcgcggcggaggcgagggcgaagatcgtctatgaacgcctgatcaacgtgaccgacgatcctggcgtgaaagacgcgctggccttcctgatgacccgcgaagcggcgcatcagctctcttttgagaaggccctgcagtcgattcgtaacaactatccaccgggcaaactgccgcccattagcgagtacgctaacacctactacaatatgtctgaaggtggagaagtacgcggcagctggaacagtgacaaacacttcgattatgtcaaggatccacagccggccgtagatggcggagatggcagtgcttctgtcggcctgacgccagagcaggaagcgctgtgcaaagcgatgctgaagcgaacgcagtctgacccgcagggcgatcctttgaccggcgccgaactcggcgccgggaagcaaaacacttcatcatcagctaagtgatgttcgcatgagccccggctgcggccggggcgattcacaatgatgggtgtggaatatgtttgaattcgacgcgtttcatctggcccgattgcaattcgcctttaccgtatccttccatatcctctttccggccatcaccatcggccttgccagctaccttgtggtgcttgaggggatgtggctgcgaacccgggataatgtctggcgttcactctacaatttctggctgaaaatctttgccgtcaattttggcatgggcgtagtctccggattagtcatgtcctatcagttcggcaccaactggagcggattttcccagttcgctggcagtattaccggcccgctgctgctgtacgaagtgctgaccgccttcttccttgaagcgggattcctcggggtgatgctgtttggctggaataaagtgccgccagcgctgcatttttttaccacctgcatggtggcgcttggcacgttggtttctaccttctggatccttgcctccaatagctggatgcagacgccgcagggttttatcatcgaaaatggccatctcatcccgcaggactggctggcgattatctttaacccctcttttccgtatcgcttgttccatatggcgatagccgcgtttctcagtagcgccatgttcgtcggggcgtctgccgcgtggcatcttctgcgcggcaacgactcgccggccatccgcaaaatgctgtcgatggcgatgtggatggcgctgctggtggcgccgatccaggcggtggtgggggatatgcatggtcttaacacccttgagcatcagccggcgaagatcgcggccatcgaagggcactgggaaaatcgccccggcgaggccacgccgctgctgctgtttggcctgccggacatggagcaggagcggacccgctatggtcttgagatccccgctctcggtagcctgatccttacccacagcctgcataagcaggtgccggccctgaaagacttcccgaaagaggaccgaccctattcgcccgccgtcttctggtcgtttcgcatcatggtcgggatgggcgtgttgatgatcgccttagggatctgcagcgcctggctgcgctatcggcggcggctgtaccactcgcgtcccttccagtggtttgcgctctgtatggggcccgccggtcttattgccctggtcgccgggtgggtgaccaccgagatgggccgccagccgtgggtgatatacgggttgctgcgcacgcgggatgcggtgtcgttgcacagcaccctgcagatggccatcagcctgctggtatttatcgtggtttactgcgccgtgtttggcgtggggtattactatattttccggcttatcaaaaaagggccgcagccggtgactgagctgacctcgcaaaccgcaggcaccccggcgcgtccgctctcagcggctgagccggtgcgtgatgaggagaacgcatcatgagcatcgatatctcggtgatttggtttgtcatcattgtcttcgccacgctgatgtatatcgtgatggatggtttcgatttaggtattgggatgctgttcagcgtggtgcatgatggcgaagagcgcgatgtgatggtcaacagcgtcgcccccgtctgggatggtaacgaaacctggctggtgctcggcggggcagggctattcggcgcctttccgctggcctatgcggtgatcaccgatgcgctggttatcccgctgacggcgatgctcatcggcctgatttttcgcggcgtggcctttgaatttcgttttaaagcggttccctcgcatcgcatcttctgggactatgcctttgccggcggctcgctgttggcgaccttcagccaggggattgtcgtcggcgcgtttatcaacggctttgcggtggctgaccgccgcttcgccggttcgacgctggactggcttacccctttcaatctgttctgcggtctggggctggtggtggcctatctgctgctgggcaccacgtggttgattatgaaaagcgaaggcgcgctgcagcagcggatgcgcgagctgacccgcaaggtactgctggcgctgatggtggtgattgcggtggtcagcgtctggacgccgttgggctggcgctacgtggcggaacgctggtttacgctgcccaatttcttctggttcgtgccggtgccaattctggtgttggctctgagcctgtggatctggcgcctgagcgcgcgccccgccagccacgcccgtccctttatcctgacgctgggcctgatattcctcggcttcagcgggctggggatcagcgtctggccgaacattattccaccgcatatctccctgtgggatgccgctgcgccgccctccagccaggtatttatgctgccgggggcgctgctcattatcccggtgatcctgatgtataccgcctggagctactacgtctttcgcggcaaagtctccggcagcgagggctatcactagcctgattcgcgccggcaggtgaggatttgctggcgcgtcgcgccgtccggtcagggatgaccgagagggatgcgcacaaaccggtgatctgctgcaacgactctggccgggtgtttatgccttcggcggcttgatcttaataataaatcgttcgttaacccgggtgatcctcgcgccaatatcgccaaactcggtggcgattttaaaaaaatcgtccgcggcgacatcaaaatcgagttcaatcttcgggtgttgtcctgtcgccagtaattcatagaaatggtcaaggctgcgggctttttcgctaggcatcttatttctccatggtaaaccaatctgcaggggttttattgcttacggcgcttttacggattattcagcaggatgacaaacgtgcctgatataaaattatgcaatgacagtaagaatgaggcagggcgaggttattccgtgttgttaaaccgcgtggcgacgcgttgtccgccataccatgacggcagagacgaccctgcggcgccggttgatgatagacattttttgatgacaaattaatgacaataaaatgaatctgtccgggctcgggatggcatcgtgctaaataattttattctgtggctggtaaggtggttgttaactactttatggttatggagcgtcttttttagggccaacggcgagggaacaacgatgcaattacttgatttattcgcaggcttattatggttaagcagcgttatcttcctgctgtttgttcttgatgtgatcatcacccgttatctttatcgtaaataatcgacaacgacagcggcgttgggcataggggacggcgtcggaggatgataatataacccgcggaatgattcagaaaggaatgcgcggtggccgggagaattgattacgatattgaaaaataccagtttaccgaagccggtgagacgccacggctccgggagcagtggcgcgaagtatacctggagtgtcgtcagctgcgggccggggcagaggagcgcctgcgcattgcgttactgaacgtcgactatgtcaccagcttcgagctgccttttcgcctgctgctggtgcgtgcgccgcagctaatcgccgatgttcgcgagacgttgcagcttagccgtaaagctgccgttttcaacggcaaacgttacggctgcgtctatagtttgaaacaggatttacaggctgtcccggaagcctttcattaccgcctggcaaaccgcattcgtcgcgtcgatgcaaccgggctgacggcggccccgtaccagcagattgcccgggagataaagccggcccgggagcggctccgccaggcgctgaacgccggcctgccggtcaccgctctcgacgccctgttctggttcggcagtcagcgagtggcggcggacatcgcgcagttgcgccggtccggcatggcgattgtcacgacggaggtggaggtcagcgacaatttgttcaataccacccgacgagtgcccgtttaccgcctggccagcgagtgaatcggcgacctttcgcccagccgttgcctctgcagacagttgaccattgtcccgtcgaaccagacgcacagccctctggcgacaggccgcggggtcagttccagccatgcgctggcgatgagcatgaggagcattagcgccagtggaaccatgtattttcttttcactgccctttatccgctgcgcctgttctgccagcaaggtagcggtaaagtatgacgtttcgttgaccggggcagcgtttttattatcggcaagcggttgcgttgggccagagattattcatcttttggcatacgagaggacgaaaactggcggcttgtatttttgatttttattacaccacgcttttttttgccgccggggaaaagcgtaatgtggctacgaatggatgcggctcgtcatgtaactggctggtttgaaacaatattttaattgttgtctaaacgcatgcgacagcggtggctaatttatattaattcactttaccgatcaataaattatatgttgatagtttttagctatcgaatgtttcttatcgatcattttaaactatttttgttggcgggaaatatatgacatgctttaaccctttcttatttttggtattttttaaatggttgaagaaaacgcgaaaaatacctcctatcgcttcgtactggagcccgctattagcgatgatggcagctgccactcgtgggaattgctcactaaagatattatagcacccgcacgaaataacgcctcagcgcccgcgttttctttctccacgcttaccgaaagcgataagcttgcactatttacccgacaaatcgagttgctttccgtatttgatttttccctggtcgataataagccgatctcgctcaatatcgatgatttattaagccattttattctgacggaccgctatctctgcgattttctgcgctcgtgtaagcatattgctttggagataaatgagaattttcatgagtttatcgccggccgcgagctgacggcgctaagcacgctggcggcgctttgtccggtctggctggatgattttggtcgcgggcgaacctccttcccgctgctggagagattccgcttcgattgcgtcaaagtggataaggactacttctgggataaagaaaacgaccccgctttgcccggtctgttgcagtctattcataccctgaccggccatgtgatcgttgagggtatcgaaaccgaaaagcaaaaacggttaatcacttctgccggggacatcataggtcagggccgctactggaaggaagaatatatttttctttgcggttgagggtcgaccgggggctggtttcggttacctgctattcttttattatccagttttaaattccccctttgctactgatagtctttattagcgcagtgataagcgcctctcttttttatgaaggatcattccctgtaaatacccccatgcgtaacgccccgatcgccatttcgacgtaagccaggtgctgacctctgagctgcgcgagctggtgaaaaaagatctcgccgctgcgatcaattaatcctgcctgcgccatccgctcaggatcgcgcggcatggaaaaatgccgccgtttaccggcggctattgcttattttgcgctaccctggtttttttccagccgggcgaaatactccggtgcaaacgggcgcggatcgacgtcggcaaacggcgcgcgctcaaagtgcgatttcagcgcccaggggaccgtgcagtcaaaaatggtcttgcagctgatgccatttccacggatcgacgggctgtattccggcgtctgggacggatccagctggtgaccgcgaatgccggggattgtcgtaatgctgacgtccccctgcatgcgggtggtcatcgcccacaggatatcgtcgctgtcaaagatgtcgacatcttcatcaaccagaataatattttttagctcggaataggtcgccagcgccagcagcgcggcctgcccctgccggccttcatcggcgggttgacgttttttcacctgcaggatcccgaggaacttaccgccacccgcggtgtgggcgtagacattttgtaaaaagcccggaatggcggcctcgacggcattccagatactggcttccgttggcaggccggcgagggtggtatgctcttcccccggtcccaccagggtctgcagaatcgcattgtttcgcatggtcactgctttgactttgattaccggcagcgacggattagcgccgccgcagtagccaggaaattccggcatcgcgtggccgctattggtgtgctgatcctctctgacgcgcacgccaggcaacagctcaccttcgataacgatctcggcgcgggcgatggctttctccgggacgctgacgccctgaaccagctccaccggacgttgacgcagcgcgccggcgacgcccagctcgttatagccgaacggcgtggtaggggcttcgaagcaggcgccaatatagatggccggatcgagacccatattgatggttatcggcagcggtttgccggcggcctcggccttctggcgaaacacttcgatatggcggccggcggcaagaaacatcgacagctcatcccggccctgaacgcacaagcggtggatggtgacgtcggtcagcgaggcgtcgtcgggatcgctggccagcgccaggcccaggcagaagaaggggccggcgtcgataggggtgttggtgggcgccggaagcagggtgcgcaaatcaaaatccggatcgtcggccagaaagatctgttcctggcagggggcgctgctggccgggacgaccaccggcgcgaccggttttttcaccgccttacccacttcaagggccagctgcgaggcttcgcagcccagcagcagcgcggcccgctggcggctggcgtgcatacccaccagaatgcgcgagtgtggataacccttaatattgttaaacatcatcgccggcccgatgcgagtggggcgcttcacggtgccgcccgcgccgatatggcgataaacaccggccagctcggcgttagggtcaaccggatgatcggtttcgagatactgattgtcatgctgttgcagcagcgcgatggcgtcgcgcagatcctgaatcggtgcggtcatgatgttctccttagcgtatcgatgctcacagtatgcttcgcaggctaatggttatcaattgcatcatttatgctttattgataagctttttcttatctatttgtagggaggagtccgaccatgtccttgcgagcgttacgccattttgtggtcgttgccgaagagttgcatatgcaccgggcggcggagcggttacatatcgcccagcccgccctcagtcagcagattaagcagcttgagcagcgcctgggcgtggtgctcttttcccgcgccaaccgccgtctgactctgaccgccgcgggcgaggcctttttacacaagacgcggctggcgctggaaatggccgatcaggcggtgctggacgcccagcgcaccgcgcggggcgagcaggggaggctgcatttggggtatgtctccagcgcgatgtacgacagtaaactgccggggctcctgcgccggctgcgcgccgactggccggggattgagctgtcgctggtgcagggggatgtgcaaatgctctacgaagcgctgttggatctgcgtctggatatcgccatcatccgcgcgccgctggcctcgccgccggacgcgctggtggtcaggccgtttgtacgtgaaaagctctgcctggccctctatcaacagcatccgctggccggcgtgggcgcgcttaatctggcctcattgcgcactgacaactggatctcgcttgacgatccgcagggcaccggactggagcaggtttttatggatgcctgtcgcgtcgcgggctttacgccgcaggtggcgcagcggattaacgacgttacctcgatgattagcctggtctccgccggggtgggagtggcgttggttccgctctcggcgcgggccttacgccttgataacgtggtgtatatcgatctccaggatcggctggcggagagtgagctgagcatggtttaccaccgccatattcgttcggcggtggtaaggaaagttatctcgctgcttaataccgctgagcgatagtcccggttagctggtcttcaggcggccaaagctgacaatccttgaacggcccagctctttcgcccggtacagcgcggcatccgccgcgcgaagcagactatcgctttgggtgtgctgcgggtagctggcgatgccaatcgacacatccacctggcctatctcggtcagaccatcacgcagcgtcatattgcgcacctgggtgtagatctcgctggcgcactggtgcgccccggcttcgtcaatcccggggagcagcactaaaaactcctcgcccccgtagcggaaagccatgccgatatcgcgcaccgcgcgctgcacaatggtcgcaacgctcttaatcaccagatccccagcctcatggccatagcgatcattgatggttttaaaatgatcgatgtcgatcatcagacagctcagcggagtatgggtatggaccgccagcgccatctgcgaatgcagcgcttcgtcaagatgatggcggttacgcaggccggtcagggaatcgaacagcgctttttccagcagggcgctgcgcaaacgctgattggccagcgccaggcccaacgcttccgccatcagctcgagataggcccgggaaggagcgtcaccggcggtgacgttctggaaggtcagcaggccaatggcttcgccctgggcgatgagcggtacgcagagcgactggccggcgtgcgtctccggcagatgatagcaggtgatatcgggctcgccctgcaccggcggatggctgagtccccgccgtatcgcccagcagtcgtcgggagaaaagggcgtcgtctcaccggcgggcgacagccactgcgctacgcagcgcatctgccaggggtcggtatccagaacatacagtttaccggggatcgtcggggcgatattcggcgcaaaccgctccgccaccttaatcacatcctcaatggtttcacagccctgcagccgctgagtcatacgcgccagcagctcgcggatcgcccagtcggcgtcgcgctgctgctccagccgctggcgggccaggccgttctcgcgaaaaatgcggatcgcctgagccatgtcaccaatctcatccacctgggtaaagtgcggcgtctctaccgcataatcctgggaggcgagacgctggactacgtcgctcaggcgaaccaccgggtagagcacccggcgtttgagaatgaagccgaggacgaacaaaaacatcagggcggtcaggccgaccatgatttccgacagcgtacgccagatccgctagcgctcggtggcctggtcgatagcgacggcggcgcgatgctcaagcatctggcggaagcgatcgatctgcgtctgcatgcgctccagttcagtctcgtacgcggtgccgtacagcaccgcgatggccgctggcgcatcgccgcgagcgacatgcgccagggccgcctgctgttcatcctgtagctcattggcgatccgcaggccatcctggagcagcgccagctcctcgcggctggcgccgttatctttcaggccgcccagccgctgctctatgctcttgtcggtctgctgcagctgctgatattgcgtaagcgtctccggcgaaggctttatcacgtacagccgggcgaggtcagacagcgcccaggcgtcgttttccacctcgtcggagagggtatcaaagacctggcgctgctgtaccgcctggcgttcgacgcggtcggcgctggaggccatgagcatagcgctcccggaagccagcgtcaggccaacggtgatcccgtaagcccagttagtgatggtggcgattctcaccgtgaatttccttgcatgcagatgaagctgttttgattatagaactccgcccccgccacgacggcggcccgcttcagaggcggcgctcgctatgcagaggggcaagggtctgaagaatgatggcgtgtagcgtttccgcatggtggcgcaaaacgaggaagacatcgctatccagagcgccatttataacatccgcttccataatctgtaaggcttcctgccaggccatccctttacgataagggcgatcttcggtcagcgcggtgaaaatatcggcgatggagataatccggtcggcgagggtcaggtgctccttttcgagatgcagagggtagccgctgccgtccattttttcatgatgattcgaggcccagttaatgatgtcgccgagctcgctatagtcgctgagaagttcgccggtcatgtagctgtgctcccgcacctgactcagctcctcatcatccagctcgccctctttttcgagaatggagagtgggatatagaccttgccaatatcgtgtagatagccggctatctgtatttgctgacaggtgggctccggcagctgcatccagcgggcaagctggcgggcgatttcccccaccatgatgctatgggtggcggtaaagctactgtaggtgtcgacgattttggcaatcagcaggcagacatccttcagaccgtgaatatccagatagcgcgtgttgatggggccaataatctccagcagccgctgaatatggccggggtgaaggtgctgccagaagttcgcattttcagcgacctcgcacaggatatcgcagagcggcggatcgatctcccgatgcaaagcgacgaactgttccaccaccgcccgcgtgggccaggcggcaacgtggcgatcggccggcagcagccgttcaaaggcatcagcaaaatagacaatgtgctgttcgcgggagccccggtggttcgggctaaaatggtgatcgcgaataaagggaacgatgggctggaaggtcgctaatccctccagcatcgccacaccctggcgctgatgcgggtcgtggatattatcgatagcatccagcgaatgaatggtgcgtttatcccccagcacgccgatatcgtgcagcagcgcggcgcaaaaaatggtctgctgccgttcgtcaggcagttccagcctttgcgccagcgtcagggcgattaaggccgttcgttgcatatgccggtgcagttcagggttaatgatctggatgactctggtggtcagcatcagggccgacttcagggcaatacgcatctctgttctccgttcgcgtgacctggcgggcaaaaatgctctcgccggtgacggaagtgtcgataatctgatcgcaatgcgtgttgtgtgttgctgaacaggtaaatactcagaatgttttggttcatagctctgcccgtttcagatccagtggtgcaccagagttgggcgatatcgtcctaagaaccttattattgtctgatagttaaccatttcccccccagaaaagaaatgaattctggcaagccctttgcattaagcaagcgtaagtttgattaatgtctatgaagggagtgacctgtatgaattttagagcattacttgccattgcgttattgacgatgagcagcctggcgtttagcgagacgcgtcttccgcatattgttattttagccaccggcggaacgattgctggttcggcggccagcaatacccaaacaaccggctataaagccggggcgattggggtgcagacgctgattaacgccgtgccggaaatgagtaaaatcgctcacgtcgagggcgagcaggtggccaatattggcagtgagaatatgaccagcgatattattctccagctctcgaagcgggtgaatgcactattggcccgggacgatgtcgatggcgtggtgatcacccatggcacggacacgctggatgaaaccccgtatttcctcaatctgacggtgaaaagcaacaagccggtggtctttaccgcggcgatgcgcccggcgacggcgatcagcgccgacgggccgatgaacctgctggaagcggtcacggtcgccgccgatcctgatgcccggggacgcggggtaatggtggtgcttaacgaccgcatcggcgcggcgcgctttgtcaccaaaactaatgccacttcgctggataccttccgggcgcccgaggagggctatcttggtgtcgtggtgggcggaaaaccccagttcgagacgcgggtggataaaattcacacgctgcgctcggtgttcgatgtgcgtcagctgaaggttctgccgaaggtggtgattatttatggttaccaggacgatccggagtatatgtacgatgcggcgatcgcccatcatgccgacggtattatctacgccggaaccggggcggggtcggtgtcggtacgtagcgccgccggtatcaaaaaagcgcagcaggcgggcatcgtggtggtgcgagcctcccgtaccggcagcggcgtcgtaccgccggatgacagccagcccgggctggtggccgactccctcaacccggcaaaagcgcgtatactgctgatgaccgcgctgacgcagactaaagatccgcagctgattcagcaatatttccatacctactgatcctctgcggcgagggcgtttttcacaccctcgccgtgctttcttctcaatgacctggcttccatgcaaatcgatggcggatgattgcccatcattcactccacctgtgtttcccacgaggcgtaaaaaaatattttttattgtccggcgggcacagtatttcaatgcaccgcgcttattttaaaagcaggtttaaataagtctattcttaattgttgtcttaaagtcgttttaatcttttttatgctgacggattaaaaaagatgcatttcgcagtgggacgcgtttaatactcgctttgacagactacgatgcatcccaacgcggtcagaccgccgatcgcgcggctcagcggacgcctgccaccggcggccagggccgcactgcggcagctttcggttgttttcgttagtaacgctgatgattagcgtgaaaatgatatgcatgatgaatatattaagcgtggttcaagatttaagtttacatttagtaacatatgtgccgcaattatgtttttttgtcagcttgctgttttttacttgccggagggaatttcagcggattagtattgtcgaacttgctgtacgtaccgcctaatgatgataaatggattctgttttccttaagcgttaccacataattaatgtttacaggaaaaatcatggcctgcgtatttaataaacaacttttacacccgcgtaactggctgacctggttcgggctcggcatcctctggttaatcgtgcaactgccttatccgctgctgcattttatcggcaccagcgctggtcgcctttcccgtcgctttcttaaacgccgcgaacatatcgcccggcgtaatatcgaactctgcttcccggacatgtcgccagcggcgcgcgagacgctgatcgatcaaaactttatgtcgctgggaatggggcttatcgaaaccggcatggcctggttctggagcgacgagcgggtcaaaaaatggtttgatgtcgaggggttcgccaaccttaatcacgcgcttagcggtgggaaaggggtaatggtcgtcggcgtgcactttatgtcgctggagctgggcgggcgcgcgatggggctgtgtcggccaatgatggccacctaccggccgcacaacagcccgctgatggagtgggtgcaaacccgcggtcgcctgcgttcgaacaaagcgatgatcgatcgcaacaatctgaccggtctggtgcatgccttaaaatccggtgaagcggtgtggttcgcgcccgatcaggattacggtcccaagggcagcgtctttgcaccttttttctccgtcccgcaggcggcgaccaccaacggcacctatgtcctgtcccgcttatcgggcgcgaaaatgttgagcatcagcatggtacgtaagctggatcgccggggctatagcctgcatatcagcgaggtgatgaatgactatccgggtgaggataagcagatcgccgccggctatatcaacaaggttattgagcgcgagatcctgcgcgctcccgagcagtatctgtgggtacaccgtcgttttaaaacccgcccgctgggcgaaccttccgtctattaaccttcccgcacaggctgcgctttcaaaatcccgacagttggggtaacgtgagccggatcatgttttagtcgtgcgcgaaggagtgcagagtgttcgctgagtttggtgttctgaattatttaacctatctggtcggggcggtgtttatcatcctcgttcctggccctaatacgtttttcgtgctgaaaacgggtattgcccacggggtgaagaaaggctatctggcggcggcgggcgtctttattggcgacgcagtgctgatgtttctggccttcgccggggtggcgacgctgattaaaaccacgccggtgttgtttaacgtcgtgcgctacctcggggcaatttacctgctgtggctcgggggcaaaatgctctatgcggtgctgacccagcgcgacggccagtccgacgccagcgcggagccggcgagcgcgatcctcaagcgctccctgaccctgagcctgaccaatccgaaagcgattctgttctatgtgtcgtttttcgtgcagtttatcgatgtcaacgccaaaacccccggcgtggcgttctttatcctggcgctgaccctcgaggtgattagcttctgctatatgagctttttgatcctctccggctcgtttgtcacccgctacgtcaaaacccgcaagaagctggctaaacttggcaacagcctgattggtctggttttcgtcgggttcgccgcgcgcctggctaccctgcagtcctgatccccacgggccggttacccgctgaccggcccgccgtctcttattctgccctgtaacaaaaacccttcattttttattgcattggtgttacatatacagccgtttatcgctcagcaaaaaggaagccccgatgattctgcaaaaactcctcagcaataaaaactgcaaaaaatactgtctgtcgctcgcggtggtgtttgctatcgcgctggcggtagtggggcgggcgaccttcgggggcgtggtgagcgagtacaatatgccgtactcagagtggacgacgtccatgttcttcctgcagggggcgatggtgacggtttacagcattgtctttaccgcgctcttcgctatccccctcggctttattttcctcggcgccgatcgtcaggattaagcgtcaacgggcgaaccgcggttcgccctgtcttatcggcttatcaacagcgtgaagcattagtcgtcgtcatgatagtgatgatggtggtggtggcgatgggggtgatatccatcgtcaataatgcatcccgataacagcgtgcacagcgcaataatcaacggtaacacgatcggttttttcatccttacttctcccgctattcttattccccggggccgagaatgccgcggcggataacgtgagtgtaaagggttaacttattgatgggataggataactccgcaatatcgccgcggcgatcaccaccagccaaactgggtgccggccaccgccacgatggcgacgaccagcatgataatggtgctttttttcattatgccccacccggcgccgcatagccgccgacaaaaaaccagccgagaaagacgacggcgatgataaagatcgccaccgggaaaagaatacccaatttcatgattgtgtccctgtgcccacgaatgatgccctgcatgatactggatatcgcggtactttagtcaatatgaatgaaattctcctggcggcgggacttcttatcctggtacatcgcctcatcggcagcgcgtaaggccgcttcaacatcgatactctgcggatcgcaggtgaccaccccgaagctggcgccctcatagtcgatacgctgttcgccgaggaagtaggcgccgcacagagcctgacgcagggacgtgacatacgcctgctgtgcggcaggctgctgggcgctaccgacgatcaaaaactcatcgccgccaaggcggccaacgatatcttcccggcgcgcgacagcggtgagtcgtttgccgacctgcaccagaaagctgtcgccgcacggatggccgaaccgatcgttaatggctttgaaaccatcgagatcgataaaaataagcgagacctgctgctgctgggcgcgggcggaggcaaagcgtaacgccagctgcttaaacagcgcgcggcgattgggaagctgggtgagctcatcggtagacgagtgcagctccagcgcgacgtttgccgcctgcagctgttgcaccagggtgtctttttccacgtagtgggaaatgagcttcgcaaacaggcccatgacctgttcgccttcgaggttataaggctgttgttgccggctggtggcgcagagggtgccgaacagagagccgtcggccaggcggacgggaatgcttaaaaaagtagcgattcccagctcctgggcggcgatgcaggagtgccagcggttggcaacgtcattgctaaacgtacactgatcctcaagggcgcgtttgcacagggattcatcccaggggacggaaaatccttccgggatctgcatttcgctgctgttgtgggcgaacatgatctgctgccgctgggcgttggtatcaatgcgggtgaggtaggtggactccattcgcgttaccgcctccagcatctccagcagctggcgcaccagggtttccagggactgttccgcagcgagggtttgcgacacccgggcaagaataaaatctgacatgaataatacagctccagcacgccaaacgtcaccccagcatattgggctgcaaacggacatcagcgtcaaataaacagtgatatttttaaatttatcacatctgtctggggaatacttgtccacgcggtgggaaaaaaagccccgtcgggggcgacggggaaaaactcattgattatggaatgatctgttctctggtcagttcgagaacagggctactctacgggggaaaagtgcaggcaagatggagaaaacgtggagattcaggctaaaatccccgggcattcaggaaagggaggaacaatgaaaaagctactggctattctgccactgttattagccggctgtgcccagccgcagcccactgcgccgacgaaaaccatcggcatgcccaaccccgcggcggtatactgtcagcaatccggcggcacccgggtgccggtgcaaacgccgcagggcgtcagcacccagtgcaaactacccagcggcgaaactctcgacgagtgggcgctgtggcgccgggatcatccggctaaatcgtaaccggcagggccgccagccaggcggccaacacccgggcatgattctgctcggtgttcttcgcggcgtacagcagcgtcagcggctggcgttgcgccagcgccgccagccgcaggcccgtttcgcgatgggcgtcgagctcctgacgatagcgctggctgaagtgggcgaaatcgatcgcctcgccgtgaaaggctttgcgcagctcagcggaaggcgttaactccttacaccactcatcacaggccagcgcctcttttttaatcccccgcggccagagacggtcgaccagcacccgatagccgtcgctgctttcctgcgggtcatacacccgtttacactgaatcatcatcctgctccttctgtgccatccaggcgagcaactgcgggatttgcccgtcggaaaataccgtgatgccgtgggcgcggagtaggtcggcggccacgccggcgcccgctttgcgccgtccgcgaaaggaaccgtcatagacatactggctgccgcaggtagggctgccgtcggtgagtaacgctgcctgacagcccgcttcccgggcggcgctgagcgccagccaggcggccagctgataatgtccggtgacgtcgcggccgtcgctttccacgatccgcgcccgtccggcaagcacatcgccgcccgtgccgccgaggatctccgccggcagtcggggcgtaggcagaccggccgccagctccgggcagtggatcaccagccgccccgcctgctgccagcgggacagcgtcgccgccagctgtgccttctcactaccgttataccgcacctggaatcccatcaggcaggcgctgaccaaaagcttatttttcattctctctcccttacgcgctttttccagtatacctcacccgtcggccacggcggtggggtgaaaataaggattgtgttccacaggtgggatcgctattctgacgtgccttgtgctgtccgtctcgtccagacataaggaacctgctatgaaaactcctttacgcctcgcccttgtcggcgattatcaccccgatattgttgcccatcaggccattcccctggcgatagacgatgccgccgccgtgctggagcagccggtgaaatatgactggctcgccaccccgtcgatcgcctccggcgaggcgctggcggagtacgatgccatctgggtcgttcccggcagcccgtatcgacacccggaaggcgcgtttaccgcgatccgctatgcccgggaaaacagcattcctttcctcggcacctgcggcggctttcagcacgcggtgattgaatacgcccgcaacgtgctcggctggcaggacgccggacatgcggaaaccgacagcgaagggcggatggtgatcgctcccctcagctgctcgctggtggagacctctgccgtcgtcgagctgcgggcgaatacgctgattgcccgcgcctatggccgggagagcattgaagagggctaccactgccggtacggcgtgagcagcgcgtttgcggcggagctggagcagggcgatctgcgcgtcaccggctgggatgaagagggtgagatccgcgccgtcgagctggtgacgcacccgttttttgtcgccaccttgttccagcatgagcgtcacgcgctggacgggcgtcccgcgccgctggtgcaggcgtttctccgcgccgcggcacaataattccaccggcagcgggcgctgccggtcatcttcaggggtgaatttcccggtcacgtccggcgagcgcgccgcagaccgccatcaccagcgaaatcagcgccaccgccagcagcggaatatgccagtcgccattggcatcatggatcctgcccatcagcggcggcccgcaggcggccagcagatagccgacgctctgcgccatccctgacagcgccgcggcctgatgcgccgagctggcgcgcaggccgataaacgtcaggccgaggatcatggtggctccggagccaaagccgaacagcagcgtccagccgatcgccagctcaggcaacagccacagcccggcggcgctgatggcgcacatcagggcgaccagcaccgcgatcccgcgctggtcgcgcagccgatgcaggatcagcggtatcgccaggccgggcgcggcggtcgccagctgcagcaggccatgcagcgagccggcctgcgcttcgctatagcccatactctgcagaatcgacggcagccagccgataatcacgtaatagaccagcgagttgatgccgaggaacagcgtcacctgccaggccagcgccgaccgccagatcccccggttatgcatagcgcctgagccggtcaatggcgtctccgcccggcgccgggactgcggcagccagctgaggagcgccagtagcgggaagaccatcagcagcagcagcgccccgcgccagccgaatccggccatcgccacggggaccaccagcgccgaaccaagcgccgccgcgccgcccatcgtcagggaataggcgccggtcatccgcgcgacatgttgcgagaaatcccgtttaatcagcccgggcagcagcacgttacccagcgcaatgccgcagccgattaccgccgtgccgataaacagcagcgcagcggagggcagggagcgcagggcaatgccggcgcagatcagcagcatcgccagcagcaggctgcgttccatgccgaaccggcgggcaacccctgccgccagcggcgagacaaggccaaaggccagcagcggcagggtagtgagcagcccggtctgcgcggtggtcaggccatagtcgctacgaatcgcgtccagcagcggcgccgcgccggtaaagaccacgcgcagggtggtggcgatgagcaggataccggcaatcagcagcgcggggcggcggccggtagaggagatcacagaagacatatcattctcaaagtaactaacgaggggggttacgatagcggctttgtccctcgtttaaatcaagctaaaatgacagattatcgctaatatcggacaatatgatgattggactggggctggatggctatgaaccggacagtggccacgaatcggccattgcctttcgtatccgggtggtggaggcggagcagtatattccggcgcattcccaccgtaaggggcagctgatccttgccctgcacggcgccttgacctgcgaggtggagaacgcaatgtggatggtgccgccgcagtatgcggtgtgggttccggggcagctgtcccacagtaaccgcgctacccccggcgcccaggtatgcttcctgttcatcgagccgggcgccgcgccgatgccggatcgctgctgtacgctaaagatttccccgctggtgcgagagctgatccttactctggcggagcgcggcggagagtccctggccgcccccgccacggcccggctggtgcaggttctgtttgatgagctgccccgccagccgcaggagcacctgcagctgccggtatcaaaccacccgaaaattcgtcaaatggtgacgatgatggctgaggatccggcgcgctggcagaccctgagccagtgggcggcggtgtttgcgatgagcgagcggaatctggcccgcctggtagtgcgcgaaacggggctgagctttcgccgctggcgccatcagctgcagctgatcctcgcgctgcagctgctgatccgcgggcagacggtgcagcagacggctcaggcgctgggctacgattccaccaccgccttcatcaccatgtttaaaaaagggctcgggcagacaccgggccgctatcacggtagcctggctacgacttcccaataaacaatgagatgatcccggcggcaatcagcggcccgaccgggacgccgcgaaacagggcgacgccgagtactgtaccgaccagcagcccggccaccagatgcggctgggagcccatcagggagacgccgcgcccgccgagccacgaaacaaacaccccgaccgcaatcgccagcagcgatttccagttcataaaggagtggatcagcgtcgagggcggcagcgtgccgctggcgataggcgccatcacgccgatggtcagaataatgatcccgacggtcagtccctgtttctcaacccagggaaagaaggcgttcagcggcgtgacgcgcacgataatcagcacgaggatggagatcgccacggtggtgttatgactgataaagccgagcgccgccagacccagcaggatcaacagggtggtatcaaacatgtacagaggtccttgccaaaataagaatgccaaaaatatcccgcttactctacgcatcgtggcgtgaataaacaggatttttacgccatgcggcggaaatctgggcggatgcccggttagctaagacggcgaaaggtcgcgatctctggtcgggcgatatgtaaatagtcttcggtgtcgagaatgatcgaccggtccaggcgcccggcgttaaaggcgatttgtggaaagcgttcaaacagcagcgggtccgccaccagccgcagcgccggatggaaactgaaggggggaatggcgccgaacacgcaggcggtgagggcatccacctccgccgggctggccagcgaggctttgctgccgccgatatgccgggccaggctggcgaggtcggcctgccgatcggcggcgaggatcgccagcacatgctggttgacgccgtttcctttcactttacagactaacgctttcgcgccctggccaagcgcggtgccgcggattgccgagacggcttcgcactgaccgaccgcctcgtgcgccatcacccggtagcgggcccggtgctcgtcgagcagcgcgcacagccgctggtggatattaccttctactgcttcaagcatagcgtcctcctgacatcataaagcagccagcttagcgctgttgcgccggcctgccaacggtgggccgggaaattcaccattcgctcattattacttcacagtgctgtggtgcaatcccgcaggcgcagatgagttttgtaaataaaaaaaagaatgattttcattttcaatcgaactttttttatttcgctcagtctctatcggacgacacagaatattaataattgccgtaatgaggttaggatgatgcacgatgcaaccatgcagggttccccacgcaagaaatttaataaaataagggagctcaacagacggcggaattactttactaagaaagtacgtaatgccctgcgggtgggggtggcgaaagcgctctgggatcgccgacgccgtcagccggtagatttgtcgtctgcgaaaaccgtcctgttgatgcgcaatgagggggcggtcggcgatgtagtggtggattccgcgctggtgaaatgcctgcatcagtcaggctatatcgttgattttttgctgacgacctctaacagccaggtgatgcgttataacccgcggatccgccatatttatgaagctgacccggtcacgtccgctgattttttgcgtaaatttaatcataacgttcctcgcgacgttattaatgaactggctaataataagtacgatattattattgacccttcgctgttcgatattcccgtgcatcgcctgcggcttttccgacaaataaaagccaaatcagtgctcgggtttaataaatggccatcgattaagcactactcccactcttttgattttgactgccagcgctggcacgtgacgaaaacgttcgagctgatcgccgattatctccaactggacacccgcgggctggacgcttacgacctggcggtgcccgggccgattatgcaggaggtggcgcagtatctggcgtcgctaagcggaaaagcggtggtgattaatatttttgccggccatgccgaccgcagtctctcgcagacgcagctggcggaactgctcgacaaactgctggcccgccacccggggagcgcggttattctgctcgatcaccggcgcgagatccgcatcccgctgccgccggaggtggtgataaacccatttaacacgttacaccatgcgatggcgctgatcgcccaggcggagctgattatctccccggacacctcggtggtgcacatggcggcggcgtggaacaaaccgctgatcgcggtctataaggacgttctgcttaataaccggctgtgggccccgggctatgacaacgccaggcagatcattgttaaatgcgggaaggtccatcagcatcgcgggctagtggatagaattatagcggcgctaccggagacgctgtgaggcgatgaggggagacaggtagggctcacctgctggccgtatgcaagagccagcaggtgagcgaaggttgcattgccagtctgcaaccgccgctattgtactgttgcccgcggctctgccacatccgggaaagctcttaaagaggtggtcgccgcgactgacgggcgggatcactcttcagtgagccacatatccgcctcttcaaacatctcctgcaccgtgcggctgatcagctctttttcatgcttgctggcgtcggtgttgatcgccggcagcgtcatcatcggcttcacccgcacttccgcctccgggaaaatgcgctgcatgcgtttggtcagctcgttaagaatggcctctctggcgcccggcagcccggcaaaattgcgcttgtcataaatcagttccacaaacatcttctgtcctctgtatgctgatcgcgggcgatagttttactgtattaatgtacagtgtcaagcgaatgccgcggcgctgcgtatctaccacctcgcgcggcgggcgggctgcgcgcaaaagcagcaaacggttcgctggcgctgaagaagacccctattgacatcaaggagttatttcagtgctggcgattgatagctggagccgatattgaccggtaaaactggcaaaactactgtatatatattcagtattgtgtggtgggttgaaaaatgaacgtttacacgccggttgagctacgtcagattgtctcctttcccttttttgccgacctggtgcagtgcggctttcccagcccggctcaggactatgttgagaagcgaatcgacctcaacgagctgctggtgcagcatcccagcgcgacctattttgtcaaagccgctggcgacagcatgatcgatgccggcattgacgaaggcgatttgctggtggtggacagcgcgcgtaaagcggagcatggcgatatcgtgattgccgccgtcggcggcgagtttacggtaaagaagctgcagcttctgccgcgggtgcagcttaacccgatgaacccggcctattcgcccatcgtggtcggccgcgaggagacgctcgatattttcggcgtcgtaacctacatcatcaaggcggcgggctgatcatgttcgcgcattgtgatgtgaacgccttctatgccagctgtcagaccgccttccggccagacctgaaggggcggccggtggtggtgctgtcgaacaacgacggctgcgtgatcgcccgctcggcggaggcgaagccgtttgtgaaaatgggcgaaccctactttaagcagaaggctgcgtttcttcgccacggcgtcgtggcgtttagcagtaattatgagctgtatgccgacatgtccagccgggtgatggccaccctggaagagctcaccccgcgctgcgaaatttacagtatcgatgaggccttttgcgatgtcagcggtgtgcgtcattgtagagatctgaccgattttggccgcgaaatccgcgccacggtgctgcagcgtacccatctgacgctgggcgttggcatcgccccgaccaaaaccctggcgaagctggccaaccacgcggcgaagcagtggccgcggcagacgggcggggtagtggacttgtcctgcccgcagcggcagcgaaagctgatggcgctgctgccggtgagcgaggtctggggcatcgggcggcggatcggcaaaaagcttgaagcgatggggatcggcacggtactccagctggcggagagcgatatccgctttatccgcaagcacttcacggtggtgctcgaacgaacggtacgggagctgcgcggcgagccttgcctggcgctggaggagtttgcccccgctaagcaggaaattatctgcagccgttcgttcggggatcggattacggcctatgaggatatgcgccaggcgatctgcagctatgccgcgcgggcagcagaaaagctgcgcggtgagcatcagtactgccggttcgtctccgcctttgtcaaaaccagccccttcgcgctgaatgaaccctattacggcaacagcgcctcgctaaagctgctgacgccgacccaggactcccgagatattatcgccgcggcgacgagctgtctggatgccatctggaaagcggggcatcgctatcagaaggccggcgtgatgctcggcgatttctacagccagggcgtcgcccagctgaatctgttcgacgagcttgctccgcggcacaacagcgccagactgatgcaggttctcgatcagctgaatgcgaaaaacggcaggggggcgctctattttgccggccaggggatccagcagcagtggcagatgaagcgagagatgctctcgccgcgctacaccacgcgatacggcgacctgctccgcgtcagataacgcgcgctatccctgcaccgcggccggaaaaaccgccgccagccagtcaataaagacgcggagccggggcgggacgtgccggtgccgggcatagacaacgtgaaaaggatagggggccgggcgccaggcgctgaggatctccaccagttcgccgctcgccagcgccggtttcagcgaataggtaaaggtctgcacaatgcctaagccggcctcgccggcggcaatatgcgcgttgctctcattgatgccgggatggggctctgtcttcagctcggtgctgacgccgtgacgcgtaaagcgaaacggaaacgctctgccgctggccggcgacagatagctgatgagccggtggccatgatgtagttcatccggcgaggcgggggtgccgtagcgctgaagatagcccggggtggcgcaggtgaccagcgtcgcctcgccgattttacgggcgatcagcgtcgagtcttccatcggaccgccgcggatggcgcagtcaatattgccgctgatgaggtccgcgggtttatcggccacctgcaaatcgatatggatatccggccaggaggtcataaagtccgccagcagcgggatcagcacatcgcacgcggtcgacccgccgatggcgatccgtagatggcccttcggcttattgcgggcggtattgaacgacgcgtcgatctcttccaggtcttccagcagacagcgggctttttcatagtactcccgtccttccggcgtcacggtgatacgccgcgtagtgcgctgcaggagggaaaccccaagatgcgcctccagttgctgaatggttttgctgagggtggcgttgggcatattcagcgagtccgcggcgcgggtaaagctgccggcttcgacaacgcgggtgaaggctttgagagctgaaaaccggtccattattcgctttatcctggttactggaggtcattatccaccgaggggaagagtgtttttcagattaggccatttttccgcctcgccgggacgattacagtgctttccatacccggcggggcgcgttcgcgagcctggcctgtttatactctaaccaaggaaatgcaccatgagcaaaaaacttgcggataaagtggcgttagtcaccggcggcagcgccgggattggcctggcgtcggcgaaagcgctggcggagcagggcgcgaaggtgtacatcaccggccgccgtcaggaggagctggatgcggcggtaagattcatcgggcccgccgcccgcgggatccgcgccgacgccgccgtgttaagcgaccttgacgcggtatttgcgaccattgccgaagagtccggccggctggatgtgctgttcgccaatgccggcggcggagacatgctgccgctgagcgccatcaccgaagcgcacgtcgaccggattttcgccaccaacgtgcgcggggtggtgttcaccgtgcaaaaagcgctgccgctgctcgccgacggcgcctcggtgattttgaccggctctacggcggcggtaaaagggacggctaacttcagcatctatagcgccagtaaggccgcggtacgcagcctggcgcgctcctgggcgctggaggttagcgaccgcgggatccgcatcaatgtggtcagcccggggccggtacgtaccccgggtctgggagggctggtggcggaggcggaccgccagggcttgttcgatgctctggcggccggcgtaccactcgggcggctgggcgagccggaggagattggccggacggtggtatttttagcgtcggatgagtcgagctttattaacgccgcggagatctatgtcgacggcgggctggcgcaaatctaaacgcctgccgtcgccgcaccgatctgaccgggcagaggcgctttcagcagggcgatcagcagcgtactgcccaccatgatccccgccgccagccacaccattcccgacaggccagctgaggcgatcagctggccgccgacaaacgccccggtgccgatggcggcattaaaaatggccacataaatggctgacgccggctgggcgacagcgcccgcgctgcgcagcagccaggtctgtaagccgacgaacacaatcgcgatgccggcgccccacagggctaacagtagcccgctaaaacagaacggcagtggcgcaagacgggcggcgccaaggagcgccagcgcgcccccgctcagcagcagcgcagcgaaaatcagccccttcagatgacgatcgataagcttacccgcgataacgttacccagcagcccggaaacccctgacagcagcagcaggccggagagggcggtcgccgggactccctgcagatttatcagcagcggttcaatgtaggtgaaggcggcaaagtgagcggtaatgatgcaggccgtggcgccatacaggccaccgagcagcggattgcggaagatatcgcgataaacacgcagcctgacgggggcaggggcggccagcgggggcagcgtcgagcacagcaccgcagcggcggctagtgacagcaaggccatcgacataaacgcgagtcgccagcccgccagggtggcgataaagctcgccagcggcacccccactacgcttgccgctgacacgccgccaaaaatgatcgccgtggccagccccagccggtgcggcggcaccagctgcgcggcgacaatgccaattaaggcccagaaggcgccatgcgccagggcgccaatcatgcgggcgctcatcagggcgaacatcgaataagaccgggttgcggcgaggcaggaaagcgcgaggatcagcatcagcccgaccagcagcgccttgcgggaaatacgcgccggcattgcgccggaaagcagagccgccagggcgcctacccagccataggcggtgacggcgaggcccacgccggattccgtctggtgaaaatccgccgccagggcgctgagcatgcccaccggcgccagttcgctggtgacgatcgaaaaggcgcagatcccgagcgcaacgacggcaatccagacgcgcgcctgcgccgggtggaggggtaaagcaatctctttcatatcaggcgtatccttaggaaaggagcgttccgcgcggtgcacggacgttcaggtgaggagagagcaggcgatcggatggcctggttgtctccgtgagtggcgtgcagtatcatccctgcaaaattgataaaaaagagcagaaaacggagatccgttttccataaacggaaaagagatgacagcagaatttcattgggatgatgcgcgcatcttcctcgccatcgcccgggcgggaacgctgagcggcgccgccgacaagatgaacatggggattgccacggtctcccgccggctggatcggctggagcaggcgttgaacgttccgctcttcagccgccatcagagcggctaccgcctgaccgacgatggcgaagccctgctcgcgcgggcggaggcgctggaatacgctggcctggcgttcggcgaagcggcgcaactgcaggggcatgtcgccggggttgttcgcctggccacctcggataacctggccacgcattttattctgccctccctgaaagggctcctggaccattatcccgagctgcgggtggaggtgctgagcggcgtgcagccggtgaacctgcaccgtcgggatgccgatctggcgatccgcatggtcaagcctgaggccgggcatctgacgttaaagcggctggggacggtggggtttggcgtctatggcgccgccgactgtctggccggcgcggacggcctgtcgctgagcgaggcggactttgtggggtggccggaaactcaccagcacctgccggccgcccaatggatcacgcgcaccctgcgcggccggccgtgtaaagtcgaagccaatacgctcgtggcccaggtttccgcagtatccgcgggcctcggattgggcgtcctgccgcactttatggcgcgggccagcggcctgcagtgcctgcagccggagatcggcgcggatcagaccctctggctggtgatgcattctgacctggccggatccagacgcgtgcgggttctcgccgaccatctcatcgctctctttgcggaccatcaagatcggctggcgatgccctgaaggggcgcggcttgggcgtgtatcgataagactgcccgaggctgacgagccacgattttctccgcgccagctaacagtgatactcgccgcgcaatattcggcccaatgctgccccgcagtcgaaaatactgcagagtgagaggatatccccgtccggcaaaataattttgtgttgtggccagcgcggcattgttgcgctcccccagaaatgcctgtcgatgttagggtgagacgtttatcaccacaggagaacgcaaatgattgtcaggacctggcacggctgtgtgccattgcaacatgctgaggggtttgcccgccacctcgagcggaccggcgtagaacacgctcagagcatcgccggcaaccggggggcgctggtgcgccaggaaaaccagggcgaatgggcgcatttctttcttgccacctactggcaggatctcgcggcggtcaaagccttcgctggcgaagactatcacgtcgcggtcacctatccggacgacgaagcattcgaactcctctccgacccctatgtgtttcagcatgaagtcgaggccgtgtcgccgctgtaggctgatgaccgggcaggtggaagattggccagcagcaggcggttgctggccgcgtgagagcgacgtctaccttgtatgggcagccagccgccgctgggtgaacgtggcatgatgggaacactcagcgcgtgagggccgcgacaatggaggcttccattttctccggcgtcgtgaacggcgcaaaacgcgtgaggggtgtgccgtcgcgaccgatgaggaacttggtgaaattccacttgatccgtccgccgagcacgccgggcaacgcttgtttcagataacgaaacagcgggtgtgcggcggggccgttgacgtccactttctcaagcatcgggaagctcacgccgtagttaacgtgacaagtctgctcgatttcatccgcaccgccgggttcctgcttaccaaactggttgcacgggaaaccaagcactaccagcccctgagccgcgtactttttgtagagcgcttccaggccagcgtattgcggtgtgaagccacaatggctggccgtattcaccaccagaaccaccttgccagcatagtcagccatggcgaggggctggccgcgcaggcgggtagccgtcaattgataaaaaggggtcatagcaggctcctgagagtagaaacagttcaacgctgacgatcgcgcgaatgtttgaagcagattaggcagttatgatacacagggttagggatttgtacctggagtgttaaaaaacgccagatgtcatagagaaaatcgcgaacaggaacggctgaaaataatgaaatatgtcttatcgctggtggtggtggcgatactcgcaggatgtaccagcacgccaaacttgccgcctcgggataccattgtggcgatgaaacccacagagtccggtattgtcgccagctcagcgaaatacagttactgctttgtccgtgacggtgtgcctcaggaatatcagcgttataagaccttttatgaacgctttcaccaacaggcttccggcgtgcgggttaactttgtcgtggaacaacatgaggtgacggcggaatatctggtggtgatggatcagcgcaaactggatgccgggcagcatagcgagctggtgaatcagtatcatgcggtgcaaattgataacgatcgcctcggggtgttgtttaaagcgacaggattttggactgcatcggacgcgtcagatctggccgccgcctaccagttagcgcaccccgttgtggtatcaatcaatgataagaccaaaacgattagctcgcttggcgccgttgccctggccccgttgtttccgttttacatgatgtatggatgtgccaccgggccttgtgtctgaggaaaacagccagcaagtcactcgactcactggctgagtatttaattaagcttcacttttagatgactgcttgtgaaacagttcgcggaataccgggtagatatcctcctggtcgcgaatatgctgcatggcgaaattatcaaaggtcgcctgcaggtgttcatactcgcgccacagggtctgatgcgcccggcgggtaatttcgatatagctgtaataacgcaccaccggcagaattttcttcgccagcagttcgtggcacagcggggagtcatcggcccagttgtcgccatccgacgcctgggcggcgtagatgttccactgcgccgggtcatagcgggcctgcaccacttcatccatcagcttcagggcgctggagacaatggtgccgccggtttcctgagaatagaagaattcgtgctcatccacctcttttgcctgggtatggtggcggatatagaccacgtcgacgtttttataagtccggctgaggaacagatacagcaggatataaaagcgcttggccatgtctttggtggcctggtccatcgagcctgagacgtccatcagacagaacatcaccgcctggctggaaggctccggccgtttttcgtaatttttgtagcgtaagtcaaaggtgtcgataaacggcacccgctctattttagcccgcagttcggcaatctctttgcgcaggcgctcctcctccagcagctgcaccggttcgctgcggctgatggcttccagatcctcctccagggcgcgcagttcacgacgcttgccggcggtcatcgccgtacggcgggccagcgagttctgcagtgaacgtaccacgctgatgttggctggcaccccattggaggtaaaacccgcgcgatgggttttaaactcattcagctgccggtgctggtttttcttcaggttcggcagggccagatcttcaaataacagatccaggtattcatctttcgagatctggaagacaaactcatcctttccttcaccatcggcgctggcttgcccctgaccgctaccgccgccgccgccaccgccctgcgggcgctcaatgcggtcgttttgcacaaaatggtcgttgcccgggtggacgcggttgcgcaggccgccgcgaccctgatgaaacatcggctcgttgatatcgtccgtcgggatcgagacggattctccgctctcaatatcggtcaccgagcgcttgttgatggcctcggagatcgactgtttaatctgcgccttataacggcgcaaaaagcgctggcggttgacggcgcttttgtttttcccgttcaggcgtcggtctatgaaccaggtcatatgccctcctgtactgcattagccaactttacttatcatcattcagctgcagttgacccggcggcgtgccgccgggttggacgcatcaggacgatttacgaacccgcaggtaccactcgcacagcaggcgaacctgtttgcgggtgtagcctttctccatcatgcggtcgacaaagtcgtcgtgttttttctgctcatcggttgaagttttggcattaaacgaaatgaccggcaacagctcttcggtattggagaacattttcttctcaataaccgtgcgcagtttctcatagctggtccagttcggattacgtccgctgttgttggctctggcgcgcagcacaaagttgacgatttcgttacggaagtctttcgggttgctaatcccggctggcttctcaattttctccagctcggcattcaacgattcacggtcaaacagctgcccggtgtccggatcgcggtattcctgatcctggatccagaagtcagcgtaggtgacatagcgatcgaaaatgttctgtccatactcggagtaggattccagataagcggtctggatctctttgccgataaactcggcgtatttcgggatcagatagcctttgaggaattccagatagcgctcggcctgctcctgtgggaactgttcgcgctcaatctgctgctccagcacatagaacagatgcaccgggttagcggccacctcgacgtggtcgaagttaaatacccgagacaggatcttaaaggcaaagcgggtggagagcccgttcatcccttcatcaaccccggcgtaatcgcgatactcctgataggacttcgctttcgggtcggtatctttcagactttcgccgtcatagacccgcatcttcgagtagatgctcgagttctccggctctttcaggcgcgacagaatcgaaaagcgcgccagggtttccagggtgcccggggcgcagggcgcatgggtcagctcactgttgttgagcagtttttcatagatgcggatctcttcggagatacgcaggcaataaggcaccttgacgatatagacgcggtcgaggaaggcctcattgttcttgttattacggaaggtcacccattccgattcgttggagtgagcaaggatgatcccgttaaacggcagggcggagatcccttcggtgccgttatagttaccttcctgggtggcggtcagcagcggatgcagcaccttaatcggcgctttaaacatctcgacgaactccataatcccctggttggcgcggcacagcgcaccggagtagccgtaggcgtccgggtcgttctgcgcatagtgttccagcttacggatatccaccttaccgaccagcgctgaaatatcctggttgttttcatcacccggttcggttttggcgatggcaacctgctcgagaatcgatggccagactttaaccacgcggaatttagtgatatcgccgccaaactcgtgcaggcgcttggccgcccacggcgacataatggtgccgagatagcgggtcgggatgccatactctttctggaggatctgcgcatcttcctgcggattgaacaggcacagcgggtgatcgttgaccggactgcgttcgccgttggcgctcagcacatagatgggcacgcgctgcatcagcgctttcagccgttcagccagcgacgatttaccaccgcccaccggccccagcagatagaggatctgtttcttctcttccagcccctgggcggcatgcttgaggtaggaaacgatctgctcaatggcgtcttccataccgtaaaactcttcaaatgccggatagcgtgcgataacccggtttgaaaagagacgggatagccgcggctcgagagccgtatcaaccatgacgggttcaccaatggccatcaacagacgttctgccgcattggcataggcactgcgatcttgccggcagatggtaagaaactcctgcagtgtgaactcttcgtccttggcagcttcgtagcgctggcgatagtgatcgaatatattcatggcatgccgtcctttcgttttttagcacaggttgagagccgttcatatgaatagtgggggcccccggaagacataagctgaacatcgctctcctggtatccagcaacccttatgccaggttgcgggtggggtagcgtgaatgtgcccggcaattacaccttctaaatttaagcgtagatgcatttagaaatcttgcatggcgcagaaaatcaatttcaatgacatatcaataactcatcctgaacatgacgctttttgattcgttgggacgcaaagttgtcatcgggctgtcaccggatggtaagagaagggtggcaaagtgaacgatttgtgtcatatcgggtaaagaatttgaggcatgagacctacgacggtacactgcacgggctgattatttgacaacgggaatatggattgtgactaaaatcaaacttctggcactcggcgtgctgatagcgacgtccgccagcgcggcgcatgccgacgggaagttcactcttggggctggcgtaggggtcgttgagcatccgtataagcaatacgatgcggatgtctatccggtgccggtcattagttatgagagcgaaaacttctggttccacggtctgggcgggggttactacctgtggaatgacaccaacgataaactgtcgattacggcctactggtcgccaatgtacttcaagccgggcgacagcgacagcgagcagatgcgtcgactggataaacgtaaatcgaccgtgatggccggtctttcttatgtccacaacacgccctatggcttcctgcgcacgacgattgccggcgatacgctggataacagcaacggtattaactgggatctcgcctggctgtaccgttacaccaacggtaacctgacgctgacgccgggtattggcgtggagtggaacagcgacaatcagaacgaatactactatggtgtctcccggcacgagtcgcgccgcagcggcatgcgcagctatgacccggacagtagctggaacccatatctggaactgtcggctaactatcgcttcctcggtgactggagcgtttacggcgtggcgcgctacacgcgtctgtcggatgaaattaccgacagtccgatggtggataaatcctggagcggtctgatctccaccgggatcacctacaccttctgattgtgcattcttacagtgcgcttcatgcatcaaaacagggccttgcgccctgttttgctttatggtggtgcatacggttaaggaggagaagatggtgaaaaaaacagtacgcttcggcgagcaggaggcagtgccggccatcgggctgggcacctggtatatgggcgaacatgcggcgcagcgtcagcaggaagtggctgcactgcgtgcgggcatcgaccatggactgacggtgatcgatacggcggaaatgtacgccgacggcggggcggaggaagtggtgggccaggcgatccgcggtctgcgcgaccgggtagtgctggtctccaaagtctatccctggcatgccggcaaagcggcgatgcaccgcgcctgtgaaaacagcctgcgccggctgcagaccgactatctggacatgtatctcctgcactggcgcggggatatcccgctgcaggagacggttgaggcgatggagaagctggtggccgagggcaagatccgccgctggggcgtctctaatctggacaccgaggatatgcaggcgctgtggcggacggcggatggcgagcactgtgcaaccaaccaggtgctctaccatctcgcatcgcggggcattgaatacgatctcctgccctggtgccagcagcacagtctgccggtgatggcctactgcccgctggcgcaggcggggcgcttacgcgatggactttttcagcatagcgatatcattaatatggctaacgcgcgggggattacggtagcgcaactgctgctcgcttgggtgattcgtcatccgggagtgctggcgatcccgaaagcggccagtattgagcatgtggtgcagaatgccgcagcgctcgacatcgtccttagtggggaagagctcgcgcagctggaccgcctctatccgccgccgcagcgaaaaacccggctggatatggtttaacccatcgttcacggcaaagaaaaacaaaagccccgttaccaacggggcttttgctattagcgttttttcacgctgatggtttgcgccaggcgagagggcgtctcttcgctggctttctgcggctgggttacgcagcaggtttcgacgcaaacgaaggttttgtagccatcgtccggcatatcgcccatgctgacggacagcgccgggcccgggttccaggccaccacattgtgctgatgatgatgcaccacgtcgatagtgcggtttagcgcgtcgtcatggatcacgctgcagctgtcggcgttgagatagacgcgatcggtgcggtcagggaaggtctgcacgccgttgctcagaacgccttcttcggcattgttcactttatcgatatagcgctcgccaagaccgctcaccttcaccgccgcgatatcgccgacgttgaaatagctgtgcagggcagaggtggtctcgaattcaccgtgggcttccagctcgatttcacaggtcttgcccagcttaaagcgggcatagagggtgaactcgtgcggccagagcttcatggtttcagcgctgtgctggagcgcaaaggtcaacattacgccgctgtcgtcttcgtcatgaccttccagggtccatggcagattgcgggcaaagccgtgcgacggcagaccttgctgcgcagaaggaccaaaccagggccagcaaatcggcacgccgccgcgcagggcgacgccctgtttaaacggggtgttgttgctcagccacagaacttcttcttcaccggcgggtttccaggagagcaggtgcgccccctgcagcgccacagaggctttcacctgcggatggtcgatgacaatcagctccaggtcgtccagctggcgacgggagatcacgggagaaatggtttcattcaccgggagagcaaaaattttatttatcattgtgcaatcctatctctgcagacaaaaaaaagagcgaccgaagtcgctcttacagattactttttcatctcaacttatttggagatgtgggcaatcagatccagaactttgttggagtagccggtttcgttgtcgtaccaggaaaccagtttcacgaagttgtcgttcagtgcgatacccgctttagcatcgaacacggaagtgcaaacttcgccgttgaagtcggtagaaacaacgtcgtcttcggtgtaacccagaacgcctttcatagcgccttcagaagcggctttgatggctttcttgatttcttcgtaggacgccgctttttccagacgaacggtcaggtcaacaacagatacgttcggagtcggaacgcggaacgccataccggtcagtttgccgttcagttctggcagtactttacctactgctttagcagcgccggtagaggacgggatgatgttctgagctgcgccgcggccgccgcgccagtctttgtgagacgggccatcaacggttttctgagtagcggtggtagcgtggacggtggtcatcaggccttcaacgataccgaagttgtcgttgataactttagccagcggcgccaggcagttggtggtgcaggaagcgttggaaacgatgtcctggccagcgtaagcgtcgaagttagcgccgcgaacgaacatcggagtgttgtctttggacgggccagtcagaacgacttttttcgcgccagcggtgatgtgtttacgagcggtttcgtcggtcaggaagataccggttgcttcagcaacaacgtcaacaccaacttcgtcccacttcaggttagccgggtcacgttcagcggtaacacggatttttttaccgttaacgaccagatgaccgtctttcacttcaacggtaccgtcgaaacgaccgtgagtggagtcatacttcagcatgtaagccatgtactctgcgtctaacaggtcgttgattgcaacgatctcgatgtcagaacgtttctgagcagcacggaaaacaatgcgaccgatacggccaaaaccgttgatacctactttgatagtcatatattccaccagctatttgttagtgaataaaaggttgcctgtaaaattacaaaaaccttacgcagcgtcaagcggaatcgtgtcaatcattgcgacaaatcaatcctgagcagacctttgcgcgattgatttgcctcactttccctttgagcccaattccatatgggggctgcgcgcggaattttaaagggcatttaagataaaaacgtgatttaagtcacaattatctggctgcctgtgggcaccggataagtttagaacaaaagtgtacgcttcattgttaatgttttgttagaattggagcgaaagtagtccattgcaaagcgagatgtaagcccatggcgaataaacccaccccggaagagctgaaaaatggcttgagcgaaatgcagttttacgtgacgcagcatcatggcaccgaaccgcctttcaccggacggctgttgcacaacaagaaaaatggcgtgtaccactgcctggtgtgcgatgcgccgctgtttaactcccagactaaatacgactccggctgcggctggccgagcttctacgagccggtaagcgcggaggccattcgctatctgaccgacaattcgcacggcatgcagcgcattgagatccgttgcggaaactgtgatgcccatctcggccacgtgtttccggatggtccgcagccgaccggcgagcgctattgtgtcaactcggcatcgctgagcttcaccgatgagcaaaatggcgagcaaatcaagggttgaagaaacgattcagcaaattattccaggcggaggtgagcggaagatggatattgagcaaattatcgacagtatgacgccggaagtgtatcagcgtctggcgacggcggtagagctgggaaaatggccggatggcgtcgcgctgacgccggagcagaaggaaaatagcctgcagctggtgatgctctggcaggcacggtataacaccgacgcccagcacatgaccatcgacaccagcgggcagatggtaatgaagagcaaacagcagctgaaagaggattttggcatcgtgccgaagccgatcgccaccgttaaactgcaataaaccgccggccggcggtgagacgttccggcgtcgggtaaccgcgcgccggatggcgtcatgtcgaatgaccgcgtccggcggtcagccgcttcgcttactttttgttcatcatcgctttcagatcggcaaacgggttgtaggtggcctcgccgacgctcttttgcgcatcttctcctgccaccaccgtggagccatactgatcggcttcggtgtacttggaatgttcgtgatcgtgacagtacaggcacaacatctcccagttgctgccatcttccgggttattggagtggtcgtgatcgatgtggtgcaccgtcagctcgcgcagattggagtagacaaactcccgtgagcagcgtccgcacacccagggaaaaagcttgagcgccttttcgcggtaacccacttccagacgtgcgtaatttttggggatataggccatggccccctgcctcctgtcaaacggttaagctgcgccaacccctggcgcagcggataacaggcatcataacctatcccgggcggcgcgatatacctgcattgcaggcgatgctgcctgcgtcacgcctcctggtgccgacgatgcggcggaacagccatgattagtgtttgatccccagcgattccgccagctgacgggccagctgattctggtcatcggcgccatattcccagaacatggccccggcgaggcccttcgccttgatatagtccgccttaatggctaccgagcgcgggttctcataggagagggcgaacagcggcttgccctccgcggactgcaccgacagccacggaaccttcgcctcatcgtcccagtgctcggtaaaacgcttttgcggatcgttgagcagtttgcccacgatatcattgtatttcacgtaggtgtctttgctcaggtcatagcccagcgaggcaaacagcgcgatctgttgtggcccaaaatagggctgggtgaccggattgttttgcgcatccgctttcgtccagtcaatccccggctcgaccgcccgtttcggtacccggccataaaaaccaatcccgaggttcatctggctgggtttaagcccggcggccaggtaattgttgaccacaaaatcggcgctgtatttatccgctgcggcgaccgtcggccagtggctggagtcatacagattcgagttgaagtactgcgtgccgtaggccatgtcgtaggtcatcaggttgatgtagttcagcaccggggccaccgctttgacgtccacccagcttttcgggctctcggcattggcgcctacggcgatagtcaccagcttttgctcaccgactgcctcacgcagcgatttcagcagggcagtgaagttgtcgcggtcagccggctggctggccaccagtccccaggcgccgttgaccggaaactcccagtcgaggtcaatgccgtccagaccatattgctggatgattttctgcgcggaacgaataaagacggcgcgactttctgcggtcgccgccgcgccggagaaaccacgcgcgccccagccgccgaccgacagcaggactttgaggtccggattctgtttacgcagggcggggagcttttgcagatccgcctgcaccttcggcgacagccagatctcgtgcagatgagcaggatccttcagggccgcattggtctcgtctttttcatcgttatagataaggccaaacgagtagttgagatgagtgatctgccggacgtccagcttatcgatatcaccgcccggcccggcggtgacgtcgccgccgccgttaaaatagccgacggacatcagcggttgggcagagagcgcggaagcgcaaagcaagggcaaggctgccagcaagggcaaaagtttcatagtggttcctctttgacataaaaataaccacgccacggaaatggcgtggcgaaaaaacagccttgccagactagcagcaataacctgttgaaactgcgagagagttcaatttatggacaatagcgaggcggcagaagaagacccggcgcgggggcgccggggggggggggagggatcaggcctgagtttcccgccagtcgtcgagggtatagagcgtggcgcccgcggcggccatctccataaacgcctggctgctgtcccgcggctgcagatttacgccgcgacagccgtcggtgatgacgttgaccgcgtagcccagcgccagggcatccagcacggtgaacttaacgcagtaatcggtggcgaggccgagaacggtcagctccacgatcccctgaccacgcagccagccgtccagttcggttttctgccggtgaccgttgtcaaagaaagcgctatagctgtcgatgatccggttttgccctttgtggaacacagcggcgatcgcctgctgcttgagcagcggatgcagcgccgcgccttcgctgtgctgcacgcagtgatccggccagaaagtttgcgccaggccgtccagctcgccctcggtgtagggttccacctggtgctggctggcgaagctgccgtgatccgccggatgccagtcctggctggcgacgatgggctcgccgcgcgccaggctccagtcgataagcgcattggctacctcgacggtactgtcgccttcaggaaccgccagcgcgccgccggcgcaaaagtcgttctgcaaatcaaccagtaacagcgctcgatgtgccatacgtcctccttaagcctcgtcgggggtgagttcgccacgcagattttgctgcatcgccgcgcgaatggcgtcaacgtccagctgctggctaagcagatagtgtagcttggtcagcgtcgcttccaccgtcatatcgaaaccactgatgacccccgcctgggcgagggcgttgccggtggcatagccgcccatgttcacctttccggacatgcactgcgtcagattgaccaccacaataccgcgctggctggcttccgccagcacctgaataaactcgccattctgtggggcattgccgacgccataggagcggaggatcagcgctttcaccggttggcgcagaaaattacgcaccacgtcggcggagatgccggggtaaatcgtcaccacgccaatcggctgcggagtgatggggtgcacgataagatctccgctgccctgcggtgccggcggagtaccgagacggcgaatatggatcccggcctccagcagcggggcaaggtttggcgaggcgaaagcgtcgaagccgtcggcatgggctttggtggtgcggttgccgcggaacagtcgattgttgaagaacagcgccacttcgttaatcggatagttggcggcgacgtacagggcgttgagcaggttaatctgaccatcggaacgcagctcggccagcggaatttgtgaccctgtcacaatgaccggcttgccaaggttttccagcatgaacgacagcgccgaggcggtaaacgccatggtgtcagttccgtggaggatcacaaagccatcatactcctcataatggctgcggatatcgtcggcgatgtgctgccagtcctcgggggtcatatcggatgaatccatcagcggatggtattcatggatcgtgaagtccggcatctccggacgatggaactccggcatcagcgccagctgacgctgcagatggccggaaacgggtacatagccgtgttcagagcgctgcataccgatggtcccaccggtgtaggcaacgtaaatcgattttttttgcatagcatcgcttaggttggtcgtagacaggcgcagtataaagagacgcaggaaaaaatacagcgtcggtcgcgggctttgtggcagtgttggcaggagagggaaaaaggctgccccgggagacggggcagccgctgcgtattaacggatgttagcgcaggtcaggcagaaggcatagcgattctgcgggtcgttaaacgccgccagcttgtcgctctccgctttcaccgtctcggccgccgcggcgaccggcgcaggcagccaggcctgaatggccgccggcagcgaggcgcgtaccgagccggtcaggctatccagcaccatcgagaagaaggtcggctcttcctgatagtagttgaggtgccaggttttcagcttcgccagctcggcggctttggccaccgcgtcgtcgaagtcgccgaggctgtcgaccaggccgttggctttggcatcttccccggtccagacgtggccctgggcgatctggtcgattttctccggcgtgctcttacgggcgttagccaccagggtgataaagcgctgatagccattctcaatgctcaactgcatcagctgctgcacttccggcggcagcgctttggtgctggagacatccgccagcggcgacgtggcgacgccgtcggtgtggacgccaatcgacccgagggtattttccacggtgttgatcaccccaaagatgccaatggagccggtgagggtgcttgggttcgccacgatgtaatccgctggggtggagatccagtagccgccggacgccgccatgccgcccatcgagaccactaccggtttaccggcggctttggctgccgccagctcttcacgaatgatttccgaagcggttacgctgccgcccgggctgtttacgcgcagaacgatggccttaattttcggatcgaggcgcgcatcgcgaatttgcgctgcggtggtatcgccgccgacgttgcccggggtctcttcaccgtccatgatggcgccgttggcgaagattaccgcgatggcggaaccctggtcagacggcgtcttcacgttgtagtcgtaatagctgatcgcccggtaattgttatccgctttgctccagccaaactgtttggtcagcgccttttccacttccgtggaggtcgccagctcatccaccagcttattgtccagcgcatatttcgccgtatcgccgcccaccttacgcaggccatcgataatgccctgggcgcccgggaagagctgctgggcggtgatctggcggttggcggcaatggtgttgaggtagttctgccacagttcgccaatccagcggctatccgcttcgcgggcggcaggggacatatcatcgcggatgaatggctcgacggcggatttataggtgccgacgcggaagacatgggtggagaccttcagcttatccagcagcgatttgtaatatagcccgttggtagcgaagccgtgcaggtctacctcgccctgcggcgagagccagattttgttggcgaagctcgccaggtagtactggccctggctgtagctgctgccgacggcatacaccggtttgccgctatcgcggaattcgctcagcgctttgccgatgtactgcatggatggctggtcgccaccgacgaagtttttcagatccagcacaataccggtgatattgcggtcatccttcgcctggcgaatggtctgcacgatatcgaacagggagttctcctgcagacggtccgagctggcgccaaacagctggcggccaatcacgccgagcttgctgctggcggatggtttatccaccaccacgccggtaatatccagcaacagcgcgccgcgcgcggcatgttcgctggtggtgctgctgaactggctccagatgccgatacacaccagcaccagcaccaggaagatcgcattgagggccagtttgcgaataaagttgagtatccgccacgtccatttaaaaaagctggcaatcagtcgccaaagggttcgcatgtcttctccctaacgttatctaaaaagggcaggccgcaggggccgccgcgtctggctatcctaaagagtgagccgtcggttgtcagcaggaatcaccgaccgcgctgtaacaaaatccttgtgcatgttaattttatgaaaaatgacatcacaggagttatacagatggatgctctcgatctactgcttaatcgccggagcgcttcccgcctggcggaacctgccccggcgggcgaacagctggaaaacattctgcgcgccgggctgcgcgccccggatcatggcaccctgcagccgtggcgcttctttattatcgccgatgacggccgcgagcgcttcagccagttgctggaaaaaggggccagagaggccggccaggatgagaagggaattgagaaagcccgcaatgcgccgttccgcgcgccgctgattattaccgtggtcgcgcgctgtgaagaccaccctaaggtgccgcgctgggagcaggagatgtccgctggctgcgcggtgatggcgatgcagatggcggccctggctcagggattcaacggtatctggcgcagcggagcattgaccgagagtccggtggtgcgggccgccttcgagtgccgcgaacaggataaaattgtcggcttcctctatctggggacgccgcagctaaaagcctcaaccaccattgccctgccggataccgcgccgtttgtgacgcgatactgagtccgcgtgtgttatgccgggtggcggctgcgccttacccggccaacgcatccgtctctgactgtctgtaggcccgcgcaagcgcagcgccgccgggcaaggacagcgggcacggagccgattttgtgccgggtggcggctgcgccttacccggcctacgttcgtacgacctgtcgttaatttattcacttt

SEQ ID NO: 77 - DNA, 72898 bp, Unknown
  source: /note="Description of Unknown: KP2-Mcoc1 Bacteria Sequence"
gtacttgcgtacgagctcttcttaaaatatggcggtgagggggggattcgaacccccgatacgttgccgtatacacactttccaggcgtgctccttcagccactcggacacctcaccatattgtctttcccgttgttgtcgggaacgggcgctaatgtagggaaatacgtatcgcccgtcaatcaactttttgcaaaaaaagcgcgtttagacaaacttcgagcaacttgctccttaaacgtgcgaaatccgttttttttgtcgccagtagcttttcccttttcgctccggggaaatttgttatgctggcaaaccaatagaaaacaatgagtaaaataagacgccagcgtcaatcggccaaaggcgtctgctatcaggagcccctatggagattattttttaccatccgacctttgatacccaatactggatctgtgagctggaaaagcagttacccggcgcgcgggtgcgcgagtggaaagcaggcgataaccggccggcggactatgccctggtctggcatccgccggtagagatgctgcagggccgggcgctgaaggccgtgttcgccctcggggcaggggtggactctattctcagcaagctgcgcgaccatccggatatgctgccgctgtcgattccgctgtttcgtctcgaagataccggtatgggacggcagatgcaggagtatgccgtgagccaggtgctccactggttccgccgctttgatgactatcaggcgctgaagctggcttcccgctggcagccgctgcccgagtaccgcgccgacgaattcaccgtcgggattatgggcgccggcgtgctgggggcgaaggttgcggaaagtctgcaaccctgggggttcccgcttcgcgtctggagccgtagccgcaaatcctggccgcaggtgcagagcttcgccggccaggccgagctgggcgaattcctgcagggcactcgcgtgctgatcaacctgctgccgaataccgccgaaaccgccggcattattaaccagacgctgctggcgcagttgcctgatgagagctatgtcctcaaccttgctcgcggcgtgcatgtcgttgaagaggatctgctggcggcgctgaacagcggtaagctcaaaggggcgatgctcgatgtcttcagtcgcgaaccgctgccgcaggagagcccgctatgggcgcatccgcgggtggccatgaccccccatgtggcggcagtgacccgtccaatggaagctatcacctacattgcggagaccattagccggcttgagcgaggggagccggtaagcggtcaggtcgaccgccagcgcggttattaagacgagagaaccccgccacggcggggtttttgctaatcaatagcccggtttcctgctattcttgcggcaaacagaagaggagaatgtgatgtatcccgttgacctgcacatgcataccgtcgccagcacccatgcctacagcaccctgcacgattatattgcggaagcaaagcgtaaagggatcaaactcttcgccatcaccgaccacggcccggacatggcggatgctccgcactactggcacttcgttaatatgcgcatctggccccgcctggtagacggggtggggatcctgcgcggtattgagtcgaatattaaaaatattgaaggcgagatcgactgttccggaccgatgttgacttccctcgatctgatcatcgccggatttcatgagccggtgtttccgccgcaggatcgtgacacccatacacaggcgatgatagccgcgatggccagcggtaaagtgcatatgattagccatccgggtaatccgaaattcccggtggatatcccggcgattgccgaagcggcggctcgctaccaggtggcgctggagattaataactcctcgttcgtatcatcgcgcgtgggcagtgaagacaactgccgggccatcgccgccgcagtgcgtgatgccgggggatgggtggcgctgggctcggactctcacaccgcctttaccctcggggagtttaccgaatgccgcaagatccttgatgcggtcgatttcccggaggagaggatcctcaacgtttctccgcgtcgcctgcttaacttcctcgagtcgcggggcatgccggcgatcccggaatttgctgacctttaatttgtataactggaataactgaatgaacgagttttcaatcctctgccgcgtgctgggttcgctgtattaccgtcaaccgcaggacccgctgctggtgccgttgtttaccctgatccgcgagggcaaactggccgccagctggccgcttgagcaggacgagctgctggcgcgtctgcagaaaagctgtgaaatgcaatccctggcgacggactataatgcgctgttcgtcggtgaagcctgcagcgtcccgccgtaccgtagcgcgtgggtggagggttcctcggaagcggaagttcgggcttttctgagcgaacacggcatcccgacaggggaaggtccggcggatcatctcggctcgctgctgctggccgcctcctggctggaggatcatgccgcagaagaccagagcgagacgctggagctcctgttcgccgactatatcctgccgtggtgcgggacgatgctggggaaagtcgaagcccatgcgcacacgccgttctggcgcaccatggcgccgttgacccgcgacgccatcgccgcgatgtgggacgagcttcaggaagaagatgagcaataatatgtgatgcaaatcactgtttgaatgaaactgaaagaaagttcattcatatactgtgttttagatcgcattcttccggcgcgtatctgctaggatacgcgccatgaacatactcttcgcaatcgcattaacgacaggcatcctctccgggatttgggggtgggtggcggtcgctctcggcctgctgagctgggccggattcctcggctgtacggcctatttcgcctgcccgcagggcggcttgaaagggctggccatctcgtcctgcacggtgatgagcggcgtggcctgggcgttagtgattatccacggtagcgcgctggcgccacaggtgcagatcctcagctatatgatgaccggtgtggtcgccttcctgatgtgcattcaggcgcgacggacgctactgtcgtttgtcccgggcacctttatcggcgcctgcgcgaccttcgcggcagacggcgactggcgtctggtgatcccttccctggcgctgggtctggtctttggctatgccatgaaaaatagtggcctgtggctggcggcccgtgcggataagcataaattgttcgtcaacgacaacgcctgatcggcgggacgactaaaaaacaggaccttacgggtcctgtttttttatcttctcgtcaccggacaaagcgatagtcttgctcccgcaggcgagaatgccctagtatcggcagaaagccgtatccacacgctatgccgacaggaggagaaatggctgttaaacctgaggtaattctcggcgatattacgacacttgatgtcgatgtgattgttaatgcggcaaatccctcgctgctgggtggtggcggagtagacggggccatccaccgggcggccggtcccgcgctgctggcggcttgcaagcaggtgctgcagcagcagggcgaatgccctcccgggcatgcggtaattactattgccggcaatctgccggccagcgcggtgatccacaccgtgggcccggtctggcacggcggcgaccgcatggaggcgcaaaccctggccgatgcttacaaaaacagtctgcagttggcctcggcaaataactatcgctccattgcgtttccggcgataagcaccggcgtgtatggctatccgaaagaggaagcggcggcgatcgccgtgcgcaccgtcaccgcgtttctcactcgctataaccctcttgagcgcgtcctgttcgtctgttttgacgaggaaacggcggctatctatcgccgcctgctggcgtcatacccctgattcaacagaataggctatgataaccgccagtcttgacgggaatgatgggtagcaggagggagcagggtgtcagaaggaaaagtccagcagaaacagcaggcgcgccgcgcggagatcgttgtcgctgcgcaaaaatgtttcgctgaaaaggggctgcacggcgcttccgtcgccgatatcgcccgggaagcgggcctgagcgtcggtcagctatatcgcatttttgccagcaaggaagcgatcatcgaagcgattgttagcgaaatcgtcaacgccagagtcggggagatgatcgatgagaaccacaatctggcgcgtaaagcggcggttttggctggcaggatcccgacgtcggcagccaccaaaagcgataattatctgctgatggagatcaatgccgaggcctcgcgtaacccccgcttgcgtgagatcctgatgcaggccgatcggcggttgaaagaggagggcggtcgcctgtcgcagcgctaccatcccgggctcagcgatgcgcgacgcaatgccgcatcagagctcatcgccgttctgacagagggggcagcctaccgctgtgagctgagcgcctccaccccggtcgataaggcagatttagaagccctgtacaatatgattttcgaccggctttttgacgagcaggcataatacggcacgcctggcgtgccgcacaggctaatggttagctggccgaggctggggttttggccggtttgttcatcggtttaccggagaacaggaaacgcagcagcggaatgcgcaggtgaatttcatacaggatcagggcaatacccaccacaaaaaccaacccgccaataaagcctaaggtattggacttaatgaccggggtgatccacgccccgtacagcagcgtcagcggatggtgcaccaggtaaataaacagcgaagcattgacgaaataggttacgcgcgccgactggaagttcagcaggcgatggccgagcgaaaagaccacattgaccatccacagcccaagcaccatggtgatcaccgattccgtttcatacatccagccgtcgccggagccgtactgctggttcagccggtaggcgataaatcccagcagcgccgctgcgcagcaccatggtgacggggtggtaaacatcgccttcagacgcggattaataaaggtctgcgcccccagcacaaagaagggaagatagaacagcgtctgcatcaccacaaagttaaacagaccattgctaagcagcggcgggtaaatcaggaacagcgatcggcggatcagcgcgtaaagcacccccagcgcaaggaaaatcatcgttagctggcccatagtgacagtgtcaccaaaggctgaggcaccccctgttgggcggcgcgtcagccatttaaacagcaccacgcccagcgaggtcagcaccaccagcaccagtaaaaaccacaggtgggaaataagctcccacgccagggtgttaaatttgtcgtacccggaaagggtgtgccagttttccgccttgccgttgacgtactgcagcataataaactgcggcagcgtcagcagtgggatagcggtcagcatcggaataccgacccgttcgacgcgcactttccaccactttttcaacgggtagcgcaggaacagcatgtaggagaaatagccggagatgacgaaaaagacctgcatccggaaggcatggatgaagtcattaaacagcgtcaaccaccacgagggctcagcgctgttgacatgccagctgtggctggaatagatcagcgaaatgtggaaagggatccccagcagcatcagccaggcgcggatgctgtcgaagaaatattcacgctgtaccggagtattattcatacgattcacgacaatctcagataattcgtcttatcactcaagatgataacgcttacattatcagcaaccctacatgaactcggggtacctgtctccaggataagcacgcaaagtgcaaacgggatagcgaactgtttattccctgcgccgctacgctgaacaaagcagggattatgttgtcggattgcctgagtttccattaaaatagatcggatcgatttaagcacacaaagggggaagtgcttacttatatgaaacataaaccacagatgatgaaaatgcgttggttaagcgcagccgtaatgttgtccctgtgtacttcatctgcatgggcatttagcattgatgacgttgcaaaagaggccaaaacgttagccgggaaaggctatgaagcgccgaagagtaacctgccctccgctttccgcgacatgaaatacgcggattaccagcaaattcagtttaatcacgataaagcttactggaataaccagaaaaccccattcaagcttgaattttaccatcagggtatgtacttcgacacgccggtcaccatcaatgaagtgacggccaccagcgtgcgcaaaattaaatatagcccggactattttaactttggtaacgttcagcacgataaagacacggtgaaagacctcggtttcgccggcttcaaagtactgtatccgatcaatagcaaagataagaacgatgagatcgtcagcatgctcggtgccagctacttccgcgtgctgggtcagggtcaggtttacggcctgtccgcgcgcggcctggctatcgataccgcgctgccgtccggcgaagagttcccgcgttttcgcgagttctggatcgagcgtcctaaagccaccgacaaacgtctgactatctatgcgctgctggactccccgcgggcaaccggcgcttatcgctttgtcatcatgccgggacgcgacaccgtggtagatgtccagtccaaagtttacctgcgtgacaaagtgggaaaactgggcgtggcgccgctgaccagcatgttcctgttcggttccaaccagccttctccggcgcttaactatcgtccggcgctacacgactccaatggtctgtcgatcctggccggtaacggcgagtggatctggcgtccgctgaacaacccgaaacaccttgccgttagcagctatgcgatggaaaacccgcaagggttcggcctgctgcagcgcggccgtcagttctcgcgcttcgaggatctcgacgatcgttatgacctgcgtccgagcgcctggatcaccccgaaaggggagtggggcaaagggaaaatcgaactggttgaaatcccgaccaacgatgaaaccaacgataacatcgtgacttactggacgccggatcagctgccggagccgggcaaggagatgaacttcaagtacaccatcaccttcagccgcgatgaagacaagctgcatgcgccggataacgcttacgttatgcagacccgccgctctaccggcgacgtgaagcagtcgaacctgatccgccagccggacggcaccattgctttcattgtcgacttcaccggcgccgatatgaaaaaactgccggcggataccccggtcgccgcccaggcgagtaccggcgataacgctgaaatcgttgaaaataccgtgcgttacaatccggtgaccaaaggctggcgaatgatcctgcgtttgaaggtgaaagatccgaagaaaacgacggaaatgcgcgccgcgctggttaacggtgatgacacgttgagcgaaacctggagctatcagctgcctgccaatgaataagataacaaagtacattgacgcattgccgctgtcggacgccgagaaatcggcgctgccggacaccagcctgcaggccgttcatcaggccctggatgacgaccatcagaccttcgcccgcgaagacgactccccgctggggtcggtcaaggcacggcttgcgcacagctggccggattcgctgtctggcgatcagctggtgaaggatgatgaaggccgtactcagctgcatgcgatgcctaaagccaagcgctcctcgatgatcccggacccgtggcgtaccaacccggtcggccgcttctgggaccgtctgcgcggacgcgatgtcacgccgcgctatctctcccgtctgacgcaagaagagcgcgagagtgagcaaaaatggcgtaccgtcggcaccattcgtcgctatatcctgctgctgctgacgctgtcgcagaccgtagtggccacctggtatatgaaaaccattctgccttatcagggctgggcgctgatcaacccggccgacatggtggggcagaacctgtggatctcgttcatgcagctgctgccgtacgtgttgcagagcggcattctgatcctcttcgcggtgctgttctgctgggtttccgccggcttctggaccgcgttaatgggcttcctgcagctattgatcggccgcgataagtacagtatttccgcctcgacggtcggtgacgaaccgttgaacccggcgcaccgtacggcgctgataatgccgatctgtaacgaagacgttgaccgcgttttcgccggcctgcgggcgacctgggagtcggtgaaagcgaccggtaacgccgctcatttcgacgtctatatcctcagcgatagctataaccccgatatctgtgtggctgagcaaaaggcgtggatggagctgattgccgaagtgcagggcgaagggcagatcttctaccgccgccgtcgtcgtcgagtgaagcgtaagagcggcaacatcgatgacttctgccgccgctggggcagccagtatagctatatggtggtgctggacgctgactcggtgatgaccggtgagtgtctgagcagcctggtgcgcctgatggaagcgaacccgaatgccgggatcattcagtcttccccgcgcgcctcgggcatggacacgctgtatgcgcgttgccagcagtttgccacccgggtgtacggtccgctgtttacggcgggtctgcacttctggcagttgggggagtcccactactggggccacaacgccattatccgcgtgaagccgttcattgagcactgcgcgctggcgccgctgccgggcgagggcaactttgccgggtcgatcctgtcgcacgacttcgtcgaagccgcgctgatgcgccgtgccggctggggggtgtggattgcctacgatctgccgggctcctatgaggagctgccgccgaacctgctggacgagctgaaacgcgaccgtcgctggtgtcagggcaacctgatgaacttccgcctgttccttgtcagagggatgcacccggttcaccgggcggtgttccttaccggcgtgatgtcctacctgtcggcgccgctgtggtttatgttccttgccctgtcgacggcgttgcaggtggtgcatgccctgaccgaaccgcagtacttcctgcagccgcgtcagctgttcccggtgtggccgcagtggcggcctgagctggccatcgcgctgttcgcctcgaccatggtgctgctgttcctgccgaagctgctgagtattattctggtgtggtgtaaagggccgaaagagtacggcggatttatccgcgtcacgctttcactgctgctggaggtcctgttctcggtcctgctggcgccggtccgtatgctgttccacacggtcttcgtggtcagcgccttcctcggctgggaggtggtatggaattcgccgcagcgtgatgatgactccacgccgtggggggaagcctttatgcgccacggctcacagctgctgctggggctggtgtgggcggtcgggatggcatggctggatctacgcttcctgttctggctagcgccgattgttgtctcgctgatcctctcgccgttcgtatcggcaatttccagccgggcgacagtgggcctgcgcaccaagcgctggaagctgttcctgatcccggaagagtattcgccgccgcaggtgctcaaggataccgatgcgtacctgacgatgaaccgtcagcgttcgctggacgatggctttatgcacgcggtgtttaacccgtcgtttaacgccctcgccaccgcaatggccactgcgcgccaccgtcaggggcatatcctggagatcgcccgcgagcgccatgtcgagcaggcgctgaatgaaacgccggataagctgaaccgcgatcgccgactggtgctattgagcgacccggtaaccatgtcgcgtctgcactatcgcgtatgggccgcgccggagaaatactcttcatgggtgaacgcctatcagcagttggcgcttaacccgctggcgctgaaaacgaaataagccgtacgttaaggaaaataccggcagcgatgccggtatttttttatctgaaatacgaggatgtggatgcgaatactaccgatcattgccatggcgctgctgctcagcggctgcggcagcattatcagccgtacggtgcccgggcaggggcatggcaatcaatattacccgggcgtacagtgggatgttcgcgattcggcatggcgctatctcaccattcttgacctaccgttctcgctggtatttgatacgcttctgctgcctctggacgccagccacggcccctataactgattaacgctcgtcccactcgtcggctgccgtctgcccctcttcggtgtccagcgagggctcgagctgaaattcgccttcatcccattcgtggagcgtattttcctccagccactcctgacgcagctctatctcatcataatccccgtcgaagacgctctgcgcggcttcgccgctgagcatcgggaggcattcgccttgttcctcttcgtcagcaaaaaattcggcctgccaggcgatatcgccatcctgcagcacatacttttgaatgttgagctgctcaacgttggcgctctcttcatcgctgtcagggttgttggcgagaaattcttcacgtgctgcatcaatagcttcttcaagcgtggcgtagaacatcgaatcctttggcatagcgaatctcctgagaagaatatgaattgaacacgattcaatctatagaaggcggtacgcacggcgtcaagggacagagcccctctcgacgttaatttactgaatgcgaagtatccgcggctggccgacgcaggctgagggtggagtagatcgcattaaataataccacccctgcggtgaccagaaatacagcgcggaagccatagttagcggaaaccgacgcgccaatcagggggccggtaacgttgccaatatcgcggaacgactggttatagctgaagattcgcccggagatctggctggtggagttgtacaccagcagggtttgcaccgccggcagcagcgcgccgtccgcggcgccgagcaggaatcgcaggatacctaactgcagcggggtctgaacgaacgacatcgggatcaggagtagcaccgagataatcagcgccacgatgaggattttttccggcccgatgcgatctcccagtttgcccagccgcggggcgctcatcagcgcggcaatgcccggcaccgaggcgatcattccgctgataaaggcgatgttactgacgttgcccgcgagatcgcgtacataaagcgtcaggatcggcgcaatggaaccggtggccacctggattatcagcgaggtcacaaacaggctgagcaccagtttgggattctgcagcgaggagaacacctctctggcactgagcatctctttcctggcgatcggcacaaaattttcgcggattaaaaacagggtaaacaagaaacagataaatagtaccgccgcggtcataaagaagacggtgcgcaatccccagtggtcggccaggaagccacctgccagcgggccgagcagggcgccgcttaccgcgccggtagacagtgtccccagcgcccagccgcttttatggcgcgggatctgggtggcgatcagggcgttggcgttaggaataaaaccgcccagcaggccgagcaatgcgcgcagcagcagaaactgccagatattctgcgccattcccatcagcatcatcacgatggccatcccgagggcggaacgcagcagcatgatttttctccccttgcgatcagcaagccccccccagaacggcgaggcgatggcggagaaaagaaaggtaatactaaagaccagcccggaccacatgttcagggcgctatgcccggtgacgccgagctgttcgacgtagagtggcagaaagggcatgaccaggctgaaggcggcgccggttaaaaagcagccaagccaggtcacggtcaggtttcgtttccagttaatgggggtttcagcagacgacatagggttccactggcctgcgcggcaggtcaaattaagagaaaatatgagcctgctaattatgcgcctgagaaatagatgccgcaatggaggagagcttttaaagctaaaggagagcctaaagcctgagcggcgaagcttcccggccgggatgagcgcggccgggaaaagggatcagtagcgggagggcatgccttcggggcgggttttgaagcgacgatggagccacatatactgttccggggccatcatgatgcactgctcaacgatcttgttcatccacgcggcggtggtttccgcgtcgtccagcggcggggaacactctggcggcaggataatcagttcataacctttaccgtccggtttgcggcgcgggacgaagggcacgatgcaggctttggacattttcgccagcatccaggtgccggaggtggtcgccgcctggtcgaccgcaaacagtggggcaaagacgctggcggtcgggccgtaatcgtgatccggtgcgtaccacaccacttcgccttttttcagtgcccggatcatgcctttcagatccttacggtcaatcatgtccttattggatcgtagccgaccccaggtctgcagccagtcgatcaccgggttgtcgttggggcgatagacgccaatccccggttcgttcataccgaacatccgcgcacccatctcgagagtgaggaaatgaataccgatcagcagaatgccgcgctgctgcgcctgcacatcgcgaatatgctcaaagccgatggtgtcggtccagcgggcgatacggcgaaccggccagaaccaggccataccggtctccatcagccccatgcccaccgattcaaagttcatcaccaccattcggtggcgttcctgctcgcttttctcggggaagcagagctcaaggttgcgataggcgattttcgcccggcgcttcataaagcgcatggccagacggccgatggcgttcccgaggcggtagatcagcgggtagggcagttggacaaccagccacagcaggccgatacccagccacagcagccaatagcgcggatgcaacagcgccggagaaaatttaggcaaatgagtcatttcatacccgtatcagtgagcaacgtcttatattatcgcatttttttaccggccagccaaaggcggcgacagtcagctcgttttgttaagcggggcgcgaccgggtgagagaaatgtagcgtaaaatgtagggatgtaaattaattagctttgctatatcatgcccgccgtttatttcctcatttctatgtcgagcaggtacaccatgccagtgttacacaaccgcatttcaaatgagacgttaaaggcgcaaatgctggctgaaaccgagccgcgcacgacgatctcattctataaatatttcaccattgtcgacccgcaggcgacccgcgatgcgctgtgggttgccttaacccagctgaaggtctttggccgcatctatctggcccgggaagggatcaacgcgcaaatcagcgtgccgcaaagcaacgttgaggctctgcgtgagtttctctatggcttcgatccggcgctggcggggctgcgtttcaatatcgccgtggaggacgatggtaagtctttctgggtgctgcgcctgaaagttcgcgatcgtatcgtcgccgacggcatcgacgatccctcgtttgacgcctccaatgtgggggagtatctcaaggcggcggaagtcaacgcgatgcttgacgatccggatgccgtgtttatcgatatgcgcaaccactatgaatatgaggtgggccatttcgaaaacgcgctggagatcccggcggataccttccgcgaccagctgccgaaagccgtggaaatgatgcaggaccataaagacaagaaaattgtcatgtattgcaccggcggcattcgctgtgaaaaagccagcgcctggatgaagcataacggcttcaataaggtctggcacatcgagggtggcatcatcgagtacgcccgtcgcgcccgcgagcaggggctgccggtgcgtttcattggcaaaaactttgtctttgatgagcggatgggcgagcggatctccaatgacgttatcgcgcactgtcatcagtgcggcgcgccgtgcgacacccatactaactgcctgaacgatggctgccatctgctgtttatccagtgcccgagctgcgccgagaagtttgccggctgctgtagcgaagcctgcatggaagagcataagctaccggaagaggagcagcgtaagctgcgcgccgggcgtgaaaacggcaacaaaatctttaataaatcccgtggccggctgaataccaaactcgggatcctcgacccggagccgtcagaaaaaccataaccagacgagatcgatgatcgccagcagcagccagagcgccaggtagatcataaaatgctcgcgcacgttgttgaccagcatattaaacaggcgacgcataaccgctctcaatcactaacggcctcagcagaggccgtttctttacccaacggcaaaagtgccgcattccattacgcgttaaagcgcgccagagaaaagggggccagattgaagctcggtgcttcgccctgagcaaactgactggcaatttcgcccagcaccggcgcaaacttaaagccgtggccgctcagcccggtgatcagcagcgtgtctggcctgcctggcaacgtatcgataataaagtcctcatcgacggtattgtcgtaggtacaggaggcgccgtgcaggcagccgccgatgccaggcaggacgttacgcaaaaacgggaaggattcggaaccatcgctggcgacagcgccaaacgctaccctttcctgcggggtggagatcggctggccgccgttatgcttgccaattttcagttcattatcttccgccgggaaaccgtaatattgatcgccgttgggcaactcgccggtgaaggccgggaagtgattcttgctgctgtaacggccatcggcctggtaccaggcgaacaccttgcgtaccggctggatagggaggtccggaagcaggcgggtgacccaggtgccggcgctgaccagcagctttttaccatgatattcaccgtcgagggtatcgatggtgatcccgtcagcatggtgatgaatagccgagaccggacagttgaatagctgcgcgcagcctgcttcccgcgccagacggatccaggtttcgacggccagttcgctgcgcagtacgccggaagcgggttcgaaaatcgcccgatagtcatcggggaggcgtatctccggccagcgctgcatcacggcctgggcatcaagctcttccacctcaagctggaacgcacgggcgctggcggcgacgttggcgagaaaagcggagctggcggggccgaggttaatgacgccggtgcgttcaaacacggcttcgccactgatctctgccagttcgtcccatagctgctgggcacgcagcaccagcggaacatatttctcaccttcgccataggcgtgacggataagccggctgctgccgtgatggctgccttcctggtggggaggttgatgggcatcggtcatcagaacattgagtccggcacggcgcgcataatagccagcggcggcgccgacggagccgctgccaataatgataagatcgtattgcatggtgagttccgggtaattgccttgttagcagggtaattaactccctgtgcttatacaagcccgaaaataattcaggcacccgcaggtgcctgttaagtttaatgttaagtcattcgcaagccgcgttaatgtcggcgatactcgttttcctggtattcgccagattcaatcttcgcaatgcctgcttccaggattgaaataaactgacgtgcgacgtccgtcgttagccatagcgtctggccgatctcagcatcattactgttttcttgagtggggttctggtagtgcaggcgcaacatcagcgcatcgtagctatgaacggtgctgatgtcccatccaacgaggggatgggtctgaatgacttcattatttttttccatcataaccccttattcatatgttaaaagacaacaattctcgaggtttaatgcatattttttgaagcaagttaattatatcagggatcaagaataaactcgagaaattaaatgaaaggcagcatgattttcttcttttgccgcttttttactcaagataagcgcgtaaaatggccactttagtcgatattgagcagaataatcaggactattctgaacagaagaggggataaaaaaagccggggcgacccggcaaaaaaagcacaatgagggagcaaaccagagtaactggatcccgccatgcttcaggagagatcgtggacaaaccagtcgtccgcgctttcccatgtttcctgcaggatttcgcttatccggtctttgtcttctttcagggcgccaaacaccgagagctgattaccggtggcgtagcggacgctcacctggctatcgatggccgggaattgctcggcgatacggcgagagagttcgttattcagcgcttccagcgcgccgttaggtaaggcggtcgttttggcgatagacacttcaatgcgcataattgccccctgcgttcgatactggttatttatacagtatccggttagcgttgacaacagggggctgcgtttttatttcttcacggtccagcgaacggtttcacccgccaggaagggcaccagggtgtcattaggcagggcaatgctgtccacaacggtcgtctcttcacgcaccagttcaacgtagctctcattgaccggcagaccgtagaagcgcgggccgttcagcgagcagaaagcctcaaagtgctgcagagcgttcatttcttcaaacacggtggcgtagctgccgagggcggtcggggcgttaaagcagccggcgcagccacagctggcttccttacggtggcgggcgtgcggtgcggagtcggtgccgaggaaggcgcggctgaagccgctggcgaccagctcccgcagagcctgctgatgaatattgcgtttaagtaccggcagacagtacaggtgagggcgaatgccgcccaccagcatatggttgcggttgaacatcagatgctgcggggtgatggtagcagccagcagttcattaccgtcacgcacgtactcagcggcgtctttggtggtgatatgttcaaaaaccactttcaggccgggcaggcgctggcgcaggggctccatcaccgtctcaataaagcgcgcttcacgatcgaaaatatcaatctcggcgtgagtgacttcgccgtgaacgagcaacggcatccccagtttttccatccgctccagcactggcataatggcgtcggtgctggtgacgccgtggctggagttagtggtggcattggccgggtagagcttggcggcggtgaaaaccccttcgttaaagccgcgttccagctccgctgggtcgagggagtctgtcagatagcaggtcatcagcggggtaaaatcatgcccggccggcacggcgtccataatgcgctggcggtaagcgatagccgccgcgacggtggtgacaggcggcaccagattcggcatcacgatcgcccggccataaaactcactggtataaggcacgacggttttcagcatatcgtcatcgcgcagatggatatgccagtcgtctgggcggcggattttcaatacctgggattgtgctgtcatggaaggctccggctaataggttcagtcatcagggctgttttttgccgggcactaaggataagcgtaaacgttttcctttgcactcatttccgtaaaaaattcagggcgccgtagcgccctggagattaattggtaaaggggatgacaatctcgcctggcttcacctctatacctttggcgtatttcttcgccagcgcttcgccggtgctggcgtcctcacgcaggacataagccggctgctggctgaagtagctgcgcagagactgattcaggtaggggagcagggcctgaataaccgactgcagcttctccggcgccactttggcatcgaccacttccatttcctgcaggaagatggcgcctttctctcggtcaaaggttggcagcgctttgagcttcagatcgatcgtcgctttctgcgtaccgaacagggagttaagatcgacgttggcgatcccgctcagggtgactttgcccggctcctcgcgcccgatagcgctggtcaggttctgcagttcgatatgggcgtcggcaacgcctttcagaccaatatctttggcgaaatggtttcgcttctgcagggcctggttaatctcctgctcgcttaccgtgtattgggtcagctgattacagccgctcagcaggccgctgacaattagcgcggcggcgatcaatatctttctcatggggttcctcaagctcataccttccttcatcctgacacaaagcatcatgacctgtcagcacccatcgcgccagcagaataggctgaaagcaggagaaaccgccgccgcgcgcatcaggtgcgcggctccagcataccggaggcagagcgtttcgggctgaattgccaccatagcgccaggaaggtgataaccccgatggcgccgagcatcagccacggcagttcgggctggccgacggctttcccggcatcaaacagccagccgccgcccgcgtaacccagcgcgccgccgaaggcgagccccagacggctgaaacccatatagctgccacgcgcccgggcgtccgccagcgaagcgcccagcgtctcgcgggcgggttcggcaatgatagagccgatgtaaaacaggcaaatcagggtaaacagctgctgtaaactgctggtcatcccgatggggagcatggccagggtcatcaccagcagaccggccatcagccggtgctcaaggcggaagcgtttttcgctccaacgggcaataggatagagcagggtgagcgaaatggtggcttcgatggcgtacatccatttcacggcggccggcgagccggcgatgtcattcaccatgatcggcagcatcagcatcacctgcaccgccagcatataatagccggtcagcgtcaggacataggtgacgaagcgtttgtcccgcagcacccggcccagaccctcgcgaatcggcgttttcaccgtcgagagcttccatgccggcagataccaggcgttaaacgcggcgcaggcgataaacagcgcggcgccggcgctgcacaccaggcgaaaatcatactgcagcagccagctgcccagcagcgcgccaatcaccgcgccggcgctatcctgcatcatcaggatggagaaaaagcggccgcgctgatgcggacgcaccagcttaaccaccagcgccgcccgcggcggatcgaacagtgtaccgccgagtccggagagtatgcacgagaaccacagcacccacggctcatgggcgacggccatcgccgcgaaaccgccggcacgcatcagcataccggtgacgatcatcggtttcgcgccgaagcggtcggcgatggcgccgccaaagatgcctaatccctgctgtaccagctggcgcaggccgagcgcaatgccgaccatcagcgctgcccagcccatctgatcgacaaagcggatggaaatcagcggaaaaacgacaaaaaagcccagcacgaccagcatgttatcgactaacaggaaatatttacccaggctccttgcctgcgagacgcgggacatttcccctccagggaaaaatagagataagcgaggatattctgcgggcaatctgctgcttttcccagcacccttgcgacaatatttttttatcaaaaagcaagatcgattgagcctattcatcgaaaagaggagatggcgcagaaaatggtatgttgctgttttcacactatcgtgcaggaaaggtatagtgatgaaagcaagagtgaagtcagggggactgaaaaaggaaatgtttggctatcgcagtaacgtgccgaaggtgcgtttgacgacggaccggctggtggtgcgcctggttcacgatcgtgacgcctggcgtctggccgattattacgccgaaaataaagcgttcttaaaaccctgggagccggttcgtgacgacagccactgctatccctccggatggcaggcgcgtctgtcgatgatcgctgagtttcataagcaggggtcagctttttatttcgcgctgctcgaccctgaggaaaaagagatcatcggtgtggcgaatttctccaacgtggtgcgcggatctttccatgcctgttatcttggctattccattggcgagaagtggcaggggcaggggctgatgtttgaagcgctgacgtcggcgattcgctatatgcagcgcacgcagcatattcatcgcattatggccaactacatgccgcataatcagcgcagcggcgcgctgctggcgcggttggggtttgaaaaagagggttacgccaaagattatctgctgattgacgggcagtggcgtgaccatgtactgacggcgctaacgacgccggactggtctgcgggacgttaaggagagaggatgaaatatcagttaactgcgcatgaagcgcgcgtcattggctgcctgctggaaaagcaggtcaccacccccgagcagtatccgctgtcggtaaatgctgtggtgaccgcctgcaatcagaaaaccaaccgcgagccagtgatgtcgctgagcgaaggcgaggtccaggccctgctggatacgctggtgaaacggcactatctgcgcacggtcagcggattcggtaatcgcgtcaccaagtatgaacagcgcttttgcaactccgaatttggcgatctgaagcttagcgccggcgaggtcgcggtggtcacgacgctgctgctgcgcggtgctcagacgccgggcgaattacgcagccgggcgcagcggatgtatgagttcagcgatatggcggaagtggaaagcgtgctggaagggctgacgacgcgcgaagatggccccttcgtcgcccggttgccccgggagccgggaaaacgggaaagccgctatatgcatctgttttgcgacgatatggacacgctgatcaccacagtggaagctctcgcgccgctggacgatgacggcgatctgcgcgccagggttgaagcgctggagggcgaggtggcggagctgaaagcgcgcctcgattcgctgttacaccatctgggagactaaaacgtggggacaagattgcgcattggggtggtcggcttaggcagcattgcgcagaaagcgtggctgccggtgctgggggcggcggaaagctggacgctgcaggcggcctggtcgccgggtaaagagaaggcgctacggatctgcgaaacctggcggatgccatacgctgattccctcgatgccctggcggcacagtgcgatgcggtctttgtccatacctcgacggcttcacattatgaagtagtgaatcacttactgaatgccggggttcatgtttgtgtggataaaccattggcggacaagctgagtgaggcggagacgctggtcgagctggcggcgcgacgtcgactgacgttgatggtcggtttcaatcgccgcttcgcgccgctctatcgggagctgaaggggcggctgggcgaggcggcctcgctgcggatggataaacaccgtagcgatagcgtcggcaacgatctgcgctttacgctgcttgatgactatctgcatgtggtggataccgcgctatggctggccgacggtcaggcgcgtctgcgcggcggcgcgctgaagatcaccccgcagggcgaaatgctctatgccgaacatcagttcagttcgccccggctgcaggtcaccaccagcatgcatcgtcgcgcaggcagccagcgcgagtgggtgcaggcggtcacggatggcgggctatatgccgtcagcgagatgcgcgaatggcaggaggagtgcggtcatggcgtggtccagcgcccggttgccggctggcaaaccacccttgagcagcgcggctttgtcggctgcgcgcgccattttatcgaatgcgtgcaaaatcagacagttcctgaaactgcaggcgaacaggcgctgctggctcagcggatcgttgagaaactgtggcgcgacgccattagcgaataatccattgtaacaactgacagtagtaattcatgttgaacccggtagactatcgccactttccagcgcccgcatttgcgggcgttttactccagggtttggaataacagcgtaatgaaccttttaaaatcactggcggcagtcagttcgatgaccatgttttcgcgcgtgctgggctttgcccgcgatgcgattgtggcgcgtatttttggcgccgggatggcgactgatgccttttttgtcgccttcaaactgcctaacctgctgcggcgtatttttgccgaaggcgccttctcacaggcgtttgtgccgatccttgccgaatataaaagcaagcagggcgaagatgccacccgcgtgtttgtctcatacgtctccgggctgctgaccctggccctggctatcgttaccgttatcgggatgctggcggcgccgtgggtaatcaccattactgcgcccggctttgccgataccgccgataagtttgcgctaaccacccagctgctgcgtattacctttccctatattttgctgatctccctggcttcgctggtgggggcgatcctcaatacctggaaccgcttctcggtgccggcctttgcgccgacgttcctcaacgtcagtatgattggctttgcgctgtttgccgcgccatatttccatccgccggtgctggcgctggcctgggcggtgacggtcggcggcgtgctgcagctggcttaccagctgccgcatctgaagaagattggcatgctggtcctgccgcgaattaatctgaaagatgccggcgcgatgcgggtggtgaagcagatggggccggcgatccttggcgtgtcggtaagccagatctcccttatcatcaataccattttcgcctcattcctcgtgtcgggctcggtgtcgtggatgtattatgccgaccgcctgatggagtttccctccggcgtgctgggcgtggcgctcggcactatcctgctgccatcgctgtcaaaaagcttcgccagcggtaaccatgacgagtattgccggctgatggactggggactgcgtctctgttttctgctggcgctgccgagcgcggtggcgctggggatcctcgccaaaccgctgaccgtggctctgttccagtacggcaaattcagcgcctttgacgcggcgatgacccagcgcgcgctggtggcctattccgtggggctgatgggccttatcgtggtgaaagtgctggcgccgggcttctattcccgtcaggacatcaagaccccggtcaagattgctattatcaccctgattatgacccaggtaatgaacctggcgtttatcggcccgctgaagcatgcgggtctgtcgctgtccatcggcctggcggcctgcctgaacgccgcgctgctctactggcagctgcgtaaacagaaaattttcaccccgcagccaggctggttggccttcctgctgcgtctgattattgcagtgctggttatggccgcggcgctgctgggcgtcatgcatctcatgcctgagtggtcgctggggacgatgccgttccgtctgatgcgtttgctggcggtggttatcgccggggtggtagcctatttcgccacgctgctggtgctgggcttccgcgtgaaagagtttgtccgtcgcacggcgtaagcggttgtgagggtagaaaaaccccgcttcgcctcaggcgaagcggggttttttttatgatgcgctgcgttcggcagcgaggatgcgggcattctccagcaggcggatcgccagggctagcgcgccagtgatcactgccagcgtgaccactccgttccagccggccagcacgtacagcttactgcccagcaccgatcccagcgacatcccgataaacaccacggtgaacagcagggcgttgaggcggccgcgggcctgtggctcaaggccatataccaggttctgatgcgccaccaggcttgactgcaggccaaggtcaaagccaatcgccgacagggcaatcagcgccaactgagcgtgcactggcagcagcggcagcacaaacatcagggcaaaggagagggtgaccagcgccgcacccatctgtgtcaccttaccggcgccaaatttatcggccagaccgccggcaagcggcgcggccagcgccccggcggccccggcgataccgaaaccgcccgctactgcgctgcccatgtgatagtgttcggagagcatcaccgccagcgtcgaccagaaggcgctaaaggcgatagagagcgcgccctgagctagcgcggcgcggcgtaatgccgggtaacgctgccacagatgcgccatcgaggccatcagctgcggatagctcagcgtcgagtgcacagcgaagcgcggcaggacgcgccacattaccaggccaatcagcgcgacgctgaccgccgccgcctgatacatcacccgccagccgaatacggcgcccaccacgccgctgaccgtccgggagagcaggatccccagcagcagcccggtcatcaccgtgcccaccatttttccctgcttgcccgccggggcgaggatcgccgccgccgggacgatatcctgcgccatggtcgccgccataccgatcagcagactgaccaccagcagtgagctgagctggccggggaggctgcacaggagcagcaggagcgccagcagcgcgcttttcaccaggatcagccggcggcgatcgtggcggtcgccgagcgggagcaggaacagaatgccgagcgcataacccgcctgcgtcagggtagggaccagacccataccttctacagtcaggtggagattggcgcccatcaacggcagcagcggctgcgcgtagtaaatagaggcgacgctaaagccggcgccgagtgcgagaatgaagataatccagcctgcgtcgcgggtggaaagggaagtcggtgtcatgttcaatgcctcatagatgcgatggggctatttttccctgaacgcgactggcgcggtagccgggctggtggtaaaacggttatacgtagcacgtataggcaaaaggaaaatgaaaagacaagagcgtatagaccgcattgagctgatgcgcacctatatccgcatcgtagaggccggatcgctctccgccgccgcagggcagatggacactacccaggcgaccgtcagccgccgcctgcagtcccttgaagggctgctgggggttaagctgatcctgcgcaccacccatgcgatgaagctcactgacgatggcgaacgctgttatcgtcacgcccgtcaggtggtggacgcctggctggcgctggaggatgacctgcgtattgccgacgatcggccggtgggcgttctgcgagtgcgggcgccccacgcgtttggccagcagcagctgctggcgccgctggtggcatttctacagcgccatccgcagctgtcggtggagtggatgctaaacgataataccgtcgacttcctcagcgataatatcgactgcgctattcgcgtgggggcggaggtggatccagcaacggtatccgtactgctggcggaagtgccgcgctgcgtagtggcttctcctgagctgctggcgaagtatccgccgttaacctcgctggaggcgttatcgggcctgccatggatcgacattaataccttttatcagcatgaggtacggctcaggcatcaggcaagcgggcagattgtctctacagcgattactccctgtctgagcactgacagtctttacgtcgcgcgcaacaccgcgctggcggggctgggggtggcgatggtgtccagctggacggtcgtggaggatattgccgccggacggctgattgagctgttcccgcagtggcgacccgcctcgctgccggttcatctggtttatccctgggcgcgctattacccgacacgcctgcgtaagttcctcgacctgatgcgggagatcatgccggatctcgccgggatgcagcgtccgcaaagcgcataaaaaaaccggccaaaggccggtttttttattaagcacgcttactcgacgggctgtgggcgagtcggttcagcggtggctttatgggtcgcgctatgaccaccggcggcgcctttaccttcaaaggcgaacggcgggcgcacccaggtgctgtgacgcggtgcttccgggacatagtccggagctggcgcacgggtcattggcgcggtggcatggcgatgacccgccactacgaccggcttgctcaccgggggctcggctttgaccggttcggcaggggccgcttcggtcactggcgcttgctccacggtttctgcggccggggcgatggtttccactggcgctgcaacgacaggcgtcgtttctaccgcttcaggttctaccaccaccggctcggcgtcgagcgtcactggcgcgatagcctgaggcgcttcgacagccggtgcttcggtgaccggctcctgaggcgctggctcgacggctgctggcgcgacaacttccgcagcatcaacgaccagcggctcggcggccgctaccggctcgacgactaccggctcagcggttactggttccatggtagccggctcgacggtgaccggcgcagcggtaacggtttcaacgacggcaaccggggccgctacggcctcgacagttttcgcgacgctggcgtcctgaacctgaacctcttccggctgctgatcctgcggacgaaccaccgggtagcggatccagactttaccggaagccatctccggcgatgcgcaggctacggtcagcggcataggcgactgggtcggatagcgttcgtcacgatagcgacgacgacgctgaccgctgacgcgcaggtgacgcggggagcgacgtgagcgacgcggcataccgttcgcttcacgggattcgccattttcgtcctggtccgccacgctctccacccctgccggcagctcggctttcaccggctcgctttgcggagcgataacttcagccactacggcttctggcacgatctcggcaactggctcgacgacagcggactcaacgcgcactttctgtgccagctggcgcggtttacgacgcggcagagtttgtacacgctcttcctgctccgtctcctgcacaactggctcttcgcgagtctgcgctttggcttcctgctgcgcctgacgtttgtcgtcattgcggcggcgggtgcgttcgcggcgcggctgctgctcgtcacgggatttcgctttctccgcgtcgtcgcctgaggtttggcgaacatcacgggcttccacgttctgcgacggcttctcgcgacggttgcgacggttctcttcacgcgatacgcgcggttcacggccctcggcattgtccgcacgggtgtcgcgattgtcacggttatcgcggttgtcacgattgtcgcggttatcacggcggtcgttgcggtcgcggcggttgttggcgcgcggtttacgacgctcctgctgacgctccggtttttcttccgctttcttctcgacctgaacttcagccggtttggcctcttcggcgccagagaagatattcttcagcgcgctgaagaagcgtgagagcaggccaggctgcgccggtgcggcggccgcgaccggtgccgctgcggcgacaggcgcggcggcaggctcttcgagcatcggggctggcggcgcatctggcatgacaaaagcggccagggccggctgttccggacgtttccgctccgccggctcatcgtcgcctggcagcgccatctcttcttcatgcagcttcggcagcagatagctcagcgttgaggtttcttcacctttgcgcacgcgcaggacggagtagtgcggcgtttgcatttcgtcgtttggcacgataataacgcgcacatcgccctgacgggattcgatagcgctcactgcggcacgtttttcgttcagcagataggaggcgatcggtaccggaacaatggcgtggacttctttggtattctctttcagcgcttcttcttcgatcagacgcagaatagagagcgacagcgattcgttatcacgcacggtgccggtgccggagcagcgcgggcagacgtggtggctggactcgcccagcgacgggctcaggcgctgacgggacatctccagcaggccgaagcgcgaaatatggctgatctgaatgcgcgcccggtcctgacggacggcttcgcgcagacgattctccacggcgcgctggtggcgaaccggggtcatatcgatgaagtcgataacgatcaggccgccgaggtcgcgcagacgcagctggcgggcaatttcgtcagccgcttcgaggttggtattgaaggctgtctcttcgatatcgccgccgcgggtggcgcgggcggagttgatatcgatcgcggtcagcgcttcggtgctatcgataacgatagacccgccggaaggcaggcgcacttcgcgctggaaggcggactcaatttgcgattcgatctgataatggctgaacagcgggatttcaccggtgtacagtttgattttgctgctgaaatccggacgacccagcgcggcgatatgctggcgcgccagctcaagcactttcgggttatcgatcaggatttcgccgatgtcctggcgcaggtagtcacggaaggcgcggacaatgacgttgctttcctggtggatcaggaacggcgccggacggctttccgcggctttctgaatcgcttcccagtgcttcaggcggaagctcaggtcccactgcagggcttcggcggatttgccgacgccagcggtgcgaacgatcaggcccatgccgtccggaagctccaggctcgccagcgcttctttcagttcggtacggtcgtcgccctcgatacggcgggaaattcccccggcgcgcgggttgttcggcatcagtaccagatagctgcccgccaggctgataaaggtggtgagcgcagcgcctttgttgccgcgttcttctttatcaatctgcacgataacttcctgaccttcccgcagtacgtctttgatattaggacgaccatgcgcattgtagttggcggggaagtattcgcgggcgatttctttgagggggaggaaaccatgacgctcggcgccgtaatcaacaaacgcggcttcaaggctgggttcaatgcgggtgattttgcctttgtagatgttcgcttttttctgttcgtgcccggggctttcgatatccaggtcgtacaggcgctgcccatcaacaagggcgacgcgcaactcttcctgctgagttgcgttgattaacattcttttcatcgtaacttactcattattcttacattgacgactaagctgcgggcagagtaatgcctttccgggggaaaaccgatggcctcgtgtctggttcacgtcgccaacctcacggttgtcgcgcgcttaagaggcgcagagtgtcggtcgcctgtgtttcaaacggaaacacagcgcaattattcaggggaacagcctgggatgtatcaccagagaatattccatttatactcgtcgtctttcgcgttgcaggcatggtggcttaacctgctcacctcgatctggcgatccagatgagctcccgggagtcccggagttgacgccttcctgcgacttgaaatccatagagcctgtaccggtaaggactgcaacccgcagcccgctaactgtctgaaagatcacaacgtcttacgccattgctgcgtgggcgatcggtcagacaaaattggtcattccgctaatgtcttgttctaacaagatgcaatacggaaaacggtctcattattccattgctaaccttgttatagcaagttgactttcaccttttatcacccggttactcacagttttatcacctgcccatacagattgttctaataacaaacaaaatggcggtcaggtaaaccgtgaaaacaggataatgataaatataagcatataaaaatgagtggcgctaatgcgtccggctatttagaatcgcgcaccatgaaaactgagaccccaaccgtaaaaatggttgccattgctgctgatgaagcggggcaacgtatcgacaactttttgcgtacgcaattgaaaggcgtaccgaagagcatgatttatcgcatcctgcgtaaaggcgaggtgcgggtaaacaaaaagcgcgtgaagccggagtataagctggaagcgggcgatgaagtccgtatcccgccggtacgcgtggcggagcgtgaagaagaggcggtatcgccgcacctgcagaaagtggccgcgctctctgaggtgatcctctatgaagacgatcatattctggtgctcaataagccttctggtactgcggtacacggcggcagcggcctgagcttcggcgtgattgaagggctccgcgccctgcgcccggaggcgcgcttccttgagctggtgcatcgtctcgaccgggatacctccggcgtgctgctggtggcgaaaaagcgctcagcgctgcgttcgctgcacgagcaactgcgcgataaaggcatgcagaaagattatctggcgctggtgcgcggccagtggcagtcgcataccaaagtggtccaggccccgctgttgaagaatattctgcagagcggggagcgcatcgttcgcgtgagtcaggaaggcaagccgtcggagacgcgctttaaagtggaagagcgttacgaattcgccacgctggtgcgctgcagcccggtcaccggccgcacgcatcagatccgcgttcatacccagtatgccggccatcctatcgcttttgacgaccgctatggcgaccgagagttcgacaagcagctgtccgctaccggcttaaaccgcctgttcctgcacgcggcggcgctgaagtttacccacccggggagcggggaggtgatgcgcgttgaggcgccgctggacaaccagctgaagcactgtttacaggtgctacggaagagcaaataagcgcaacggcggaatcagttccgccgtttttttgcctcagcctaacagcgggttgtagttttcacggcgcaacatctgacagagcgcgattaagggtaaaccgaccagggtgttcgggtcgcggccttccagccgttcgaacagcgtaatgcccaatccttcgctcttgaaactccctgcgcactgcagcgggttctctttgcgcacatagccttctatctctttatcactgagatggcgaaagtgaacgtcaaagggttcgcattcggtttgcagatggccgctggcagagttgtacagcgccagtccggtataaaaggtaatgattgacccgctggcctttcttaactgcctgcgggcattttcctcggtgtgcggtttgccggtgatttcaccgtccagtacgcaaacctgatcggagcctataataaggtgattagggaagcgtgtggccagactttgcgctttggcctgcgccagtcgggtgacaagctgacgtgcggattcatcaggccggggcgtttcgtctacgtcaggcgcggcacattcaaacggtaaacccagtttttccagcagcatgcaccgccagggagaggttgacgcgaggataagatcagacatattttttcatccacatatagcgcttcgcagagcatcatcttaaactatgcgccgcaatgtgtgcgaataaatggcaaaaggcaacctgaggctgcctttttctttgactctatgacattacaaagttaatatgcgcgccctatgcaaaaggtaaaattacccctgacttttgatccggtacgcacggctcaaaaacgccttgattacgaaggcatctatgcccgcgatcaggttgaacgtgtaaccgattctgtagtcagcgtggacagcgatgtggaatgcagcatgtcgttcgctatcgataaccagcgtctcgccgttattactggcgatgcaaaggtaacggtaactctcgaatgccagcgttgcgggaaaccgttctcccatcacgtccacaccacgtattgttttagccccgtcagaaatgacgaacaggccgaagcactaccggaagcgtatgagccgattgaggttaacgaattcggtgaaatcgacctgcaggcaatggtcgaggatgaaattatcctctccctgcccgtagttccggtgcatgattctgaacactgtgaagtgtccgacgcggacatggtctttggcgaactgcctgaagaggcacaaaaaccaaacccatttgccgtattagccagcttaaagcgtaagtaattgaggagtaaggtccatggccgtacaacagaataaaccaacccgttccaaacgtggcatgcgtcgttcccatgacgcgctgaccgcagtcaccagcctgtctgtagacaaaacttctggtgagaaacacctgcgtcaccacatcactgccgacggtttctaccgcggtcgcaaggttatcgctaagtaatcacgcgatactcgcaggatttcccgttgcaggccatggcgggcgtgtgcgtccctggaaactcggttaacccggtcgctgggggcatttatgcccggattgttgcgtctgcagcgtgaatattcgcgggtgccagcgtgatgaagcttagtgaggactccccgggcaactggggaatcaccgaaccgggcagcgacgataccttgacacgtctaaccctggcgttagatgtcatggggggcgatttcggcccatccgtgacggtgcctgcagcactgcaggcactgaactctaattcgcaactcacacttcttttagtcggcgatcccgacgccatcacgccattactcgccaaagctgacttcgaacaacgttcgcgtctgcagattattcctgcgcagtcagttattgccagtgatgcgcgacccgcgcaggctatccgcagcagtcgcggaagctcaatgcgcgtggcgctggagcttgtgaaagaagggcgggcgcaagcctgcgtcagcgctggcaacaccggcgcgctgatgggtctggcgaaactgctgctcaaaccgatcgaaggtattgagcggccggcgctggtgacggttttaccgcaccagcagaagggcaaaaccgtggtgctggatctcggcgccaacgtcgattgcgacagcacgatgctggtgcagttcgcggtaatgggcgcggtgctggcggaagaagtggtcggcattgccaacccccgcgtcgctttgttgaacatcggtgaagaagagatgaaaggcctcggcagcatccgcgatgctgccgcagtgctcaaaacgctgccttccctcaactacatcggctatcttgaagccaatgaactgttgaccggaaaaaccgatgtgctggtttgtgatggattcacgggcaacgtcacattaaaaaccatggaaggtgttgtcagaatgttcctttcactgctgaaatctcagggagagggcaaaaaacggtcgtggtggctgctgttactaaaacgttggttacaaaaaagcctggcgaggcgattcagtcacctcaaccccgaccagtataatggcgcctgtctgttaggattgcgcggttccgtgatcaagagtcatggtgctgccaatcaacgcgcctttagcgtcgcgatagagcaggcagtgcaggcggtgcagcggcagatccctcagcggatcgccgcgcgcctggaatctttatacccagctggtttcgagctgccggaaagcgacagtgacgtgaacgcccgacagcaaagcgggacgaatggccacgattgacgccgcggcggttgaacgaggcgggtatatcacccaagagtgactgagcgtacatgtatacgaagattattggtaccggcagctatctgcccgagcaagtgcgtacaaacgccgacctggaaaaaatggtagaaacctctgacgagtggattgtcacccgcacaggtatccgtgagcgtcgtattgccgcagcgcatgaaacagttgctacgatgggctttgaagccgcaaagcaggcgctggcgatggcgggcgtgtccgcggagcaaattggtctgattatcgttgcgaccacctccggcacgcacgcgtttccgagttctgcatgccagatccagtcaatgctgggcgttaagggttgcccggcgtttgatgtcgccgccgcctgcgccggtttcacctatgcgctaagcgtcgccgatcagtatgtgaagaacggcgcggtagattatgcgctggttgttggcgccgatgtgctggcgcgcacctgcgatccggcggatcgcggaacgattattattttcggcgacggcgccggcgcggttgtactgggcgcctccgaagagccgggcattatctcgacgcatctgcatgccgacggcagctatggcgaactgctgaccctgccgaacgccgatcgcgtcgatccggaaaacccgatctatctgacgatggccggcaacgaagtcttcaaagtggcggtcaccgagctggcgcacatcgttgatgagacgctggcagcgaataatcttgaacgttcagcgctggactggctggtgccgcatcaggctaacctgcgtattatcagcgcgacggcgaagaaactgggtatgtcgatggataacgtcgttgtgaccctcgaccgccatggcaacacctccgcggcgtcagtcccttgcgcgctggatgaggccgtccgcgatggccgtattcagcgcggtcagctgattttgctggaagcctttggtggcggtttcacctggggttccgcgctggttcgtttttagtataaggatttaaacatgacgcaattcgcatttgtgttcccggggcagggctctcaggccgtaggcatgctggccgaaatggctgccgcctggccggtcattgaagagaccttcggtgaagcttccgcagcgttgggttacgatctgtgggcgctgacgcaacagggcccggcagaagaactgaataagacctggcagactcaaccggcgctgctcgccgcctccgtggcgctgtaccgcgtctggcaacagcagggcggcaaagcgccagcgctgctggcgggtcacagcctcggcgaatactccgcgctggtatgcgcgggcggtatcggtttcgctgatgccgttcgcctggttgagctgcgtggtaaattcatgcaggaagccgtaccggaaggtaccggcgccatgtccgcgattatcggtctggacgacgccgctatcgccaaagcctgtgaagagtctgccgaagggcaggtggtctctccggtgaactacaattctccgggccaggtggttatcgccgggcacaaagaggccgttgaacgcgctggcgccgcctgtaaagccgccggcgccaaacgcgcgctgccgctgccggtgagcgtgccgtcccactgcgcgctgatgaagccagccgcagaaaaactggcggtagagctgcagaagatcaccttcaacgcgccgacgattccggtggtgaataacgtcgacgtgaagtgcgaaaccgcgccggacgccattcgcgacgcgctggtgcgccagctgtacagcccggtgcagtggaccaaaaccgttgagtttatggctgccgagggcgtatcgcatctgtatgaggttggcccgggtaaagtcctcaccggcctgaccaaacgtattgttgacaccctgaccgcttccgcgcttaacgagccggcggcgatgtctgcggcgcttgagcaataaaagaggaaaaccatgagttttgaaggaaaaatcgcgctggttaccggtgcaagccgcggtattggccgtgctatcgctgaaacgctcgtcgcccgtggcgcgaaagttatcggtactgcgaccagcgaaagcggcgcgcaggcgatcagcgactatttaggcgccaatggtaaaggtctgatgttgaatgtgaccgacccggcatctattgaatctgttctggaaaatgtgcgcgcagagtttggcgaagtggatatcctggtgaataatgccgggatcactcgcgacaatctgttaatgcgcatgaaagatgacgagtggaacgatattatcgaaaccaacctgtcatcggttttccgtctgtcaaaagcggtaatgcgcgctatgatgaaaaagcgtcatggacgtattatcactatcggttctgtggttggtaccatgggaaatgcgggtcaggccaactacgccgcggcgaaagcgggtctgatcggcttcagtaaatcactggcgcgtgaagttgcgtcccgcggtattactgtaaacgttgttgctccgggctttattgaaacggacatgacgcgtgcgctgaccgatgagcagcgtgcgggtacgctggcggcagttcctgcggggcgccttggcaccccaaatgaaatcgccagcgcggttgcatttttagcctctgacgaagcaagttacatcactggtgaaacgctgcacgtcaacggcggaatgtacatggtctgaccgagatttgtgcaaaacgttcaggaaccgcgcacttcgcacggttctctgtgcggttttgtgcgaaaagatttgcgttcttagggcaaacggcctcaaaatagcgcaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgagcagctgggcgttaagcaggaagaagttaccaacaatgcttccttcgttgaagacctgggcgctgattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcattcgaccgcctgagttttatctttttattgtcccacaagaatctattttccctccctggaggacaaacgtgtctaagcgtcgtgtagttgtgaccggactgggcatgttgtctcctgtcggcaataccgtagagtctacctggaaagctctccttgccggtcagagtggcatcagcctgatcgaccatttcgatactagcgcctatgcaacgaaatttgctggcttagtaaaggattttaactgtgatgacattatctcgcgcaaagaacagcgcaagatggatgccttcattcaatatggaattgtcgctggcgttcaggccatgcaggattctggccttgaagtgacggaagagaatgcaacccgtattggcgccgctatcggctccggtattggcggtctcggcttgatcgaagaaaaccacagttcgctggttaacggcggaccgcgcaagatcagcccattcttcgttccttccacaattgttaacatggtggccggacatctgaccatcatgtttggtctgcgtgggccaagcatctctatcgcgaccgcgtgtacttcaggcgtgcacaacatcggccaggccgcgcgcatcatcgcctatggcgatgccgatgcgatggtggcgggcggcgcggaaaaagccagcaccccgcttggcgtgggcggcttcggcgcggcgcgtgcgctctccacgcgcaatgacaacccgcaggcggcgagccgtccgtgggataaagatcgtgacggcttcgtgctgggagacggcgcgggtatggtggtgctggaagagtacgagcatgccaaaaaacgcggcgccaaaatctacgccgagatcgttggcttcggcatgagcagcgatgcttaccacatgacgtcaccgccggaagatggcgcgggcgccgcgctggcaatggtgaatgctattcgcgatgcgggcatcgaaccgggccagatcggctacgtcaacgcccacggcacctcgacgccggctggcgataaagcggaagcgcaggcggttaagtctgtcttcggtgatgcggcgagccgcgtactggtgagctctaccaaatccatgaccgggcatctgctgggtgcggcaggggcggtagagtcgatttactctatcctggcgctgcgcgatcaggcggttccgccgacgatcaacctcgacaacccggatgaaggctgcgacctcgacttcgttccacacgaagcgcgtcaggtttccggtatggagtacaccctgtgcaactccttcggctttggcggcactaacggttcgctgatcttcaaaaaagtgtgacagggcttgccccggtactgctttaacaaaaggcccgttcgtcgggccttttttattcagctttctccccttgttctctgctctgggtcctgacacactgaccgaccagtgaaaaggagtcctttatgttcttgataaacggcgttgtacaggacacgttggcagcgaacgatcgcgccatccagtttggcgacggctgttttaccaccgcccgcatccagcaagggcaggttgcgctactggacgcccatctgcagcgtttacagacaacctgtgaaaaattacatatcccatttaacgactggctgacgctgagcgaagagatgcagcgtctggctcggccgcacgcgcagggcgtgctcaaggtgactctcacccgcggcgttgggggaaggggatacagtacggcaggctgcgtgtcgcccactcgcattctcagcttctctccattcccggcgcattatgcgcgctggcgggaggagggcattactctgacccagagtccggtgcccctggggcgcaactcctggcttgccggcctgaagcaccttaatcgccttgagcaggtactgatccgctctcatcttgagcagacggacgccgatgaggcgctggtccttgacagtgacgggtggcttacggaatgctgtgccgcgaatttattctggcgtcagggacgtgatgtatttactccgcgactcgattatgccggggtcaacggcattatgcggcagcgctgtatcgcgcagctggcaccatcgacgtttcgcgttgtcgaagtgacagcgcgtcccgagacgttgcgggaggccgatgaagtgctgatctgcaatgcgctgatgccgctggtgccggttcgccgctgggaggagaccacctggtcctcgcgtgagctttaccattttttagcccctttgtgtgagctgtctggttagtatgaagaaaatgttacgttttatcctgttgctggtcgtgctgttgggcatcgccgcggcggcaggcatgtggaaggtacgccagctggcggacagcaagctgctgattaaggaagagaccatctttaccctcgaagccggcaccggccggctggcgctgggccaggatctctatcgcgagaaggtgatcaatcgcccgcgcgttttccagtggctgctgcgggtggaacctgagctgtctcacttcaaggccgggacctatcgcttcacgccgcaaatgacggtgcgcgagatgttgcagctgctggccagcggcaaagaggcgcagtttccgctgcgctttgtcgaaggcatgcgcgtcagcgactacctgcgccagctgcgcgatgccccgtacgtgaagcacacgcttgaagacgatagctacgcgacggtggctaaggcattaggtcttgagcatgccgactgggtagagggctggttctggccggatacctggatgtacaccgccaacaccagcgatatcgccatcctcaagcgcgcgcatcagaaaatggtcgccgaagtggcgaaggtctgggaaggacggatggagaatctgccctatgccgatcagaaccagctgttgaccatggcctcgattattgaaaaagagaccgcggtagcggaagagcgcgaccgcgtcgcgtcggtatttatcaaccgcctgcgcatcggtatgcgcttgcagaccgatccgaccgtaatctacgggatgggcgaaggatatactggtaagttaacgcgtaaggatctcgagacgccgaccgcatacaatacttataccatcagcggtttgccgccgggccctatcgcggtgccgggcgaggcctcgctgaaggcggccgcccatccggcgaaaacgccatatctttatttcgtcgccgacgggaaagggggccatacgtttaccacaaacctggtcagtcataaccgtgcggtgcaggattatctgaaagtacttaaggaaaaaaatgcgcagtaactatatcgtcatcgaggggctggagggcgccgggaagaccaccgcacgtcaactgggggtggagacgctgcagtcggcgggtattcacgatatggtgtttacccgcgagccggggggcacaatccttgccgaaaaactgcgtagcctggtgctggatatccagtccacgggcgatgaagtgattaacgataaagcggaagtgctgatgttttacgcggcgcgcgtccagttggtggagaccgtgattaagcccgcgctggcccgcggccagtgggtgatcggcgatcgtcacgatctgtcgacgcaggcctatcagggcggcggccggggaattgaccgcacgatgctggcgacgctgcgcgacgcggtactcggtgattttcgccccaatctgacgctgtatctcgacgtcacgccggaagtggggctgcagcgcgcccgggcccgcggcgagctggatcgcattgagcaggagtccatgaactttttcaaccgtacccgcgcgcgctatcttgagctggccgccgccgatccttctatccgcacggttgacgcaactcagccgctggatgccgtggcgcgcgacattcgcgccacgatcgcccagtggatggcggagcaagcggcatgaaatggtatccgtggctgcgcccctcgttcgagcaactggtcggtagctatcaggccggacgaggccaccacgccttactgttacagtccctgaacgggatgggcggcgaggcgttgatttacgcgctgtgccgcttcctgatgtgccgccagcccgaaggacataaaagctgcggccactgccatagctgtcagctgatgcaggccggcacgcaccccgattactatgcgctcagccccgagaagggcaagagcgcgctgggtattgacgcggtgcgcgatgtcaatgaaaagctctatgaacatgcgcgccttggtggggcaaaagtggtctggattagcgatgctgccttgctgaccgatgccgccgccaacgcgttgctgaaaacgctggaggagcccccggagaatacctggttcttcctcgcctgcgaggagccggcgcgtctgctgaccactctgcgcagccgctgtcgcctgcatcatctggcgccgccgtctgagccttatgctctggcctggctggagcgtgaggtgagcctgccgcaggagtcattgttgaccgcgttacgcctgtgcgccagcgcgccggctgcggcgctcgaactgttacaggaaccgctgtggacggcgcggcagcagttgtgtcaggcgctggcggctaccctggcgagcggtgactggctgacgctgctgccgatactcaatcatgaacaggcggcggttcgcctgcactggctggcgtcgctactggtcgatgcgcaaaaacgacagcaggggattaccctggtgagtaaccctgacgtctggccgctgctggagcagctggcgcacagcctgcccgccgcccggctgcaggcgattgcccatgacgtctgtacctgccgcgagcaattgctcaacgttgtcggtgtcaaccgcgaactgctgcttaccgagcgcctgctgcgctgggaacattacctgcaacccgggacgggtttacccgtctcccacctctgagtgagacattatgtttttagtcgactcccactgccatcttgatggtctggattatcaaactctacacaaaaacgtcgacgacgtgctggcaaaagcggccgcacgcgatgtgaaattttgcctcgccgtcgccacgacgttgcctggctaccgcagtatgcgcgaactggtggggacgcgtgacaacgtcgtcttctcctgtggcgtacacccattaaaccaggacgagccctgggaggtagagaccctgcgcgcgctggcagcggaagagggcgtcgtggcgatgggggagaccggtctggattatttttataccccggaaactaaagcccaacagcaaagctcgttccgcgaccacattcgtatcggccgtgagctcaataagccggtgattgtccatacccgtgacgcacgtgccgatactctggctattttgcgcgaagaaaaggtgacggattgcggtggcgtactacactgtttcactgaggacagggagacagcgggcaagctgctcgatatggggttctatatctcgttttccggtatcgtcacttttcgtaacgccgagcagctgcgtgatgcggcgcgctacgtgccgctggatcgtctgctggttgaaaccgactcgccgtacctggcgccggtcccccaccgcggcaaagagaaccagccggcgctggtccgtgacgttgccgagtatatggcggtactgaagggggtgtcgcttgagcagctggctcagcagaccaccgacaattttgccaccctgttccacatcgaccccgcccgtttgcaacctgcttgatctgcttattattttaaggctcgtaattaatagccaaagcgagtaaagttcaccgccacaaaagtggcggtgaaggttttttagcaacatctggatacaatttatgtaagttgatgtaaatttttaccggaaggctgattgaaacgtgatagccgtcaaacaatcatcccgttaattattttactctgtgtaataaataaagggcgcttagatgtcctgtccacggcacggttctccccccgggccaatgcgtgaaagcgtaaaaaagtaccaaatactcaggagcactctcaattatgtttaagaatgcatttgctaacctgcagaaggtcggtaaatcgctgatgctgccggtatccgtactgcctatcgcaggtatcctgctgggcgtcggttccgctaacttcagctggctgccagccgtggtctcccacgttatggcagaagcaggcggttcagttttcgccaatatgccgctgatcttcgctatcggtgtggccctcggcttcaccaataacgacggtgtatccgcactggctgcagtcgtggcttacggcatcatggtgaaaaccatggcggttgttgcgccgctggtgctgcatttacctgctgacgagattgcggcaaaacaccttgctgataccggcgtgcttggcggtattatctccggtgctatcgccgcctacatgttcaaccgcttctatcgcatcaagctgccagaatatctcggcttctttgcgggcaagcgttttgtgccgattatctctggtctggccgctatcttcaccggcgtgatcctctccttcatttggccgccgatcggctccgcgatccaaaccttctcccagtgggctgcttatcagaacccagtggtggcgtttggtatctacggtttcatcgaacgttgcctggtgccgtttggtctgcatcacatctggaacgttcctttccagatgcagatcggcgaatacaccaacgcggctggtcaggtgttccacggcgatatcccgcgctacatggcaggcgacccgacggcgggcaaactgtctggcggcttcctgttcaaaatgtatggtctgccggcagcggctatcgcgatttggcactctgctaaaccggaaaaccgcgccaaagtgggcggtataatgatctccgccgcgctgacctcgttcctgaccggtatcaccgagccgatcgagttctcgttcatgttcgtggcgccgatcctgtacgttatccatgccattctggcgggcctggcgttcccgatctgtatcctgctgggtatgcgtgacggtacctcgttctctcacggcctgatcgactttatcgtgctgtccggtaacagcagcaaactgtggctgttcccgattgttggtatctgctatgcgatcgtgtactacgtcattttccgtgtgctgattaaagccctggatctgaaaacaccgggtcgtgaagacaccaccgaagagagcaaagctggcgccaccagcgagatggctccggctctggtcgccgctttcggcggtaaagagaacatcaccaacctcgacgcatgtattactcgtctgcgtgttagcgtggcggatgtagcgaaagttgaccaggctggcctgaaaaaactgggcgccgctggcgtggtagtggcaggttctggcgtacaggccatcttcggtaccaagtccgataacctgaaaactgaaatggatgagtacatccgtaacagttaagacgtagtatcggggagactaaggcagccaactggctgccttttttatgcgctaaagtcggtgccccacaagcgataaccctgaaaacagtccgccatatgcttattccctcagcagctaagtctatagttgaataagaaaaagagctttcaggttgaaagagagggagaatgtcgctcatactcttagcggaacctgtgcgtccgcgtttatctgcagaagcaggccagcgcacgggataaaacttataaggaatcagtcatggcagaagaaacgattttcagcaaaatcattcgccgggagatcccgtcggatattgtctatcaggatgagcttgtgaccgcttttcgcgacatctccccgcaggcgcccacccatattctgattgtcccgaatgttctgattcctaccgtaaatgacgtcaccgctgaacatgagctggcgctgggccggatgatgaccgtcgcggcgaagatcgccagcgatgaaggtcttgccgacgatggctatcggttgatcgtcaactgcaaccgccacggcggccaggaagtgtaccatatccatatgcatctgctgggcggtcgtccgcttggcccgatgctggcgcacaaaggctaacgtcatgctcaggacccttttgggcgcgtgtctggcggcggggctactcgccgggtgtagttcacacccggaaatcccggtttctgaccagcaggcgctggtgatggagtcgagcgtgctggcggcggggatcagcgccagcgagcctgccgtcgtggcgacagagattcaggctaccgcctcctcaacgctatataacgagcgccagcagccggttaccgtgcactatcgttttttctggtatgacgcccgagggctggagatgcatccgctggacgcgccgcgcaccatcgtggtaccggcccgctcctcggtcacgttatatggcagcgccaatatcctgggggcgcataaggcccgcctttatctttatctgtaaggggtaattataatgatgaaaatgtgtcgctatgcgttaatcacagcactggcgatattcctcgcaggctgtgcggggttgcgggagcagcccgcgccggtagaagaggccaaaccgcagccgcagcagcctgcgcagccgcagcccacggtgccgaccgtaccggcggtgccctctgtcccggcgcagcctgggccgattgagcatcaggatcagcagtcgggtcagccggcgccgcgcgtgcgtcattatgactggaacggcgcggttcagccgctggtggggcagatgctgcaggcgagtggggtcaatgccggcagtattctgctggtcgacagcgtgaacaaccgcaccaacggttcgctgaatgctggagaagccaccactgcgctacgtagtgcgctggccggtaacggcaaatttaccctggtatcggcgcagcagctggcggtcgccaagcagcagctgggcctgtcgccgcaggacagcctcggcagccgcagcaaagccatgggcattgcccgcaacgtgggcgcgcagtatgtgctttactccaatgccaccggcaacgtcaacgcgcctgagctgaaaatgcagctcatgctggtgcaaaccggtgagattatctggtcaggtaaaggtgctgttcagcaacaataagctaacgcgcgacgagctcttgtcgcgcttctttccccattatcatcctgtcgcctcgctgagccagagtggcctcagcggcggcagtgtgattattagcgacggcgaccggcggcacgtgctgcgtcagccgcacgatccgtctgccgccacttaccattttcgccgtcagtatcacgcactccgccgactgcctgccaggctggcgccaaccccgctgttttactcaccctgctggatggtggtggagtattgcgcaggggaggtgaaaagcgagttaccggcctccccgcagctgtcaggcttattgtatgatttgcatcagcaaccgcggtttggctggcgggttagcctcacaccactgctggcccagtactggcagaggtgcgatccggcgcggcgcaagccgcgttggctgcgctggcatcagcggctgcgccgccagggcgagccccgtcccctgcggctggcgccgctgcacatggacgtccatgccggcaatattattcataatgagtccggcctgaggctgatcgactgggaatatgccggcgatggcgatatcgcgctggagctggccgcggtgtggatcacgcctggcgcgcgccgtcggctggtagaagcgtatgcccggcgggcggccatcgacgcgcagctgctttggcggcaggttgcactctggcgcccgtgggtactgctgctgatggcgggctggtatgaaatgcgctggcggcagagcggggaccggcaatttatcacgctggcagatgaaacatggtgtcagttagacaacgaacgtaaaggataagagaggtcagtgtgggcccagtgatgttggatgtcgaagggtatgagctggatgcagaagagcgagaaattctggcgcatccgctggtgggagggttgatcctctttacccgaaattatcacgatccggcgcagctgcgcgagctggtgcgccagatccgcgacgcctcccggaaccacctggtggtggcggtcgatcaggaaggggggcgggttcagcgtttccgcgaagggtttacccgtttaccggcggcccagtctttcgccgcgctgctggggatggaagaggggggcaaactggccgccgaagccggctggctgatggccagcgaaatgatcgccatggatatcgatattagttttgcgccagtgctggacgtcggccatatcagcgccgcaatcggcgaacgttcttatcatgaagatccgcagaaagcgctgacgatggcgcgtcacttcattgacgggatgcacgccgcgggcatgaaaaccaccggcaaacacttcccgggacacggggcggtgactgccgattcgcacaaagagacgccgttcgatccgcgggcggcatcggttatccgcgaccatgatatggcggtgttcaaaagccttatcgccgagcagcgtctggacgccattatgccggcgcatgtgatttacccggagctcgatccgcgtccggccagcggctcggcgtactggctgaaaacggtgctgcgcggcgaactgggctttgacggggtgattttctccgacgatctgtcgatggaaggggcggcgatcatgggcagctatgccgaacgcggtcaggcatcgctcgacgccggttgcgatatgatcctcgtctgcaataatcgtaaaggcgcggtcagtgtgctggataacctgtcgccgatcaaagcagagcgtgttacgaaattgtatcataaaggttccttttcccgtcaggagttaagggattcagcccgttggaaaacggtgagtgcccagctggagcagcttcatgcgcgctggcaagaggcgaagtccgcgtaacgctctacggggcgttgttgtctggtgaggatgcgatgattatctatttacacggttttgactcgaacagccccggtaaccatgagaaggtgatgcagctgcagtttatcgacccggacgtgcggttgattagctacagcacgcggcatcccaagcacgatatgcagcatttgctgaaagaggtcgataaaatgctgcagctcactgccgatgaccggccgctgatctgcggcgtcggccttggcggctactgggcggagcggattggttttctgtgcgatatccgccaggcggtgttcaatccaaacctgtttccgcatgagaacatggaaggcaaaatcgaccgaccggaagagtatgctgacatcgccaccaagtgcgtgaccaacttccgcgagaagaaccgcgatcgctgcctggtggtgctttcccgccaggacgaggcgttggacagccagcgttccgccgatctcctgcaccactattatgaaattatctgggatgaagagcagacccataagtttaaaaatatctcgccgcatctgcagcggctgaaagcgtttaaaaccctcggctaactgcttttcccttgttcccaaacccgcgtcgggttcaccacgcgggttttttcatgtctacacttattggtttcgctgaaaaaatacgcgacaaaacttgatgcacatcaattttggtatgaccaatgcaccgttcatggtattctcgacagtgctgaatggtttcattaacgtaacttgttgttaaataaaggctatttcaataacttttatttaacaattggttaataattttaggggtacacatgactacgccattgaaaaaaatcgtaattgtgggtggcggcgctggcggactggaactggcaactcagctggggagaaagttagggcgccataagaaagcgaaaatcaccctggtggaccgtaaccacagccatctgtggaagccgctgctgcacgaagtggccaccggttctctggatgaaggcgttgatgcgctgagctatctggcccatgcccgcaaccacggtttccagttccagctgggctcggtggttgatatcaaccgcgaagggaaaaccatcaccctcggcgagctgcgcaatgaaaaaggcgagctgctggtggctgagcgtaaactgccgtacgacacgctggtcatggcgttgggcagtacctcgaatgactttaatacccctggtgtaaaagagaactgcattttcctcgacaacccgcaccaggcgcgtcgcttccatcaggaaatgctcaacctgttccttaaatactctgctaacctcggcgctaacggtaaagtaaatatcgccatcgtcggcggcggcgccaccggcgtggagctctccgctgagttgcacaatgcggtgaaacagctgcacagctacggctacaaagggctgaccaacgaagcgctgaacgtcacgctggtcgaggcgggcgagcgcattctgcctgcgctgccgccgcgcatttccggggcagcgcataatgagctgactaagctgggcgtacgggttctgacgcagaccatggtcaccagcgcggatgcgggcggcctgcacactaaagatggcgaatatattgaggcggatctaatggtctgggcggcggggatcaaagcgccagatttcatgaaagagatcggcggcctcgaaaccaaccgtatcaatcagttggtggtcgagccgacgctgcagactacccgcgatgcggatattttcgccatcggcgactgcgcctcctgcgcccgtccggaaggcggctttgtgcctccgcgggcccaggcggcgcaccagatggctacctgcgcgctgaacaacatcctggcgcagatgaaaggcaaaccgctgaaggcatacacctataaagaccatggctcgctggtgtcgctgtcaaattactccaccgtcggcagcctgatgggtaacctgatgcgcggttcgatgatggtggaagggcgcattgcgcgcttcgtgtacatctccctgtaccgtatgcaccagattgctctgcatggttacttcaagaccggcctgatgatgctggtcgggcgcatcaaccgcatcattcgcccgcgcctgaagctgcactaatcgctgtcgcgacccggaggcgcgctctgagggcgcctccgggcttttctgctgaaaccgcagagatcccgctcggaatcctctgaatccctttgatttgcagcgaattctcgcacttttcatccgctatctgatttgcgccctcccggctccggttgcaaaattgtatcaacagcaacaaaggaggaactcccgtgaataaatctatgttggcgggtatagggataggcgtggctgccgcgctgggcgttgcagctgtcgctggtctcaacgtgttggatcgcggcccgcagtatgcgcaagtggtctccagtacaccgattaaagaaaccgtgaaaacgccgcgtcaggaatgccgcaatgtcacggtgactcatcgtcgtccggtacaggatgaaaaccgcatcgccggttcggtgctgggcgcggtggcgggcggggtgattggccaccagtttggcggcggtcacggacgcagcgtggcgacggtcgtaggtgcgctgggcggcggctatgcaggcaaccagatccagggcgcgatgcaggacaacgatacctacaccaccacccagcagcgctgcaaaacggtgtatgacaaatccgataaaatgctcggctacgatgtgacctataagataggcgatcagcaggggaaaatccgcatggatcacgatcccggcagccagatcccgctggacaacaacggccagctggtcctgaacaacaaaatctaaaaacagatttgtgtagtgattagcccctcaatcgctcaggctgaggggctttttttatcagaaggttaaggcgtagttcagaccaaaggtgcggccacgacctttgtactcatacagcgatgaactgccgtaggttgggctgtagagcagcggcgcgcgctggccccagatagtgacatagtcttcgttaagcaggttttcgatactgaaggtcagtttccccaccggcagcgcgtaactaccgataaaatcgacggtgttatagccttccagcttgttaccggcggcatcgctgaggtcaaatacctgctgactctgcacgcgcaggctccacggatccggcgcccagcccacccaggcggtggctttagacggcgaggcgagggtgacgtcccatttttgccagcggccgtcggtctgcacctgggatttcagcacgttaaagttaccgccgacgctccagtcgctatccggaataaagtaatcgaccgccccctcaacgccgtaaatacgccgtttgtcggactgaacgtcgatggtcatgtcggtgcggttgacgacaatggtcttatccgaggtcgagtagtacgccgccagctgggtgcgcaggttatcgccggtgtagcgccagcccagctcatacgagttaactttgatcccctgcagcggcgagtcatcgacgttgacgctggagatcagcggcagatgaccattcaccgcagcgccatatttaccgatgccatagtatttaccagggtccggtagctcgacaccctgcgagaagttaaaccaggtttgttgacgctcggtcaggtgggccacgatcccggcgttaaacaggaaattgtcataatcggttttgccgcctttgatggcgtcggcggagcgcgctttgccgttggcgatatcctgctgctgggcgtagccgacaaagtcgtcgacccggttttcggtccactggtagcgtaccccgccgctgacggtaaagatatcgttcagatcgtagctggactgcaggaatggcgcgacattggaaatactgtatcccgggtagcggccggttgtgtagatcgattcgttgtgcaacccgccggaggccatcgattgtggcagatcgaagaacatctggttggcattaaaggtctcatgatcggcgtcgagaccccaggtgagatcccaccccgccagcggttgactgttgagggtcagcttggccccatactgatcggtatcctgctgcgacgaggagaagctactgacctgacctttcgtgagcgtcgggaacggatagaaggtgagggactcatcgcgatagtacacctggctcaccagattctggccgaaaaagtcggcatcggagtactggaggctgatcagatggcgttcggtgccggggatacggtcggaattgagcccgtcggtggtatacgctttgccgccgctggtgaccgcggacatgttcttcccgagccagagaccgtagtcatcatcgccctggcttttataatactgggtgaccagctgcagctggcggttatcatcgatctcaatcgtccccgtccccattacgtcgaggcggtcagagtgctggagccccgtttgggtattatcgaggatcagcgcatcgttattgccgtcgtaccagccgccgaaacgctgataggctaccgacaagcggccggatgcgtggtctgttccgccgctgacggccgccgcgacgcgctcatcatgatcgttgctgttcgcaaaaccgctcttgctgcccacctcaagatcgacctgacgatcctgctgcccctttttggtaacgatgttgataagcccgccggtactgcccccgccgtacagcgaggtcgctccggagatcacttcgatatgttcgatgttgaatggatcgatggcgtcgagctggcggctgtcggtgcgtgaggagttgagtcggacgccgtcaatcagcacgacgatcgcgcgcccgcgcatgttcatcccatagttggtccgcccctggctgctgacgtcgatgccggggatcagctgcgccagcacgtctttgaactctttcccgccctggacctgctgctcaatctcctggccctcaatgacccaggtggtttgggccatttcggccacggtgcgatgggtgcggtttgcgctaacgatgatgctgtcttcatcagactgagccgccagcgcaggcagcgtgctggccagcagcagagggtggagcacccagaggcgctttttcatatccattccttttatgagcaagttgctttgtcgttgttatgggccggcgtcggccggtattcgttacaatgcgaaacatctggaaaaactcaaaaaaggattttgcacataatgaatatcgcaatcaatatcatttgcgtttatcttgcgcgagaaaaggtaataaaaatcaatctattttgtggggataaagccaacaggagagcggatccggcggcagaataccgccggaagcagggcgcatcaggactcgaggacctgcggccagagacggagagtggtgtcggtgatttgcatcagcttgtcgaaatccgcgccttcccgggcgctaatcgacatcccctgcagaacgcagttaagaaattgcgccagctgcgcgacatcgcggcccgcgggcagttcgccctgcgcctgccgctgctgcagaaactgggttagcgcctgctcctgcatcgcatggcgggatttgatggtattggcgatatccgtcgaggaggcggccagcgcggcggaggtattgatgataaagcagccggccggcgtctctttgctggtaaagcaggtggcgaccgccgtgaagtagtcacgcaacgcgcgatcgacggattttccctcggcaaacagcacggcttcgtgcttcgcggcaaagcgggaaatgtaacgatccaacactgcgcggaataggccttctttattcacaaattccgcatacagggtgggggcttttgctcctgtcgcctcgaccagatcggcgagcgaggtcgcctcatagccgtgctgccagaagagtgtcatggctttgtccagcgccgcatccctgtcgaacaccttcggtcggccacggctttttttggcgcaactttgaacgtcagttgtcatggtgccgttgtacctatgttggtttggtgaaaggccattataaaaataaacgatcgccggggccagcgctgtcggtttaaaaataaataattcatatatgtatgaaatttaagcattttataaatagttaaacgatcgttataaaaatgcattgacgtgtgacatagatcacattattatttacctatcgatcgttaagttaatgcttgcgaccctactataaaattcatctgcacaggtataataatcatgaaaaccgttaatactctggctattgccgccgttttaagttccctttctttcgccagctttgccgctgtagaggtgcagtccacccctgcaggacagcataaagtaggcaccatctctgcttctgccgggactaacctgggctcgctggaagaccagctggcgcagaaagcggatgagatgggcgccacttcatatcgtattacttcggtaaccggtccgaatacccttcacggtaccgccgttatctacaagtaagcccgatgcgtcgctgcccggcccccttcaccggacagcgatgagtaagaccctgttgtacccctgtttgacccttgccaacaaaaaacccgccatcaggcgggttttttgttttgtgcagcgtaagactacaacgactgcggtcctgagtcagcttgacgggtgacgtcaatcggcatgcccgagcggtaattcatcgcgcgctccatcaccgtcccgtcggtctgcggcgcctgtttgaacgcagtcatggccgcattaagcgtaatgggcagggtctgcgggtcgtcatcgatatgctcagacagcggctgatggacctcaaccagacggcggccatccggctcgaccgacgccttgatcggcgtgttgataatgttcaccttcgtgcccggcgagatagtgttgtacagcgccttgatatcgttatcgcgcagacgaatgcagccggaactgacgcgcataccgatgccgaaatcggcattggtgccgtgcaggagatagactccgccataggcggcgaggcggatggcgtgatggcccatcggattgtcaggaccagcaggcactaccgccggcagctcaatccccatagccttgtagcgcgcgcgaatgttggcggtaggtgtccaggtcggattggcccgtttgtcggacacggttgtgaccatcgtcggtgtgatggtggtcccacccagctggccgatgccgattgggtagacggtcacttcattcttgcccggcgggtaatagtagaggcgcagttcggcgaggttaatcaccagcccttcgcgcggcgcatcgggcagcagcgtctgcagggggatggtcagcacgctgccggcgcgcggaacataggggtcaaccccgggattggcctgcagcagggccaggaagccgacattgtacttcttggcaatcgcttccagcgaaccgccgtcatcctgtaccacatgaaactgattctgacccaccagccggctgcccggcgggggaaggggccaggtgttagcgcgcgcggggagggccagcgcggcgactaacgcgactagcgtcagccaaagcgtcacggggaaacggtttctcattaccataactccaaaatatgtaagtggttatttttatacgaaaagcagatgagattatggcgtgagtctgtgtggggaaatccaggcggattgcaaaatgtttgtaaagattgccagatatgtgggaagggagatacggcagcggggccgtatctcctgccagtcaggcgacggcgttctcttccagctggcgcataaactggcgaacccagtccatccgcgttttacgctcctccaggtcctgcatgaacttcaggcgcgtgggaccgtccaggcggaagtgctggggctgcttttgcagcaggccgatcagccacaccggattgacgttgtttttctcgttaaattcgatcacgccgcctttttcgttgctttccagcttgcggatccctaacttttgcgcctgctgacgcagacgggcgatatccagcaggttgcgggcggcatcgggcaggcggccaaaacgatcgatcagctcgactttgatctcctccagatcctgttcgtttttggcgctggcaatacgcttatagaatgacaggcgcgtattgacgtcagggatgaaatcatcaggcagcagggaaggcatgcgcagttcaacctccgtctgctgactggtgagatcttccagcgagggttcacgcccggctttcagcgcatcgactgcgttctccagcagctccatatacagggagaaaccgatggtttccatctgaccgctctgatcttccccaagcagttccccggccccgcgaatctccagatcgtgggttgccagcgcaaagccggcgccgagatcttccagcgacgcaatggcctcgaggcgcttttgcgcatcggtggtcatcgctttcggatgcggcgtcagcagccaggcataggcctggtgatgcgaacggccaacgcggccgcgcagctggtgcagctgggcgaggccaaaatggtcggcgcgttcgatgatgatggtgttggcggtgggaatgtcgatcccggtttcgatgatggtggtgcacaccagcacattgaagcgttgatgatggaagtcattcatcacccgctccagttcgcgctccctcatctgaccgtgaccgatggcgatccgcgcctccggcaccagctccgccaacttgtcggcggctttctggatgttctcaacgtcattaaacagatagtagacctggccgccgcgcagcgtttcgcgcaggatcgcctcgcgcaccaccagggcgtcatattcgcgaacgaaggtcttcaccgccaggcgtcgcgccggcggcgtggcgatgatcgacagatcgcgcatcccgctcatcgccatgttcagcgtccgcgggatcggcgtggcggtgagggtcaggatatcgacatcggcgcgcatcgctttgatgcgctctttatgccgcacgccaaaccggtgctcttcgtcgacgatcagcagcccgagatcgcgcagcttcacctcgctctgcagcagcttgtgggtgccgatcaagatatcgattttgccttccgcggcctgctcgaggatctgcgcctgctctttagcgctgcggaagcgggagagcatttcgatgcgtaccggccagttggcgaaacgatcgcggaaattgtcatagtgctgctgagccagcagggtggtcggcaccagcaccgccacctgcttgtggttctccacggcgaggaaggcggcgcgcatggccacttcggtcttgccgaagcccacatcgccgcacaccaggcggtccatagccagcggctggcacatatcgctgaggacggcgttgatcgcctgcgcctgatccggcgtggtttcaaatgggaagccgtcgcagaatagctgatactgttcgcggtcgtgtttaaaggcaaaacccgccttcgccgcgcgctgggcatagatatccagcagctcggccgccacgtcgcgtactttctcagccgctttttgtcgcgcccgggtccaggcatcgccgcccagcttgtgcaggggggcgttttcttccgccccgccggcgtagcggctgataagatgcagggacgataccggaacgtatagcttggcatcgttggcgtaggtcagcatcagatattcgccggtgatgccgccggcttccagggtagtcatgcccgcgtagcggcccacgccgtgttccaggtgaacgaccggctggccgatatgcagttcggcgaggttgcgaatcagagtgtcagggttaatggtgcgtcgcgaatcctgacgacggcgcgccacccgctcgccgagcaggtcgctctcgcaaatcagtgccaggccgcgctggctgtcgataaacccgtgctcggcggcgccaatcatcagatagcggccgttgccggtggcttcctccagacgcagcacatgttttggcgcaactttaatccgcgccagcatttcgctcagcgcttcacggcggccttcgctttccaccgagaagatcaccggaccggtaaaggactcgaggaagcggcgcagattatccagcggcgctttgttctgcgcctggacggcgaggtccggcagcgtctggtagcccagattagtatttgccgctttgtccgccagacgttcggttttcagctgcacgcgcggccattttttcagttcgctgaatagctcatcgctgcgcagccacagcagctcaggcggcaggagcgggcgcatcgggtcgacgccgcggttttcaaagcgggcgcgggcttcattctggaatcgttccgcgctggcctcgagatcgccggtgttgacgatcagcgtgctggccgggaaatagctgaataacggcggcagcggctcgctgaagaacagcggttgccagtattcgataccggcaggtagcgtccctttactgacctgctgatagatgtgttcggcatcgcgcttcacctcaaagcggtcgcgccactggctgcggaacagctcaatagcggtctggtcggtggggaactcgtgcgccggcagcaggttaatggccgccacttcctccagcgtgcgctggctgtcaacgtcgaacaggcgcaggctgtcgatttcatcgtcaaagaaatcaaggcggtagggctgatcgctacccatcgggaacaggtcgagcagcgcgccgcgggtagcatattcgccgtgctccatcacctgatcgacatggcggtagccggccccctccaactgatcgcgcagcgcatcgcgcgacaggcgctggccctttttcatcaccagcgcgtggccgtgaaggaagctgtgcggacagacgcgctgcatcagggtgctgaccgggacgatcagtacgccgcgctgcatggtgggtaactggtaaagggtggcaagacgggaggagatgatgtcctgatgcggcgagaagctgtcgtaagggagcgtttcccagtccgccagccccatcaccatgctgtcggtaaactgcctgatctcgtcgttcagacgcagcgcgttttgcatgtcaggcgccaccagcaccaccgggccgctgtggcgttcggccatctccgccaccagggtggcgcaggctgcgccggtcaactcgccaagctggcgctgatcgccggctttgaccggcaatgagtatcgatattgttcaggcatagacggtttcatgatctcttagggattcgctctgccgatatggagggcaactcgctgatattcaatagtgagattatccgcgattggtctggattcgccaacccgaattgccatcgcgtattgggtgaagaaaggtcagcgctgtcgataagcgtaaagataaataagtaagtacttatctatccgtttgtatttacttggtttttaggattattgctaataaagtcgtcatgtatcagtcgtttacgctgcctctaatcgcttatatactcgggcatcggctatcagcaaccagatggatgacatgtaccaacctgccgcactctttatcggcctacgctatatgcgcgggcgcgcagccgaccgcttcggtcgtttcgtctcctggctctcaactatcggtattacgcttggcgtaatggcgctggtgacagtcctgtcggtgatgaacggctttgaacgcgagctgcaaaacaacatcctggggctgatgccacaggccattcttagcgccaaacagggttcggtgaaccctcagcaactgccggagcgcgaagcgaaacttaatggggtaacccgcgtagcgccgatcaccaccggcgacgtggtgctgcagagcgcgcgcagcgtggcggtcggggttatgctgggcattgatccggcgcagaacgatcccctgactccatacctggtgaacgtcaaacagagcgatctgcaggcgggcaaatataacgttattctcggcgagcagttggcgggccagctgggggttaatcgcggcgataaaattcgcgtgatggttccttccgcgagtcagtttacgccgatgggccgcgtgccgagccagcgtctgttcacggtcatcggcaccttcgccgccaacagcgaagtcgatggctatcagatgctgaccaacatcgacgacgcctcccgtctgatgcgctatccgctggggaatatcaccggctggcgcctgtggctggataaaccgctgcaggtcgacaccctgagtcaacagacgctgccgccgggaactcagtggcaggactggcgcgagcgcaagggcgaactgttccaggcggtgcgcatggagaaaaatatgatgggcctgctgctgagcctgatcgtcgccgtcgcggccttcaacattattacctcgctggggatgatggtgatggagaagcagggcgaagtggcgatcctccagacccaggggctgacgccgcggcagattatggccgtctttatggtgcagggggccagcgccgggatcgtcggcgcgctgctgggagcggtgcttggcgccctgttggccagccagctgaataatttaatgccgatcatcggcgccttccttgacggcgcggcgctgccggtggcgattgagccgctgcaggtcattgttatcgccctggtggcgatggtgctggccctgttgtctacgttgtacccttcctggcgcgctgccgccacccaacccgctgaggctttacgttatgaataagatcctgctgcaatgcgacaacctgtgcaaacgctatcaggaaggcaatgtgcaaaccgatgtcctgcacaatgtcagcttcagcattggtgaaggcgagatgatggctatcgtcggcacctccggctctggcaaaagtacgctgctgcatctgctcggcggcctggatacgcccacctctggcgacgtgattttctccggtcagccgatgagcaagctatccaccgccgcgcgcgccgacctgcgtaaccgcgagctgggctttatctatcagttccaccatctgctgccggactttagcgcactggaaaacgtggcgatgccgctgctgattggcaaaaagaagccggcggatattgaacgccaggcgaaagcgatgctgcaggcggtcgggcttgaacaccgcagccatcaccgtccgtcggagctctccggcggcgagcgccagcgggtggcgattgcccgcgcgctggtgaataaaccgcggctggtgctggcggacgagccaaccggtaacctcgacgctcgcaacgccgacagcatcttccagctgctgggcgaactgaacgtcgcgcagcgcaccgcgtttctggtggtgacccacgacctgcagctggcgaagcgcatgagccgccagctggagatgcgcgatggccgtctgaccgccgacctgaccctgatgggggccgagtaatggcgtctccgttatcgttactgattgcattgcgtttcagccgcggccggcggcgcggcggcatggtgtcgctgatctcggtgatctccaccatcggcattgcgctgggggtggcggtgctgatcgtcggcctcagcgcgatgaacggctttgagcgcgagctgaataaccgcgtgctggcggtggtaccgcacggcgaaatcgaacccgtgaatcagccgtggaataactggcaggaagcgctggcgaaggtgcagaaggtgaaggggattgtcgcggcagcgccctatattaacttcaccggcctggtggagagcggcagcaatatgcgcgccatccaggtgaaaggcgtcgacccgcagcaggagagccagctcagcgcgctgcctacctttgtgcagaataacgcgtgggccggattcaaggctggcgaacagcaagtgatcctgggcaaaggggtcgccgatgccctgcacgtgaagcagggggactgggtgtcgatcatgatccctaatgccgacgccgaccatcagctgctgcagccaaaacgcgtcaggctgcatgtaaccggaattttacagctgagtggccagctcgatcatagttttgccatgatcccgatgcaggatgcgcagcagtatctggagatgggcagcagcgtgaccggcatcgccatcaaggtcaccgacgttttccatgctaacaagctggtacgcgacgccggcgaggtgaccaacagctacgtctacatcaagagctggatcggcacctatggctatatgtatcgcgacatccagatgatccgcgccattatgtacctggcgatggtgctggtgatcggcgtggcctgctttaacatcgtctcgacgctggtgatggcggtcaaagacaaaagcggcgatattgcggtgctgcgcacgcttggcgcaaaagacggcttaattcgcgcgattttcgtgtggtatggtttattagccggatcggtaggcagcctgtttggggtggtgatcggcgtgatctgcgcgttgaacctgacgtcgatcatcaacggcatcgaatacctgattgggcataaattcctctccggcgacatctattttattgacttcctgccgtcagaattgcactggctggacgtcttttatgtgctggtgacagcactgttgctgagtttgctggccagctggtatcccgcccgccgcgccagccgcatcgacccggcgagggtgctgagtggccagtaatttatcgtcatcgtcggcctggctgacgacacaagaggaattgctgaaatgtattatggatttgacattggcggcagcaagatagcgctgggcgtatttaatcaggagcggcgactgcagtgggaaaaacgcgtcgctacgccgaaaagtagttatgaggattttctccaggcggtagaggcgctggtccgcgaggccgatgagcgcttcgaccagcagggttcggtcgggatcggtattccgggaatgccggaaacggcggacggcacgctgtatgccgctaacgtgccagccgccagcggccggccgctgcgcgctgacctcagcgcgcggttggggcgcgatgtgcgtctcgataatgacgccaactgtttcgcgctgtcggaagcgtgggacgatgagtttacgcaatacccgctggtgatgggattgatcctcggcaccggcgtgggcggcggcctggtgttgaacggtaaatcgattaccggacatagctatatcaccggcgagttcggtcatattcgcctgccggtggatgccctggaggtggttgggcgcgattttccgctgctgcgctgcggctgcggccagctgggctgtattgaaaattatctctccggtcgcggtttcgcctggctgtacgaacatttttatcagcaaccgctctcctcgccggagattgtggcgcagtggcagcagcacgatccgcgcgcgcaggcgcacgttgagcgctatctcgatctgctggcggtgtgtctggggaatatactgaccattgtcgacccggatttgctggtgctcggcggtggattatctaactttacggccattagcgaagggctggcgcaacgattgccgcgccatcttctgccggtcgccagggttccgcgcattgagcgcgcgcgccacggcgatgccgggggaatgcgcggtgcggccttccttcacctgacccattaatcacagaggtagctatgcagtcgcgccgtttacatcgattgagccgttttcgtcgcaataaacgtcggttgcgtgaccgtctgcgtcagcggattttctttagggaggacaggatgaagcctgaagcgatggcaaaaccgagagtggtggtgttaaccggcgcgggcatctcggcagagtcggggatcaaaaccttccgcgcggccgatggcctgtgggaagagcatcgggtggaagatgtggcgacgccggaaggcttcgcccgcgatccggcgctggtgcaggcgttctacaacgcccgtcgtcgtcagctgcagagtccggaaatcaagccgaacgcggcgcatctggcgctggcgcgtctggaggatctgctgggcgaccattttctgctggtcacccagaatattgataatctgcacgagcgcgccggcaaccgccgggtgatccatatgcacggcgagctgctaaaggtgcgctgttcgtggagcggccaggtgctggagtggaccggcgacgtcaccgccgaggacaagtgccactgctgccagttcccggcggcgctgcgtccgcacgtggtctggtttggcgaaatgccgctggggatggatgagatctacagcgcgctggccgacgcagatatttttatcgccatcggcacctccggccatgtctatccggcggctggctttgtgcacgaggcgcgactgcacggcgcccataccgttgaactgaacctggagcccagccaggtgggcagcgagtttgccgagaagcactacgggctggcaagcgaagtggtgcctgcctttatcgataagctgctgcaggaaaacgcgctgtaaactgaagccgcctgccggtagctagggcgcagcccacggccgccggcagcgctgctgacaaggatgtcacgtcatgacaggagtcagaccatgcataatccgctggttatcgaagcgatcatgttgatcgcggccattatcgttggcgtctggagccagcgcgctttaccgctacacgccgatagccgaccgatcctcttcctgctatgtctgttcctcggcactggcagcgcgttgtgcctgctgctggatatcttagctctgctgttgaccggtcaggtcgcgacgggcggtgtgcgaatatacggcccgttgctgctgctggtggtgctgtggaaacctctcaactgggttgtcggcatcattgaagattttgtgcagcggcgagccgaaaaagggaagggcaaaggccagcacgacggcggtcaacgctgatccgccgcctgcgccgcggcttatttatagcgccttttgcatattaatgaccgaacgggcgttcgaggcgctggtagccagcacatcgataaccccggtgcgtaatgcccccaggatcgccgtcgctttcgtactttcggaggcgatagcgatgacgcagggaatggcccgcagctgttcgagacttaagccaatgacccggtcattcatcaccgtatcgacgggtttgccctgaatattgaaaaagctgtaccccgccagatcgcccaccaccccctgttcctgacgcgcggtggcaatttcctgcggcgtaaaccagccgagctgcaccataaagctgttttcattcatatcgccgaggccgatgatcgccacgtcagctttgctggcctgttcgagcgtggccttaatcaggcggttttgcataaaggccgcgcgcagctccggggtttccacatatgccggggcataaagcgtttcactgaagccgttaaatttgcgcgccagattccggctgatgtggtcggcgtcaatcagctgattgtcacgcttggttccgccgatgccgcagataaagcggcagtggcgctcaggaaacacgccaacgtgattcgccaccgcggccacattgcgcccctgaccaacggtgacggtcatatcgttttttaacaccccggcaaggtagttactgaccagggccgccacctgctggcgctgttcatcttcatcatggtgatccagggcaattagcgcgcgcttaatgccaaagtgcgaaataaactgctgctcaatctgggagctgaagaccggatggtatttgacgctgatctcaacaatcccttcctggcgcgcttttttcagcaggcgcccgactttgatacgcgaaatgccgaatcgtttggcgatctcttcctgcgtttgttcctgatcgtaataagccaccgcaatttcagtgagcagggcgtaatctgagtcttgttcaatcatggcctggaatttccatctctggtgtcccttttatattactgcgcctgcaaaataaattcctgtgtaacgcgttgaacaatgtcgcaatagccttgcgcgtcccaggccgcgcggccgataaacaagccattgatctcctgctggcgcagcaattccaccgcgttttgcagcgttacgctgccgccatagagcagcgggatacgggttcccgtctcgtgaccaaaccgctcgcaaagcgcctgacgtagcgcctgatgaatgacgcccgcctcctgcggtgaggcgggcgtaccatgttcgccaatggcccacaccggttcatacgcaatcagggtccgcagcgcctgctggtggctcaggccatacagggcgatcttcatctgccgcaccacgctttcacgcgacacctgccagcgtttctcctcggcgctatcgccaatacagatcagcgggcgcaggccatgacctaaggcgctatgcacttttcgattaatcgcggcatcgctttcattaaaggcggcacgtcgttctgaatgtcccagctcaacaagcgtggcgccggtttctgccaacatggccgccgagatttccccggtccaggcgccctgatccgcttcatgcatattctgcgcgccggtcagaagcggtaactgatgcgtttgcagaaaatggctgacgggttggatcgcggtgaaggggggaatgacgaagggctgaatagcggggtgacagccctccggcatccgcgctgccagcgtttcgcaccaggccatggcctgggacagcggcttgttcattttccagctggttcctaaccatatcggggtcatcattgcttctcctcttaataaaatcaaatacttgccaggaacggggccataccctgtattgaggttgaactttttatcactgcatgaacatatgttagatcacatttttcgatgaaaaaaatctatgaatttttttatgtgatcttcatcactcatggcggctcattcatcaggtaatgttttgagcatatgatttgatagtgaacatatgaacagtcaactgaaaaaatgagaggcgcatgatgtcagcagagaaaaaacccgttgtggcgattaccattggcgatccggcagggatcggcccggagatcaccgtggccaccatgatggacaaaagcgtgtatgacgagtgcaaaccgttcctgatcggctcggtaccgattatcagccgggcgatgaaaatcatgggctgcgattttgctatccataaaattgcccatccgcaggaggcccgttttagctgggggacgttggatgttctggaaactggcgactacgattgcgacagtatcgaatggggcaaggtgcagaaactggcggggcaaatgtcgctggactatgtgatgaagtcgatcgagctgggcaaagcggggctgatcgacgtggtctctactgcaccaattcataaggaagccatcaagctggcaggatgtaagctcccgggccataccgaaatctatcaggtggaaacccaatctgattacggtctgaccatgttccacgtccacaacctgcgcgtcttcttcgtgagccgtcatatggcgctaaaagcagcctgtgactatgccaacaaagcgcgagtgctggcctgcgttcagcagatccaccatgaatttaccgccctgaacatcaaaaatccgcgcattgccgtggccgccctgaacccgcatggttccgacaatggtctgtttggtcacgaagaggctgacaatctgatcccggcggtgaaagcggcccaggagatggggatcaacgctatcgggccggttccggccgattccgtgttccatctcggcaaacaggggcgctacgacgccattctctcgctgtatcacgatcaggggcatattgcctgcaaaaccctcgactttgaacgttcgatcaccattaccttcggcctgccgtttatgcgcagctccgtcgaccatgggacggcgtttgatatcgccggtaccggtaaggcgggtaccgtcagtatgctggagtcgacgctggtggcggcccgttactggaaaatgaagcatcaataatcgctgaggttcatgcgaatcacgaggacagagaaatggaaaaacatctgttgattagcaagggctgtaagggctggggcgggccgctgactatcacgccaggtcaggggaaaaagattgcgtacatcaccggggggatccgtcccccggtcgtcgaccgcctgagcgaactgaccggctggccttccattgatgtattcaagaatggcgaaccgccggcggaagagattggtttaatggtcatcgactgcggcggcacgttgcgctgcggactctatccgaagcggggaattcccaccattaacctgcatcccaccggtaaaagcggcccgctggcggaatttatacacgaagggatctacgtctccggcgtgacgccagcctgcattgagatggtctggccgcaaggggaaggcggaaagcttgggatcgtggctgacgatctgaccggggcaactaccgtcggggtgctgctggcacgcagtggtttaaaaaccgccgcgtttttcgataccgaatccttcgcccgcaatgaggtagagtatccggcgatggtggtcagcagcgacagccgcccattgccgaaagcggaggcccagcacaaagtgagcgctgcggtgaaacagctgcaggctcgcggcgcgcattacttcaccaagcggattgataccacgctgcgcggcggcatcggatttgaaatcgacgccatgctggaacaactgccgcaggagacggtggcggttgtggtgccggcgatgccgcagtcacggcgtattctcgtcggcggttactcggtgattgattcggtagccctgtcgcggaccgatgtggctcgcgatgtacgtaccccggtcaccgagtcgtgggtgccgggactgttggcggcgcagacccatcatcaggtcgggcatatcgcgctgacatcggtgatgaaaggcgaagggcaaatccagcaggatttacaggaacaacaacagcgcggcgtgcgggtgatagtggtcgatgcgataaccgtcgacgatgtcgatgccatcgccggggcggtagtggccctgaactggaacgtgctggccgtcgatccggggccctttaccgaacggctggcggttcgtcgcggcctgatgcgcgaagcgcggagcagcgcgcccgcgagcctgacagcggacggccagcgcggctcgattttgatcgttgccggcagcgcaacgccagtaaccaaaaaacagctccagtatttgatcgctaatgatgcccgggtctgccatatcccggtggatgccgagctgttggttgaccggaaaaacgccgctgagattgaagtcaatcgcgtggtgcagcatgcccgacagtgtgttccggcgcagcacaacgcgctctttgtttttgagtccgccttgaccgggcggttgctaaaccttcaggaagaggagcagcgatttggtctggcccacggtgaggctgcgcaaaatattaaccacggattgggcagtattgtgcgcgaggtgcttaactgtgcgtcgggtgaaattaaaggattgtatatgaccggtggtgacaccatggtcaatgtactaaaagagctgggcgccaccggaatagaaatgattgactatgtcatcccgcaaaccgatatggtgcggatcattggcggcgattatgccggcttaatttgcgtcgggaaaggagggctaaccggaccggaagatattattagcatcattgttgaccgaatttatcaggaagcacagcaataacccagtaatctaataactaataaacgacgtaatggtcgtcagggtagtattgcgtcgttatctctgttaaatcttaatttaagagttaccctatgaatattaatatacttgaaaaaatgaataaggtgcccggtgggttaattattattccactgctggtggctatattaattaatactttcgcgccccaggtgctcagcattggcgggccgaccaccgccttatttaaagtcggttccagcgccatgatgggcatatttttgctcatttgcggaacctcgatcaatatccgtcaggccgggttgccgctctataaaggcgccgtgctgctgtttctcaaatgtctggccggggcactggcggtatgggttgcgggaacgttgtttggcccgagcggttttctcggaatatcgaccctggcgctgattgcctgcctgaccagctcgaacagctccctctatatcgcattgtgcagcaactatggcgatgccagtgatgccggggcgatctccgtattctgcatcaaggatggtccgtttgttaccatgatggtgctgggcgtcagcggcctggccaatattcccttcgccgcgctgctgtcgatgctgatcccactgctgattggcatgctgtggggcaatctggacgaacgctttaaacagttatgcgctgcggcgcagccgctggtgatcattattatgtcgttcgccatcggcgccaactccagtatcaatacggtgttcaccgccgggctgtccgggatcctgttggggattatctccgcgctaaccgggattgtgttctactttatctacaacctgtttttgaagaagaaaagcgcgctgggcgccgcgctgggaaccaccgccgccagctcggcgctgacgccggcgatggttgcccaggcggatccttcgctggcgatgtacgtggatgccgccaccgcgcagctggcgacggcgagcattatcaccatgatcaccgcgccgatactggtcgcctggtttgataaacggctgaaaaagcgtgcgccagccgctgaaccgctgaaagaggtgaaaagtgaagagagcgtgacattatcttcccctgccgccaaaggacacaaatagtatgagcgtgccgttgtattcattacggattaccgccgtcggggaatatgttgagtactctctgcaggagctgcggcttattttattctccgatgccgttcccgacgatattgcgagttattgcgctgtacaccaggccagcgaactgaccgccgagttatcgcctggtcagcaaatgaaattaaatgataaaaattatcgggtgaccgcggtaggccgtgtggcaacggcaaatttacgacagcttggccatatcacgctaaattttgatggcgcagatatcgctgaattacccgggacggtacacctttacggcgaaccaccacaaattattcagcctggcgaccaaatttcgttttacccgaattgtcattaagacgtactgttaaattaaggaaataaccatgaaaacaatcgctattggtgcggatgatgccgcctatgcttttcgcgattccatcgtcgcttatttgaatgggttgggaattaacgtcgcggattacagcagcgataaacgccaggggagtaccgtttatccggatgttgcccatgcggtggcgatgtcgattaaacagggcgaacacgagcgtgggatcctgatctgcggtaccggcattgggatgagtattgtggccaataaagtccccggggtccgcgccgcacagtgtcacgataccttctccgccgagcgagcgcgtaaaagtaacaacgcgcagattattacccttggcgcgcgggtgattggcgctgagctgggcaaaaaaattattcaggcgtggcttgagtccgaatatgaaggcggcggatccgcgcccaaagtggaacgtattgattattacgaacaccagcatgccagagattaatctccgcagtcgtaagataaggaacagatgatgagccagttagacgaactaaaaaaatacaccacggttgttgctgataccggcgatattgaatcgattaaaaagtttgcaccccaggatgcgaccaccaacccctcgctggtgctgaaggccgcgcagctgccgcagtatcagccgctgattgccgatgcgattggcaaggcacgccgccagggaggcagcgcagaaacgcaattgattaacgcctgcgatcaggtggcagtggatatcggcagcgaggtgctgcgccatgtgcccgggcgtatctccaccgaagtggatgcccgctttgcctgggatcgcgggatgtgcgtcgcgaaggcgcgcaagctcatccagttatatgagaaaaatggcattggtcccgagcggattttaattaagctcgccgccacctgggagggcattcgcgctgccgaagagctggagcagagcggtataaactgcaacctgacgctgctgttctctttcgctcaggcccgggcgtgcgccgaagcgggcgtctttctcatctcgccctttgtgggccgcatctacgactggtatcagaagcaccagccgcagtcagcctatcaggtggacagcgatccgggcgtggtctctgtgcgccagatttatcagtattacaaatcccatggctatgacacggtggtaatgggtgccagcttccgtcgaattgagcagatccaggcgctggcgggctgcgatcgcctgaccatctctccggcactgctggacgagctggcggccagcgaaggagtgctgacccgccagttgactcccggctgcgtgacggaaacccgtcccagcccgatgacgcaggcggagttcctctggcagcatcatcaggatcccatggcagtggaaaaactagcggaagggatccgactgtttgctgtcgatcaggtgaaactggaacaacagattcagcagatgttgtaatccgcggggataaagactgatgaaaacgacaaataccactcgccgccaatgcgccaacgcgctgcgcgccctgagcatggacgctgtacagaaagccaaatccggccacccgggggccccgatgggtatggctgacattgccgaagtgctgtggcgtgatttcctgaaccataacccgaacaatccggcctgggctg

SEQ ID NO: 78 - DNA, 63360 bp, Unknown
  source: /note="Description of Unknown: KP2-Mcoc1 Bacteria Sequence"
atggcggtcagcccgcaggacgtgatggtggttatccagtttaaccaactggaggactggagttttagcgcagggaagatggcggatgaatgagacaggcggcgccgcaagaggcgccgcgtttcagatgatataatttactaccacgcgagatgatgcaccagcgagagatcccaggccgttgccaatagcgaaagaaacataatcacattgaccactgtttcaagacgtttttccatcgttgcttctcctgagcctgtttcccctgttatagcgggaaaagcttaacaacctcttaccgcttcaggactcaagcgtgatcctgtagcgtacgtaatcgtcagccggggtaaactcatcatacagatgacgggcgggattatcacggcgcgtatgccagtacagccgcgaccagcctttgtccgccccttcgctttgcagcgacttaatcatggttctggcaataccctgtccacggaaggcgggatcgacaaacagatcctccagatagcagatcggcgtggtaacccaggttccctcatgaagaacacagatagcgaagccgaccactgcatcatccaccaccgcgactctacccaatacagacgagtttacatccagcatccgctgccaggtgcattcggtcacctcttccggctgcgggctaccgtaaaaacgagtgtagccttgccaaagctgaagccattcggctttgtcgtggggccgtacttcccggatatcgatgaccatgagagtttccttacagatgaatgcattagcctgcgaatattggcaggagatatgagttgaggtcattattttcctgcgcagatatttgttcaagcgcttcggccataattctcctgctgttcggaacgatttggcactaaaaagccgtatgcagaggagccactgaccggctgttacaggttagtataatagtatgttgtaactaataaaaatcctgcacaacccggccgcagccgggtgtatagatggactatcagcaaagaggtttgacggcgtcgcgcataccgcaggtcaggatagcgtcaaggtcggcagtcaccagctccaccaatcccgggatctggctcagatcctgctgccagtgatccgccacgctgagcacggcggtgaccagctcgcgagtgctcatctggccatcgcgatggcgggcccacagcgtttgatagcgcgatatccagtcggcgtcatcctgtactggatagctctcaccatcccgctctccccggtaaaaggcgatcagcgccgccagggcaaaggtcagacgcggcggcagcgcgccatgcgctttctgccccgccagcagctgcggcagaatacgggtgcggtacttggtcatgccgttgagcgcaatcgagagcagctgatgtttaatatagggattacggaagcgccctgtcacggcgctggcgaatgacaccagctcatcgcgcggcagatccagcaccggaataatttcgtcataaatcgctttttcgacaaacgcgcaaatctccgcatcgttcatcgcctcacccacggtgtcgatcccggcctggaaggccactggcaccagcgcggtgtgcgccccgttaaggatcgccactttgcgttctttatacggcttgatatcgtccacaatgcgcacattcagcggcagtttatcgagacgcagctcggcctccagcgaggcaggtccctggataacgaacaggtagaaatgctcagcggtatcaaggaaagcatctttatagccggtctgcgcctcgagagccgccacttcatcacgcggatagccggtcacaatgcgatccaccagcgtcgaacagaaggtattcgctgaggtcagccaggtgataaatgcctgcggcagttcccattcgctagcatagcgcagcaccagcgcctgcagcgcctcgccgttataatcgatcagctcgcagggaataatcacccatcccttgtcggccgcaccggcgaaatgctggtaacgctcaaacaacagacgggtcagtttcgccggataactgaccggcggcgcgtcgtcaaaccgatccccggcatggtagctgatgcccgcctcggtggtgttggagaagacaaaccgcatctccgggttatgcgccaggcgtaaaaaagcgtcgaagtctgcgtaagcgctgatctcccggttgaccgagcggataagacgcgcgtcgctgaccgcttcgccctgctcgttcaggccgcgaataatagtcgtgtacaggccatcctgggtgttcagcgaaggcggaaaatctgtggcgataggccgcacgaccacgatgcccgcattcaggtcggtatgctcgttgagcaggtcgatctgccagtcaacgaatgcgcgcaggaagttaccttccccaaactggatgatacggtcagggtactgcgcgccggggaaatcacgacggtttaaagttttcacaatgggttccctctaatagtagtcatacaacctgagtaattggtccaataagttatcaggtttttctaccagtgaaaccctgttttgatcaaagcaatctgcaatagcggccgtcagggcagaaacttatagaatagtgaggtggcagtcatttcgccgtcgggcatcagcgcatagcgcggaatttcccccactttttcccagccgcagcgggcatagaactgttccgccccgctgccggtcgccgtgtccagcaccagcaccgtcttcctttcccgccgggcaatgcgctccagctcgctcatcaacgcctgggcgatccccttgcggcggacattttggtgaaccaataatttggcgacatccgctcgatggggctggttttccggttgactggtgataagttgcacggtgccaacgggacgttcctccgcgtcgaaggcggccagcacaatgcgctccccggccgccacgctgtcggcagtgcgttgccagaacgttatcgccgtttgcggcgcgaaaggcagcataaagctcaccgaggcgccgccgttgacgcagcttgccaggatctcgcttaatgccgggaggtgatggagaatatcgtcacgcgagagcgtgcgcagtgaaaaggatgtggtcataaaagctccctgttatcgaccacatcactatgtttttaaccaaaaattagcacaagtaggatcccgataggattttcttatggcgcgctttcggtcagcgtcggcatacaaatttggttacgaccgctctgtttggctttcaccatctcatcgtccgccgccaacagcagctggttaaacagctcggtgatgcgggcgtggcctacctcgcgcgtctccagtcccagactgatggtcaggtggatcgggttctggcccaggccgaaaggctgcgactccaccccgtgacggatcttttccgccagcaaatagccctgctgggcgctgtcgacgacggcggccaccgcaaactcttcgccgccgatacgggccaccatcccctgctcacccaccagctgtcgaacctgctgggcaaactgggtcagcacgcaatcgccgccttcatggcccagagcatcattcacccgtttgaagccatcgatatccagcaccatcaccgtcagcagcttatccgccggcagcgtctgacgcttcaacgcttcgctcagtccggaacgggaatagacgcgggtctgaaagtcaaaatcggcgcgcagggccagctgcttcaccagcgtgttaatcgcttcgacactggatgcgacaatcaccgggctaatcagcatggcggcaattccgaggcgggtggagaacagctgccacggctgcattcgcgcatctggcgaaaagtgaattaacgaattagcgaccagcagtatttcgccgatgccagtgagaaaagtcagcagacaggtcagcggcagcggatagcgtacagcgcaccagatcaaagccggtaacgggaaggtaatgctgcccgcgccgcctaccgccacgccaagcgcaattgacaggaccagcgccagcaccggcagcagctggcgaaagcgaaaaccgcttaatgccgaaggcagcgtcagggtcagaataaagggcaggattaataccgccgttgagaactgttcgctaaaccagtccgccagctggggaacgaaggtggcgcgttcaacatccaccgaccccagcgcgccgaccgctgcgcacagtaaggcggctaacaggcagaaacagaataaattaagcgcgtttatcgggcccggcatggagtcggcgcgacgtttatcccacagcaccagctgcgctagcgtcacaataaagacaatattggaaaagttaatcagcaatgaggcaaagcccataccccagcgcgaggttaatccatcatagaccagcattgccgcaaaacagacggcataaaaatagctgcggttaagccatacatagcgtgcaaaaatcccggccatcactgcattgagcggccagaagaaagagagctcctgcaccagacgcagcatagcgccaagaaaatgcagcagtagcgttaacgtaaataagaccaatgcatcgcgcacgggttgttcttcacgaaacagcgtaaatgaccgaatcgacagtgaagacattcagtaattatccgtctaattgtttcaggaaattattatgttaatagttagttagcggattatcataacatgagaatatttatcaggcatactccggcgccgatcaaatgcaaattagcgcacagacggcgcattcatttgtagcaccagccagcggtggatgacctgcacgatatagtcctgctccggctcgctcagcgcgcggccgtggggaatggcatgccatttttccaggcagccgcgacagcaggtagcggtcgcgtgctgggcgataaacaccgggtgaccgcgcatcggcgtctgcttgccatcattgatcggcgcagcgggcgccagccgctggcgaataaagtctgcggcatgccgatcaatgacctccggtcccttatcgagacaatattgccgctctttcccccccagacggaagcgtgagcgaaacgtcgagcgcgccaggcgcgcaaacaagcgatcctgatcgaccatcagaacaccgacctccccatccgctgagtcagtttttccagcatcgccacgccggccagcgagttcccggcgtcgtcaagctccgggctccacacggcgatcgccatctcctgcgggacaatcgccacgatcccgccgccgacgcccgatttcgccggcaggccaacgcgccaggcgaattcaccggcgttctggtacatgccgctggtcatcatcagggcattcacctggcgggactggatgggcgcaataaccggcgcgtcgagatgcggggcaatgccgcggtcggcgagaaacagaaaggttcgcgccagctcaacgcagctcatctccagcgaacagtagtggaaatagttctgcagcacggtggcgacgtcgttatggaagttaccaaaggatttcatcagccaggcgatggcggcgttgcgcgccgaatgctcaaactctgagcgagccaccaccggatcgtaggcgatatcggccacgccgctcagacggcggacaatctccagcatccgctgacgcggggcgctgagccggctctgcagcatgtcgcagaccaccagtgccccggcgttgataaacgggttgcgcggtttgccctgctcgatctccagctgcagaagcgagttaaagggctggccggaaggatctttccccacccgctgccagatctcctcctcctgatagtggttcatggccaccaccaggctcaataccttggagattgactggatggaaaaacgttcatgggcatcgccagcggcaaagtgctgaccgtccaccgtactgatcgcgataccaagcttgtcgccgctgacgctggccagcgccggaatataatccgccacttttccgcggccaatcagcggcctgatttctgccagaatggcttccagcattgcattattgattaccgtcgccacacgcggctccttgcccaccatcaaaattcggtgggcgagtatagcagacgtggacgacggtcgtcaggggctaacgttgattagcgacggtctttccagacggtctgcgcattacagaactcgtgcaggccaaaatgcgacagctcgcggccaaaaccgctcttcttcacgccgccgaaggccacgcgggcgtcgctggcgcagtagccattgaggaagacgccgccgcactccagctcgcgggcaaagcgctgggcctgcgcctcgtcggtggtatagaccgtggcggacaggccaaactcgctgtcgttggcgagggccagtgcatggtcagcgtcgcgagcggtggtcagggttgctaccggaccaaacagctcctgacgaaagccggtcatcccggcggtgacgttgcccagcaccgttggcgcatagtagttgcccgccccttcgattttttccgcgcccagcagcagagtcgctccttcatcaagggtcgccgttacctgctggtgcagttcatcgcgtaaatcgaaccgcgccatcggtccgacgtagttttgctcgtcgcgcgggtcgcccatcttcagcgctgccacggcgtcgacaaatttgcgggtgaaggcctcggcaatgccggcttcgagaataaagcgtttcgacgccgcacacacctggccgctgttctgatagcggccggtgacggcggctttcaccgcgtcatcgagatcggcatcgttgagcacgataaagggatcggatcctcccagctcaagcacgcatttcttcagcgccgcgcccgcctgggcgccaatcgccttcccggcgcggacgctgccggtgacggtcaccgccgcgatgcggtcgtcattgataatctgcgaaacgccgtcattggtggcgttcacccaaccaaatacaccatccggcaggccggcggcggcaaaaatttcgcccagcagacgggcgctgcccatcacgttcggggcatgcttcagcagatagctgttgccggccagcaggatcggcaccgcgccgcgcatcacctgccagaccgggaagttccacggcatgaccgccagtatggcgcccagtggacgatactcaattaccgcctggttattttccaccagggtagcttccgtcgccagcatcgccgggccgtgttcagcgtaccagtcgcagaggttggccgatttcgccacctcgccgcgcgcctgagcgatcggcttgcccatctcaagggtgatcatctgggccacctcttcaccgcgggcgcgcagcgcggccccgatgcggcgcagggcgtcggcgcggtcggcaagcggcgtctgacgccactggcgatagcccgccgcggcgagcgcgatggccgcgtcgacctcgcgttcgctggcccacggcagcgaggagaccacctcaccggtagtcggattgacggagacggcgtgcgttgcagataaattcatcattattctctctcgttgcttgcgaagtgtccgtattctggcttacctttccattcattgaaaatgaataatattaagcaacacattcacaaaagaagaatatcatggacctgactcagctagagatgtttaacgctgtcgccagcaccggcagcattacccaggcggcgcagaaagtgcatcgcgtgccgtccaacctcaccacccgcatccgccagctggaggccgacctcggcgttgagctgtttatccgcgagaaccagcgcctgcgcctgtcgcctgcgggacacagctttttgcgctatagccagcagatcctcgccctggtggacgaggcgcgaatggtggtggcgggcgacgaaccccaggggctgttttcacttggttcgctggagagcaccgcggcggtacggatccccagcactctggcccactttaatcagcgctacccgaaaattcatctggcgctctcaaccggcccttccgggacgatgatcgacggcgtactggaaggcgccctgagcgccgcgtttgtcgacggcccgctggtgcatccgggcctggaggggctgccggtgttccctgaagagatgatgatcgtcgccccctacggccacgcacccatcacccgcgccagcgaagtgaacggggccaacgtctacgcctttcgcgccaactgttcctatcgccggcattttgagagctggtttcatgccgacagagcgaccccgggcaggatccacgagatggagtcttaccacgggatgctggcctgcgtcatcgccggcgccggcctggcgttgatcccgcgcagcatgctggagagtatgcccggccatcagcaggtttccgcctggccgctggccgaagagtggcgctggctcaccacctggctggtgtggcgccggggcgccaaaacccgccagctggaggcgtttatagcgctgctgaacgaagatcggcaaacagtggtttctccataaacacgctgagcggatcgggttgatacggcgcaaacgcgcagcgggtctggtagccgttgcgcgtgtagagggcgatggccgcatgctgatggataccggtctccaggcgcagggtatggcagtcgcgctgacgcgctttcgcttccagcgccgccagcagcttttctcccaactgctggccgcggtgctggggatcgatatagactcgcttcatctcgccaaagccttcctcactgaggacaatagccccgcagccaacggcctcgccctgcgggctgcggatcgccagggcgatgaccgtctgcgacggcagctggctaaggtccagcaggtggttgctctccgccgggtagagggtctcctgccaggcgtcgagggcggcaatcagggcgataaattcggcgtcagtaggggcgatgtcggtgatggtgtacataggtgagctccttttttaccccactgtagcgcggccggcggcttttcccgacatagcattaacttatattgccgcccgcctattgcgctaacccactgaaacacagtaattttatcccctgccgttcgtacttgagatctgaatatgcacaccaaagcccgtaaagtgatgattattggcgccggcaatgtcggcgcgtcggcggcctacgccctgctcaaccagagcatttgcgaggagctgatcctcgtcgaccttaaccaacagagcgctgaggcccacgctcaggacctgagcgacgccgcggcctacctgccggggatgatgaccatctccacccgcgaggccagcgactgcgccgatgtcgatatcgcggtgatcaccgtctccggcggcgcgctgcgccccggccagagccggctggatgaactgacctccaccgcgaagattgtgaagagcattgtgccgacgatgatggccaacggatttaacggcatctttctggtggccaccaacccctgcgacatcatcacctggcaggtatggcagctttccggcctgccgcgcagccaggtgctgggcaccggcgtctggctggataccacccgtctgcgtcgcctgctggcgcaggaactggagattggcgcccagagcatcgacgcctttatcctcggcgagcatggcgatacccagtttccggtgtggtcgcactcctcggtatatggcacgccaatcgccgacctctaccagcagcgcaccggcctgccgctcgatcgcgaggcgatggctgacaaagtgcgcaagctgggatttgagatctacgcgggtaaaggctgcaccgaatatggcgtggcagggaccatcgccgagatatgccgcaatatcttcaccggcagccaccgcgcgctggcggtctcctgcattcttgacggcgagtacggggtcagcggcgcggcggctggggtgccggcggtgctggcccagggtggcgtgaagcagatcattgaactgcagctggccggcgaagagcaggcgaagttcagccagtcgatcgcggtgatcaaggccaatatcgcccgtctgccctgacggcagcctgcgagtcagtcggcaatgatcagctgcggggaaagggtctccagcgcctcgcgggttatatccggcaggtgggcgtcggtcacgatatcggtcaacgtcgtggcccccggcgcaaccgatacgccgatgcttcatcagccaggcagagaaagttccccgccgcggcttccgccgcttgggcgactgattactccgcaggaagtggtctctctggtgagctggttgctgagcgagggcgcatcggcgatgaccggacaggagctggtgatgtgtggcggcgcatcgctgggctgatgctatgtcgcacccggggagcggaagtagattaccgctccccggggcgacgcgggggcgatgattaacgcaggtaaaccgttccgcgcatataggtggtggcctggccgctaatcagcacacggtcgccctgccactggcagcgcaggtcgccgccgcgagcggagacctggcgcgccatcatggtggttttccccagcttttcgccccaccaggggatcagcatgctatgggcggagccggtgaccggatcttccggcaccccttctcccgggcagaagaagcggctgacaaagtcatactcttcatccggcgcgctgacgcagatcattttgccaagcgttcgcagccgcgccatatccggtcgcaccgcttcaacctgctggcgatccgccagcaccaccagataatcgcgcccttcccgaacttcaacggcggcctcgagtcccaacccggtcagcagatccgccggcgggttttccaccggggaggtcgaccacgccggaaaatcgagcgtcagccagtcgccattacgggtgacccgcagctcaccaacaaaacgggtgctaaagagaatcgtcgccgaaggatggtcgagatattcgaaaataacgtgcgcagcggcgagggtcgcgtggccgcagagattgatctcagcgagtgtggtaaaccagcgcagctcatagccctcgtcggtacggacaaagaaagccgtttcggattgattatgctgctgggccattttcaggagcacatcgtcggctaaccactcgctgagcgggcagacggccgcggcattgccgccaaagtttttatcgctgaaagcatcgaccagataaaattgaatttcctgcataccctgtccttactttttttactttccttcaacatgacataaaagcgcccccttgacactatccatagcaaaattaatcgcttaaccgcggccagccccttgcgatgaaatgagacgcagatcacaaaatgattgtcttttcgccaacaatcgttttaagatcagcgtcacatctttccctgaatcaccagtccagagcttatgactacgaatacggtctcacgcaaggtagcgtggctacgtgtcgtgacgttggccatcgccgcgtttatttttaacaccacagagtttgccccggtcggtctgttgtcggatattgccgacagcttcggcatggaaaccgcccaggtgggcatgatgctgaccatctacgcatgggtggtggcgttaatgtcgctgccgtttatgctgctgaccagcaaagtggagcgccggcgcctgcttatcggcctgtttattctgtttatcgccagccacgtcctgtcgttttttgcctggaattttgacgtgctggtgatcagccgcattggtatcgcctttgcgcatgcagtgttctggtcgataacgtcggcactggccatccgcatggccccgccgggcaaacgggcgcaggcgctgagcctgatcgccaccggtaccgcgctggcgatggtgtttggtattccgatcgggcgcattatcggccagtactttggctggcggatgaccttcctggcgatcggcctcggcgcgttagccaccctggcctgcctcgtaaaactgctgccgaccctgccgagcgaacattctggctcgctgaaaagcctgccggtgctgttccgccgtccggcgctggtcagcgtgtacattctgaccgtggtggtggtgaccgctcattataccgcctacagctatatcgagccctttgtccagacggtagcgggcctgagcggcaactttgccaccgtactgctgctgatccttggcggggccggtattatcggcagcattctgttcggtaaactcggtaaccagcacgcgtcggggctgataagcctggcgattgccctgctgctcgcctgcctgctgctgctgctgccggcctcgcataacccgcagcacctgatgctgctcagcatcttctggggggtggcgatcatgattatcggtctcggcatgcaggtgaaagtgctggcctccgctccggatgccaccgacgtcgccatgtctctgttctcgggcatctttaatatcggcataggcgccggggcgctggtcggcagccaggtgagtctgcatctttccatggcctccgtcggctacgtcggcgccattccggcgctggtcgcgctggtctggtcgctgatgatattccgtcgctggccggtatcgctggaagaccatcagccgcaccactcctgaatccgtcgcacaaaaaagcccgccggtatcgcgccggcgggctttttttctctgcgcatcgcgggcggtcagggatgccaggtcgaaatgatctccagcacgccattaataataaactgcacgcccatgcagaccagcagaaagcccatcagtcgcgagatggcctcgatgccgcctttgccaaccagacgcataatcgcgccggaactgcgcagacaagcccacagaatcacccctaacagcaaaaagatgatcggcggcgccgccagcaccacccactcagggaagtccacgccgtgcttaacggtcgaggcggagctaataatcatcgcgatggtgcccggaccggcggtgcttggcatcgccagcggcacaaaggcgatattggcggtcggttcatcctgcagttcttccgatttgatcttcgcttccatcgaatcgtgggctttttgctggggaaacagcatgcggaaaccgataaaggccacaatcaatccgccggcgatacgcagcccaggtattgatatgccgaatgtattcatcaccacctgaccggcataccacgacaccatcaggatggcgaagacatacaccgatgccattaacgcctgtttattacgctcggcgttgttcatattaccggccaggccaaggaacagcgccacggttgtgagtggattcgccagcggtaaaagcaccgccaggccgagccctattgctttaaacaaatcgaacatagttaattaaagtcccgttaatattcattttttaagaatggtttcattccgtgagtatatcggcttcaacaaatttgacgccagcctgctgataaatcacttctgcaaaaaaataacaagcgttagaaaaatcataaagagtgacccacatcgtacttttccattttagcaaatcgtggcatcggccaattcataatgttgacttatgattgcctgggcaatagtatcacctgcaactaattacttgcctgggcaaccattatgaaaagtaccagcgacctgtttaatgaaatgatcccgctgggccgcttgatccagatggttaaccagaaaaaagatcgcctgctcaatgactacctctcacctatggatattaccgcgacccagtttcgcgtgctctgctccattcgttgcgaagtatgtattacccccgttgagctgaaaaccgtgctttccgtcgatccgggcgcgatgacgcgcatgctcgaccgcctggcgtgcaaaggctggattgaacggttacccaaccccgctgacaagcgcggcgtgctggtgcagttgacgccggacggcgcagccctttgcgagcagtgtcatcaggttgtgggtcagaagttacaccaggagttaacgaaaaatctgtcggcggacgaagtcgccatgcttgagcaactgctcaagaaggtcctgccgtaaaaataagaagaggtaagatgatgtccagacgtaataatgacgccatcactatccatagtattttgtcgtggatcgaggataacctggaatcgcccctgtcgctggaaaaagtgtctgagcgctccggttactctaagtggcacctgcaacgtatgtttaagaaagagaccggccattccctcggccagtacatccgcagccgcaagctgacggagattgcgcagaagctcaagcagagcaatgagccaatcctgtacctggcggaacgctatggtttcgagtcgcagcagaccctgacgcgaacgttcaagaactatttcgatgttccgccccacaagtatcgcataacgaatgtacctggcgaatcccgctatctacatccgctaaataactgatgttaatcgcctgcactataaaagacgtattgaggaaatcatgaaactattcgctgccgcagctatcgtactcttgtcgctggcctccagcctcagctatgcggagcaaaacaccacgccggtgcgtcaaaaccagcgtgatacaatgattatcccttcagaacataatgattcgccgtttgatttcaatcatatggcggctggtaatgataaatctgacgaacttggcgtgccgtactaccagcagcacgacctgtgatgccattacacgcataattgtgtatagccccgtctccggggcttttttttatccgcgcgccatgccaggccgcaccaaccgtaagccaaagacattaatgtagagcccggccataatcagcaccgccccggtgagctgcagtccgctcagcgtctccccgagcagcagcgcagcgctggccattcccaccaccggcaccagcagcgacagcggcgccacccgccaggtttcataccgccccagcagcgatccccagatgccatagccgacgatagtggcgataaacgccagataaagcagcgacagtatcgttagcagatcgatgtgttgcagactcgccagcatggtctgcggaccatcgatcaacaatgaggccagcataaacggcagcaccgggatcagcgcgctccagaccaccagcgacatgattggcggccggctcgcctgggacatgattttcttgttgaaaatattgccgcaggcccagctgagcgccgccgcgagggtcagcataaagcccaccagcggcacatgctccccgccaaggctgccctccaccagcaccagcacgccaaagatcgccagggcgatccccgccagctgcttgccctgcagacgttcgccaaagacgaaggcgccaaggatgatggtgaagaaggcttgcgcctgcagcacaagggaggccagcccggccggcatacccaggccgatagcgcagaacagaaaggcgaactgaccgaaacttatggtcaggccatagcccagcagcaggcgcagcggaatagctggccgggcgacaaacagcagcgccgggaaggcgaccagcataaagcgcagccccgccagcatcagcggcggcatattgtgcaaccccagcttaatcaccacaaagttaagcccccacaccaccactaccagcagcgccagtagtccatctttcctcgtcatacccctgcctctgtcgttattggaatttttgtgaacaaaatcaaagtagcgaaaaagcggccgccgggatagatcattatttttggcaggcccggaagtgcgcccgtcgaccgcgatgacctgtacaaggcgtaatggccgtgttatttgtgatcgaagacataaaattataacaacatgacaggcaaggaaatcatgatcaccactctccggcgctccaccatcgcgctgctggcatcgtcgttactgttgactatcggccgcggggccacactgccgtttatgaccatctatctcacccgacgctttcagctggaggtggatgtgattggctatgccctgtcgctggcgctggtggttggggtgttgttcagcatgggttttggcatcctcgctgacaggttcgataaaaagcgctatatggtgtggtcagtgctggtatttattctcggcttcagcgcaataccgctggtcaataacgccctcctggtggtgatcttctttgcgctgatcaactgcgcctactcggtcttttccaccgtcctgaaagcttggttcgccgatcggctgacggcagagaaaaaagcgcgcatcttctcgctgaactacaccatcctcaacatcggctggaccgttgggccgcccatcggcaccctgctggtaatgcacagtatcaatttgccgttctggctggcggccgcctgcgccgcctttccgctggtgtttattcagctgtttcttcagcgggatggcgccgccgcggcccagccgggcgcagcgccctggtcgccttcggtgttgctgcgcgaccgggcgctgctgtggtttacctgctccgggctgctggcctccttcgtcggcggcgccttcgcctcctgtctctcgcagtatgtgctggtggtcgccagcagcgatttcgccgagaaagtggtggccgtggtgctgccggtcaacgccgcggtggtggttgctctgcagtacgcggttggccggcggctgagcgcgagaaatatccgcccgctaatgaccttcggcaccgtctgctttgtgatcggccttgtgggctttatgttctctggcgccagcctgtgggcgtgggggatctcggcggcgatcttcaccctcggggaagtgatttatgcccccggggagtatatgctgattgaccatattgccccgccggggatgaaggccagctacttctccgcccagtcgctggggtggctgggggcggcattcaacccgatgctgacggggttgatcctcacccatctgccgcactggtcgctttttgtcattcttatcgtggcgattgtcgccgcctggctgatgattttccgcgggatcaatgcccgtccctggcaaccggattctccgctggccaacgcctgacgccagctggcatgcggctgtcaggttgctgtcgggccgttgtcgggtcgctgtcgtggtggctggcggcccggttcaccatactccatcacaggtttacatccgcagaacgttatggagcatacgaatatgaacagcaacaatcaggtcaaacaattacggctgcagcgcgcctggtcccaggagcagctggccgaaatggcgggtctcagcgtccgtacgatccagcgcattgagaatggcgaacgcccggggctggagaccctcagcgccctcgccgcggtctttgaggtgacggtggccgagatcggcggcgaagcccggcgggaagacgcgccgggccaggaagcctcactggatttgcgcatagaggaagccaaagcgcgggtgcatcaggagagccgctttttccgttcgctgtcggtggcgctggtggtttgcgtgctgctggcggtgcttaaccgcttcactaatccacagtactactggtccggctgggtcgccctgatctggggcgccctgctggtggtgagaggattacgcctgttcgtgttcggcgaatggattaaaaactggcgccaggcgcgcctgcagcggctgctgcgcaaataggccgcaaaccggcggcgcgaccgccgccggcctggtcagatggtcaccatggcgcgcacgccgtcgctctccatatcaccacccttgccttgctggacgatggcgccgcgcgacatcaccaggtagtggtccgccagcccggcggcaaagtcatagaactgctccaccagcaggatcgccatgtctccgcggctcgccagctggcggatcacctcgccaatctctttgatgaccgagggctggatcccctcggtgggttcatcaaggatcagcagctgtgggcggctggccagcgcgcggccaatcgccagctgctgctgctggccgccggataagtcaccgcctcgccgctgcttcatggtcctgagcaccgggaaaagctggtagatctcctccggcacctgctgcgcttcgcgggcgggaaagcgcgacagccccatcagcaggttttcttccaccgtcaggcgcggaaatatctcgcgcccctgggggacgtaggcgaccccggcctgcacccgctggtgcggtttgcgatgggtgatgttctgatcctgccagcgtacctcaccgctgcgcgccgggatcagccccatcaggcatttcagcagcgtggtcttaccgacgccattgcgccccagcaggcaggtgacttcgccctggcgggcggaaaaatccaccccgcgtaaaatatggctgccgccgtagtattgatgtagctgactcacctgtaacattggcgctccttaacgtcccagataaacttcaatgacctgctcattggcctgtacctcccgcagcgatccctccgccagcacctggccctgatgcaggaccgtcacccggtcggcgatggtctcgacaaatcccatgtcgtgctccaccaccatcagggagtgctgtccggccagcgtgcgaaacagctccgccgtatactccgtttccgcatcggtcatgccggccgccggctcatcaagcagcagcagatgcggctcctgcaccagcagcatgccgatctcaagaaactgtttctgaccatgggacagcagaccggcctggcggtagcgctcgccgtcaagacgcagcaggcgcagcacctcattcagccgatcgtcctgttcgctgctcatccgggcgcgcaggctggcccacaccgatttatcccccttcatcgccagggcgagattttccgccaccgtcagcgcttcgaagaccgtcggcttctgaaacttgcgcccgatgccctggcgggcgatggccaccgggtcaagagtggtcagatccaccgactggtcatagagcgctttgccgctctgcggccgggtcttgccggtgatcacgtccatcagggtggtcttgcccgccccgttggggccgatcacacagcgcagttcgccgacgcctatcgccagcgacagatccgtcagcgcccggaaaccgtcaaagctgacgttgatgttctccagctgcagcaccggatcggtttgttcgcgaaagcgatcgccgggcagctggcgggtaaacagtccttcatccggttgcattagcggtctcctcgacgcagcaggcccatcaccccgcggggtaaaaacagggtcacaatgatgaagatgaggccgagaaacagctgccagtactctggcatcgccacggtgaaaatgcttttcgcaccgttgaccaatccggcgccaagcaccgggccaatcagggtgccgcgcccgccgagcgccacccagatggcggcctcgatggagttggtcggcgacatttcgctggggttgatgatccccacctgcgggacatataacgcccccgccagaccgcagagcaccgccgacagcgtccacaccagcagcttgaagccgcgcgggtcgtacccgcagaacatcagccggttttcggcgtcacgcaccgcggtgaggatccggccaaacttactctgcgccagcgccgagcccagccacagggtcagcaacagcagcaaaaccgtggccataaacaggctggcgcgggtgccggcggcggtgacaggaaagcccagcagcgtggtaaaaccggtgaagccgttattcccgccaaacccggtctcgttgcgaaagaacagcagcataccggcataggtcagggcctgggtcatgatcgagaaatagacccctttgatcttcgagcgaaaggcaaaccagccgaaaaccagggccagcagaccgggaaccagcaccaccagcgccatcgcccaggcgaaatgctgcgtgccccaccagaaccagggcagctcgctccaggagagaaaagacataaacgccggcagaccgtcgcccgccgcctggcgcatcaggtacatccccatggcgtacccgccgagggcaaagaagatcccgtgccccagcgacagcatgcccgcatagccccagaccagatccagcgccaccgccacaatggcgtagcagaggattttgccgctcagcgtcagcagccagctcggcaccgccagcggatgggaggccggcagcagcgccaggaatggcatacacagcagccccagcaccagcaggatccccagccagcgcagaggccgcggcgcgcgctgcgccagcgttaaggtgattggttggctcattagtcaataaccctccctttcagcgcgaacagaccctgcgggcgtttctgaataaacagaataatcatcaccaggatcaggattttgcccagcaccgcgcccatttgcggttcgagaattttgttgaaaatgcccagcccaaaggccgccgccacgctgccggccagctggccgacgccgcccagcaccaccaccagaaacgagtcgatgatgtatccctgacccagttcaggcccgacgttgccaagctgcgacagcgccacgccgcccagcccggcaataccggagccgaggccaaaggccagcatatccacccgcccggtaggcacgccgcagcaggcggccatcgcccggttctgcgtcacggcgcggacgttcatccccagacgggtgcggttcaggatgagccaggtaaagcacagcaccagcaggacgaacgccagcaccgccagccggttccacggcaggatcaggttcggcaggacctgcacgccgccggagagccaggccgggtttgccacctccacgttctgcgcgccaaacaacatcctcaccagctggataagcatcaggctgatcccccaggtggcgagcagcgtttccagcggccgaccatacagatgacgaataatggtgcgctccagcgccatgccgatcccggcggtcaccagaaacgccaccggcagcgcgaccagcggataaaaggccagccattgcggcgcgagctgcgccagcgcctgctgtaccagccagcagctgtaggcgccgatcattaacatctcgccatgggccatgttaatcacccccagcaggccataggtgatcgccagccccagcgcggccagcagcagcaccgagcccagcgacagccccataaaggcctggcccagcagatcgccgagcagcagacgatgtttgatcttttgcaggctatcgctggccgcctcgcgcaccgccgcatccggctcatgctgggcatcggtaaaggggatcagcagcgcctgggtttccgggtccgcggaatggccgagcagcgtcacggcggccagccgcgcgctggcctcaggctgagcgagctgcaggcgcgccagcgccacctccagcagaccccgcacattatcatcggtttccgcctgcagccgctgttgcagcagcgcggccatggccggagtcgcttcccgctgtagcgttcgtgcggcggaagctctctccgtgacattgtcacttaaaataaggtggctggccagcgcgccggcagccagattgcgcagccggttggtcagacggaccggccgggtttcgccctgcggcgcggcgacagcgcccaatggctgtaatccgccctgtcgggtgcggaaagcatgttttccgtcgtccatcaccaggctctcggtggtcaacgcccgcagcagcggcagacgatccgcctgcggcgctgccgcccactgggtcaacagctgcgcctgctggctgcgactggcggcaacgaagtcgtccgcctccgcggcctgcgcccgccatggcagcaaggtcagcaatagcgccaacacactcatgagacccaatgcgttcatgtcgttctcctctggtcagcggccgacgggcgcgacgctcccgccccgtcggccgtggcgcttactggctgacggttttcaccggatggtcaggtttcttatcattaccggggatccacggactccacggctgcgcgcgaacgggctcatcggtctgccagaccacgttgaactggccgttgccttcaatttcaccgatcatcaccggcttatgcagatggtggttggtggcatccatggtcagggtaaatccggacggcgcgttgaaggtctgcccggccatcgcctcgcgtactttgtcaacatcggtggtgcccgctttggtcaccgcctgcgcccacatatgcaggcccacccaggtcgcttccatcggatcgttggtcaccaccgtatcggcattcggcagcttgtgcgctttggcatacgcgcgataatcggcgacaaaggctttgttggtcggattatcgagggactcaaagtagttccatgccgcgaggttgccgaccagcggtttggtatcgatgccgcgcagctcctcttcccccaccgagaacgccaccaccggtacatcggtcgctttcagaccctggttagccagctctttgtagaacggtacgttggaatcgccattgatggtggagaccactgccgttttgccaccggcggcgaattttttgatattggcgacgatggtctggtaatcgctgtagccgaacggggtgtagacctcctcgatatctttgtcctggatccctttggcatgcagaaaggcgcggaggatcttgttggtggtgcgcggatagacgtagtccgtccccagcagaaagaaacgtttagcgccgccgccgtcctcgctcagcaggtattccactgccgggatagcctgctggttaggcgccgcgccggtatagaagacgttgggggacatctcttccccttcgtactgcaccgggtagaacagcaggccgttcagttcctcaaccaccggcaggaccgatttacgcgagaccgacgtccagcagccaaacaccaccgccactttatcctgggccagcagctggcgcgccttctcggcaaacagcggccagttggaggccgggtcgaccaccaccggctccagtttcttgcccagcaccccgcctttggcgttgatgtcgtcgatggccatcagcgcgacgtctttcagcggcgtttcggaaatcgccatcgtcccggagagcgaatgcatgatcccgactttgatggtgtcggcggcataggcctggaaggagagacccatagccataacagaggcggagagtgcaaaagcttttaataacgttctacgttgcatgattcactcctgagtagcgcaaaaaataaagaattaacagctaaccagaggtgataaggcataaaaggtgccaggttgtgaaaacagcaggatgcggcgcaggtgggcgatagtggcgaagaggatggcagcgttgcctcatcacggtgcaacgctgcgctaagaaagcaattaccagacgtcggcggcgatggaggtcaccagacggaccttttgccattgctggtcttcgctgagggcattcccctcttcagtggaggcgaaaccgcactgcggactgaggcagatctgctcgagcggcacgtactgcgcggcctcggcgagacgcgcttttaccccctgcggattctccagctcgccgtttttggtggtgatcagcccgaggaccacctgctgatggccgggacgaataaagcgcagcggcgcgaaatccccggagcggtcgttgtcgtactccaggaagaaggcatcgacattaacgccgccaaacagcacctcggcaaccggctcgtaaccgccttccgagatccaggttgaacggaagttaccccggcagacgtgcaggcccaccgtcagatcggccggcttaccctccagcgcctggttcagcacccgggcataaatacgcgccagcgcatccggatcctcgccgcgctcgcgtacctgctggcgctgggcatcggagcacagataggcccacacggtatcgtccagctgcagatagcggcagccggcgtcataaaacgcgcggatggcgtcgcgccaggtggtggccagatcgtcgaagtagtcgctaagatccgggtagaccgtggcatcgatatctttccgcccgccgcggaagtgcagcacgctcgggctgggaatggtcatcttcggctgcgcgtcgccgctgatgcttttcagatagcggaaatcctccagcatcgggtggtcgccaaacgccagcttgccggtgacgcgaacgccgtgcgctttggtctgcacgccgttgaactggatcccctgctcggcatcgtaacgttcaacgccctgcaggccatcgaagaaatcgaaatgccaccatgcgcgacgaaactcaccgtcggtgaccacatgcaggccgcagtcgcattgctgctgaaccagatgacggatcgcgttattctcaatctcgcgtagctgagcggcgtcgataatcccctcagccagctgctgacgcgcctgtttaatgctgtccgggcgcaaaaaactgccgacgatgtctgcgcggaacggggcctgttgacgttgcatgctgtctccttagcggtgggcgcgttagttgcccaccgtgatagttcattatttgaattttagacttctggatggctatatgtccagatactggcatgcagagtggtgggtcgcaaacgagaatatttcatggtacatgaaaaattttcatttaccggaaacaaacgcatagccctcatcttcccagccggtgagtccgccgagcatcattttcaccggccgccccagctcggccagcttcagcgcggcaacgtcagcaccgttgcagtgcggcccggcgcagtagaccacaaagagggtctccgccggccaggccgccattcgctcggcggtgatctggctgtgcgggagatgctgcgcgcctggcaggtgacgtctggcgaaggcttcctcgctgccgaccacgtgcagcaggacaaagtcgacctcgccggcacgctgggcgctgtgcacatcggcgcagtcggtctcaagatgcagcttatggctgaaccagcggatagcctcagcggaggtggcgggggtaaattgggttactacactcatggcgtcttctccttgtctgtgataacactactttactgacgcccatcaccctgatctgccgacaaccatgacagaaaacgctaacatcctgacaaccccttctgtgacaccgtcacgtcatcaggtggtcgccctcgcctacgatggcctgtgcacctttgagtttggcgtagccgtggagatcttcggcctgccgcgcccggaaatgggcgacaactggtatcagttcgccgtcgccgccgtcgatgaagggccgctgtgcgctaccggcggcatccgcctgatgaccgacggcggtcctgaacttctcgcccaggcggatacgattgtggtccccggctggcgcggcgtcgacgccccggtccccgaggcgctgtgcgccgcgctggcttccgcccacgcccgcggatgtcggattatttctatctgttccggggtgttcgttctcgccgccgccgggctgctcaatggccgccaggcgacaacccactggcgctacactgcggcgctgcagtcccgttttccgcagatccaggtggtggaggacgtcctttacgtgggcgatgctttgctgatgacttccgccggcagcgcggcggggatcgacctttgtctgcatctggtgcgcgaagatttcggcagcgaagccgccaacgtcgtcgcccgccgcctggtcgtctctccccatcgcgacggcggtcaggcgcagcaggtcctgcgcccggtagcccgcagccgggagagcctgcgcctcggtcagctgtttgactatctgcaccagcatcttgccgccagccataccgtcgcttccctcgcccagcgcgccggcatggggacgcgcacctttttgcgccgctttgaggaggccaccggtaaaacgcccgcccgctggctgctggaggaacgactgctgcgcgcccgccagcacctgacggagagcacgatgggcatcgatcagatcgctgagcgctgcgggtttgccagcgccggcaccctgcgccaccattttcgccagcacttcgcgctcagcccgctgcagtaccgtaaacagtttacgccttctccgattgcaaaatcgtcgcagccacggacaatagacggccacagtaaaccggtcgccaggagggtcgatgatgaagaaagagtgtcgggtagtgatctataaagaggggctgctgggcagtctgttttttggcgaagccaaggccgaccctgacaaaatgagccagtttctcagcagctatacccgtgagggatgggaagtgaaaaccatgtcggtggagcgccgccgtaccgccctgttctggtcgcgggaagcgtatcttttcgtgctcgaacgccccctctgacagcctgcgcctggtttacacgtttaagccaggcgtttctaagcgtcacctttcagggctgacggatatagccctgctcctgcattttctgcatgccttcctcgctggcgcagaccatgccggtagtcaacatggcaaagccaaagcgctgataaaacgtaattttatcggccaccgcatagataaatattttgccaaagggcaggagttgctcccggatggccagcatcagctgttgcccgtagccctgtccctgacgagcggggacgatcgccacatccgccagatagctgctccaggtgcagtcgctgatggctcgcgccacggcaatcagctgaccgttctcatagccaaaccagcagaaggtgctctggcggaacgcctgctccagttgctgaacatcacgctcattcagcccggcctcggcgatgatcgttcgcactcgctgccagtccacccgcacgatcgcctctttaccctcaatcaccatcatgaccttgtctcccgtcgtctcccggaagcaagatctagcatgccgcggcaggatatgccagatggaaagccggactgaagcagtcggtacagggtggaaggggcaaaaaaaaaccgccatatgactggcggtaaatcaatgcttgcatggatagattgtgttttgcatttttcgcagacagataagctttacctctctacgtttgctgccgaagttagcatgctcaacttcaataaagcctcaacgaccagcagctaaagcttctccaccagcgctttcagctgcgccagggtctgctgccggtcctccgcggcggcgacaggccaggccgactggcgcacgatgagccgggtcggcagcagctcgcggatccgcagctgcggggccgccatcagggcaatcagccgctccaccgcccttttgcccaacagatcgaagtcctgcgccaccgtggtgagcggcggctggaagtaaaggctgtcggcggtgtcatcgtagccggtcaccgataccgcctggctgccgctgcgattgagctgggccagcgcgctgagcacgccgagcgccatctgatcgtttgccaccactatggcgctgatccgcggctgcaggtggaggagctcgaaagttttctgccaaccgctggcggcgctccagtcgccaaacaccgtagtagagcgggcaatattcagactgtgcaacgcctcgcgccagctggcgagacgcagacgggcggaaaccgaactttccggtcccgccagcagaccaaattcgcgatgccccagctcccacaggtggcgcacgcaggccccgcagccgtcgcggtggtcgaagcgcacgcagcagacatcggcctccggggagacatcgagaaacaggcaggccatatccggattgtcttgcaccagccgctcggcagtggcgctctccagcggcagactgacgatcaccccgcgaatatgctgagcgcgcagctcgtccagccgggcctgcagcgcgacaaaatcagcctgcgccggcatcgctatcgccacttccagctgatgcaggctggcatggctctttatcgcggcggcgatctgcgagggggcgtgcagcgtcagcgaggcggtaatcagcccgatggagggcgccgctttgccggcaagcagctgcgctgagcggttaggcacatagtgcagcgcctgcatcgcgcggatcacctgctcgcgggtgcgggctgacaccacctcaggacggttcagcacccgggagaccgtctgctgggacacgcccgcggcgcgggcgacatcctccagggttgcggtacgacgcggcatcttttctcctcagcaataacaatgtcgtgcgctaacattttatgtttaacgcgcgacaaaaaacagcgcttcgcccccgctttcgtgatcgtctgttaatttcgattcccccgagattgctggacaaaacaaattacccgataacgttaatcatcctgtttagcgaacgacaatttatgacttaccggggtttaatatgcaaattagcgataccggccgcagccacactcctgactttcacgccgtcctcgcccgtgaagactggcagaaccagaccattacccaccttaaccgcctgccagcgcatcccgttttcgccagctggcgcgatgagcttgccgcccgcgataacctaccttcatcccgccgccgtcaactggacggcgagtggcagttctcttacgcccgtagcccgtttgccgtcgatgcgcagtggttgacgcaggatctaccggactgccgcggcacgcctgtgccttccaactggcagatggagggctatgacgcgccgatctacaccaacgtccgctatcccatcgacaccaccccaccgcgggtgccggaggataacccgaccggctgctactccctgcactttacggttgaggacacatggcgcgagaacgggcaaacgcagattattttcgatggcgtcaactcggcgtttcatctgtggtgcaatggcgtgtgggtcggctattcgcaggacagtcgcctgccggcggcgttcgatctcagccccttcctgcgtccgggcgacaaccgcctgtgcgtgatggtcatgcgctggagcgccggcagctggctggaagaccaggatatgtggcggatgagcggcattttccgctcggtatggctgctgaataagccgcagcaacggctatgcgacgtgcagttgacgccagcccttgacgccctctatcgcgacggcactctgcaggtccaggcgaccatcgaagcgactgaggcggcgcttgccgggctcagcgtcggggttagcctgtggcgcggcgaggagcagatcgccgccgggcggcagccgttaggtaccccgacggtggatgagcgcggccactacgcggaacgggtcgatttctccctggcggtggcgacgccggcgcactggagcgcggaaaccccgaactgttatcgcgccgtggtcaccctgtggcgcggcgacgaactgctggaggccgaagcgtgggacatcggttttcgccgcatcgagattgccgatggcctgctgcgtctcaacggtaaaccgctgctgatccgcggcgttaaccgccatgagcatcatcatttgcgcgggcaggtggtcaccgaggcggatatggtgcaggacattctgttgatgaagcagaacaactttaacgccgtgcgctgctcgcactatcccaacgcgccgcgctggtatgaactctgcaaccgctacggtctgtacgtggtcgatgaagccaatattgaaacccacgggatggtgccgatgaatcggctgtccgacgatccggcgtggctaccagccttcagcgcccgcgtcacccggatggtacagagcaaccgcaaccatccgtgcattatcatctggtcgctgggcaacgagtccggcggcggcggcaaccacgaagcgctgtaccactggctgaaacgcaacgatccgagccgtccggtgcagtacgagggcggcggcgcggataccaccgccaccgatattatctgtccgatgtacgcccgcatcgaacgcgaccagccgatcccggcggtccccaaatgggggatcaaaaaatggatcagcctgcccggtgagcagcggccgctgatcctttgcgagtacgcccacgcgatgggcaacagcctcggcaacttcgccgattactggcaggcctttcgcgagtatccgcggctgcagggcgggtttatctgggactgggccgaccaggcgatccgcaaaacctttgccgacggcagcgtcggctgggcctatggcggcgactttggtgataagcctaacgatcgccagttctgtatgaacggtctggtgtttcccgatcgcacgccgcatccgtcgctggtggaggcgaagcacgcccagcagtattttcagttcacgctgctgtcgacctcgccgctgcgggtgcgcatcatcagcgaatacctgttccgcccaaccgataacgaagtgctgcgctggcaggtgcaggcggccggtgaacccctgtatcacggcgacctgaccctggcgctgccccctgagggcagcgacgagataacgctgctcgatagcctgatcctgcctgaaggcgcccgcgcggtgtggctgacgctggaggtgacccagccccaggcgaccgcctggtcagaagcggagcaccgcgtcgcctggcaacagtttcccctgcccgccccgctggcgctgccggcgcccaccgtgtctgccggcgctccggatcttatcgtcagcgatgaggtctggcagatccgcgccggttcgcaatgctggaccatcgatcgccggacgggtctgctgagccgctggtcggttggcggtcaggagcagctgttgacccccctgcgtgaccagtttattcgcgcgccgctcgacaacgacatcggggtcagcgaagtagagcgtatcgaccccaacgcctgggtggagcgctggaaaagcgccggcctgtacgatcttgaggcgcactgcgtccagtgcgatgcgcagcgcctggcaaatgaaaccctcgtcgactgccgctggcactacctgcgcggcgaagaggtagtgattgtcagccactggcgcatgcacttcactgctgacggaaccctgcggttggcggtggacggcgaacgggcggaaaccctgccgccgctgccgcgggtcgggctgcacttccaggtggcggatcagcaggcgccggtgagctggctgggtctggggccgcatgagaactaccccgaccggcggagcagcgcctgcttcgcccgctgggagcagccgctggcggcgatgaccaccccctatatcttcccgacggaaaacggcctgcgctgtgatacccaggcgctggactgggggcgctggcacatcagcggacatttccacttctccgttcagccatggagcacccgtcagctgatggagaccgaccactggcacaagatgcaggccgaagacggcgtgtggatcaccctcgacggcctgcatatgggggtgggaggcgatgactcctggacccccagcgtgctgccgcagtggctcctgagccaaacgcgctggcagtacgaggtctcattgcgttgcttttaatccgtgggggcgacagcccccaccccacaaacagaataacaagggatcatggtgatgaaattctcagaactggcgccacgagaacggcataatttcgtctatttcctgctgttctttttcttttactatttcattatgtcggcctacttcccgttttttccggtgtggctggcggacgttaaccatttaactaaaacggaaaccgggatcgttttctcgtctatctcgttattcgccattatttttcagccggtgttcggcctgatgtcggataagctcggcctgcgcaaacatctgctgtggaccattacggtattgttaattctgttcgcgccattctttattttcgttttctctccgctgctgcagatgaatattatcgctggttcgctggtaggcgggatctacctggggattgttttctccagcggctccggggcggtggaagcttatatcgaacgcgtcagccgggccaaccgctttgaatatggcaaagtgcgggtcgcaggctgcgtcggctgggcgctatgcgcctcgataaccggcgtgctgttcggcatcgatcccaatatcaccttctggatcgcctccggctttgcgctggtgctcggtctgctgctctggctgtcgcggccggaaagcagcaacagcgcccaggttatcgaggcgctgggcgccaatcgccaggccttttcgctgcgtacggcggcagagctgctgcgtatgccgcgcttctggggctttatcgtctatgtggtgggtgtcgccagcgtctacgacgtgtttgaccagcagttcgccaactttttcaaaagctttttcgccagtccgcagcgcggtaccgaagtgtttggcttcgtcaccaccggcggcgagttgctcaacgcgctgatcatgttctgcgcgccggccatcgttaaccgcatcggcgccaaaaacgccctgctgaccgcggggatgatcatgtcggtgcgtattctcgggtcgtccttcgcctcatcggcagtcgaggtggtgatcctcaagatgctgcatatgtttgagatccccttcctgctggtgggaacttttaaatatatctcttccgcctttaacccgcgcctctcggccaccctgttcctgatcggttttaatctgtcaaaacagttgtccggggtggtgctttccgcctgggtgggccggatgtacgacaccgtcggcttccatcaggcctatctgatcctcggctgcatgaccctgagcttcaccctgctctcgttcgtcaccctacgcggcggcaaccgtctgctgccgaccgcagagacgcagagccccgcctgactccagcgcccccgtcagggatgacgggcttcactcgacaatccgcgtctccccgccgcgattctccagcgcatagcgctgacaaggcgccccggcggcgataagctccgccagctccgccgagtggctggtcagccagatctggctgtagcgcgaggcctcgataatcagccgggccagcgcgggcaacatgtcgcgatgcaggctgttctccggttcattgatcgccagaaacgccggcgggcgtggactgagcagcgcgacggcgaggcacaaaaagcgcagcgtaccgtcggacatctccgccgccagcagcgggcggcggatcccttcgcgacgcattttcagagcgaaacgcgagtgctcgttttcacaataaaactggcagccgggaaaggcgtcggcaaggatttcatgcaaaatctcctccgcgccgatctcgacaatggtctgaaaggcggcggcgagattctggccatcgctgtcgaggactggcgaacggtaacccacggccggctgacgcagcggcgaatgccggccaatcgcgaattcatgataaaaccgccaacggcgcagcgtctcccgcactcgcgatacttcgggaaaacggtgcggctcgccaagctgaccgaacaccgactcattttcataaatactctcggtgaaagtacttttctccccggtgacatcgacgagaaacgccgcctgattcttgcgctgcagtacgcgggaggaaggccggcgggagtagccggccagccagatattctcttctttaacgataggatcgagcatgaattgcgtcggatagggcaatttttcagggaagcctatctgcagttcataatcgaagctgtcggtccggcaggcgatttgcagccggcgggggtgacgatcgaggggcgaacgctccccggaccacatcatattctccagaccgccctcttcgctgataaaccccgaaagcctgccctcagcggcagcggtcagcaggtggatggcgttataaatattggatttaccgcagccgttagggccgaagacaatgttcagcggcccgagctccagcgcgatatccttcactgagcgaaaattttgaatacgaatgtactgaatcattatgcgtccgaccctggaaatagaaggctgccacagtagcacagcggcgcccggcacaccctcttacgccccctttcgggcagggtttaacagaacatttttttcattccacgggtcagggcgacccgcgtcagcttatcgctatcctgatgggcgtcgctgaaaacgccaaaaaaatagcgttcatcgtcaatggtttggctaacaattcggtagctcaacggttgcccggatagcgcaccgtactgcgcaggcgtcaccgagacctcggtcgcgtcatcggcgacgctgaccaacagcccgtccgccttaccgcccaccagcatgaccttaattatcgggtgcaccagttcctcccgggatggcatatagcgttggcgaaccgcagggaccggcgggcgtggtgatcggcaaacagcgacgcccgacagagtgcggtatttagtactttcttatagtccatcacggccttgagtcaaaaaatagcgtgcttaggcagggctagatattgattattcgaaataaaagatgacaaatgatgaaggaaaaaagaggaattgtgaatcagcaaaacgccgggttattcttatttgtcgcttctttactcgcctttatcggccctcactcaaggatgtattgtggttatgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacatcttgccgacggcatgacggtcggcgaactctgtgccgccgccattaccatgagcgataacagcgccgccaatctgctgctggccaccgtcggcggccccgcaggattgactgcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctggcgaacggggtgcgcgcgggattgtcgccctgcttggcccgaataacaaagcagagcgcatcgtggtgatttatctgcgggatacgccggcgagcatggccgagcgaaatcagcaaatcgccgggatcggcgcggcgctgatcgagcactggcaacgctaacccggcggtggccgcgcgcgttatccggcccgcagcacctcgcaggcgtgccgggcgatatgactggcggcggcatcggagagatgccggtcggtaatgatggtggtgaaccgggtcagaggtaacgccatgaacgtggccacctgattgtatttcgaactgtcgcacagcaggatgcttctcgcgctgacctggctgacggtctccttgacggtaaccttgttctcatcaggggtgaaaatcccgcgactgtcccagccgctggcggagataaaggccgtatcgatagccaggtggcgtaacgtacgcgccgccgattcgcccacgcaggagcggttctcccggcacagagtgccgccggtgtggatcacgccgcactggctggcatcgatcagcagctgggttatctcaaaatcattggtgaccacctggagatcgttccggtcgaggatcgcccgcgccagcgccagggtggtagtcccggcatccagataaatgcaactgtttttggcgatatgactcgccgccagcgcgccgatcgcctgtttctcctcactctgcagcgtgcttttcaccagatgactgggttccgcggccagccggctgacggcgcgcacgccgcccgagacgctgaccagcagcccctgctcctccagtttactaacgtcccgacggatggtcatatgggacacgccgaggatctccgtcagctcgttaatgcttaccgccccacgctgctccaccagggctaaaatacgctgatgtcgttctattggaatcaccgctctccccttaccattttttcacaccaggcgtcaccacccaggctacgggcctggcgacacccggtgttgttatcgcgctttgccgctgttttttacgctattttagggcaagaatcgccgctgtgcagcctctttccgcctgtgaattttttatattcatgtgggttattcgtgataactctcacataaattcacatgataacgctttattctatcattaaatcacattaattaactaatgttcacaaggagaccagcatggctgcacacactaacgtctgcgtgattggactgggttcaatgggcatgggcgccgcccgcgcctgcctgcaggcgggcctgaacacctggggcgttgacatcaatcccgacaactgtcgcgcactgctggcggtgggcgccaaaggcgcgggccccagcgcggtgccgttcgccgcggaactggatgcagttgtgctgctggtggtcaatgccgcccaggtgcgggggatcctgttcggcgagagcggcctcgccgcccatctgaagccgggcaccgtcgtgatggtgtcgtccaccatcgcctccgccgatgctcaggccattgccgaggcgctggcggagtaccagctattgatgctcgacgcgccggtatcgggcggcgccgtgaaagcggccgccggcgacatgacggtgatggcctccgggagcgatgccgcctttgcccgcctcgcgccggtgctggacgccgtggccggcaaagtctaccgcatcgggagcgacattggtcttggctcgacggtaaaaattatccatcagctgctggccggggtgcacatcgccgttgccgccgaagcgatggcgcttgccgcccgcgccgggatcccactggagacgatgtatgacgtggtcacccacgcggcgggtaattcctggatgtttgagaatcgcatgcagcacgtcctggatggcgattactcgccaaaatccgctgtcgatatttttgtcaaagatctcgggctggtgaatgacactgcccgggcgctgaccttcccgctgccgctcgctaccaccgcgctgaatatgttcacctccgccagtaatgccggattcggtcgggaagatgacagcgcggtgatcaagattttcaacggcatcaccctgccgggccataaacagtgaggagagacaacatgcagcttggtgtcattgccgatgacttcaccggcgccacggatatttccagcttcctcgtgcgcaacggcatgccgacggtgcaactgaatggcgtgccgacccgcgatcttccgctgaccagcgaggcggtggtcatcagcctgaaaactcgctcctgcccggcggaaatggccgtcagccagtcgctggcggccctgcgctggctgcaggcccagggctgtcagcagttttatttcaagtactgttccactttcgacagcaccgcgcagggcaacattggcccggtgctggatgccctgctggccgagctgggtgagacgcggacgatgatttccccggcgctgccggttaacggccgcacggtctatcagggatatctgttcgtcggcgagcaactgctgaatgagtccgggatgcgccaccatccggtgacgccgatggaggatgcgcacctgggccgcttaattgagcgccaggggcgcggaaaagccgcgctgattgcctggccgattgtcgcccgggggccggaggcggtcgccgccgcgctggcggcagtcaacgatccggcggtgcgctatgtggtgctcgacgccctcagcgaacaggatctgctcacccagggcgtggcgctgcgggagatgaagctggtctccggcggttccggcctcgccatcggcctcgcccgcgactgggcgcagcgccatggcgcccggggtgaaagcgctcaggccggcatgccgctggctggcccggcggtggtgctctcgggctcctgctcggtgatgaccaacagccaggtggcggcctatcgtcaacaggctcccgcccgcgccgtcgacttaagcgcctgctttaccgatctggagagctacgtcaggacgctgactgactgggtggacgcgcagcgcgatgcgccgctggcgccgatgatctatgccaccaccgagccgcaaacgctgcagcggatccaggcgcagtatggcgacaaggccagcagcgaacgggtggaacagctgtttgccgctcttgccgccgccctgaaggcgaaaggatttacccgctttattgtggccggaggggaaacgtcgagcattgtggcgcagaccctgggggttgaggcgttccatattgggccgaccatctcccctagcgtgccctgggtgcgtgacacccgccagccgctctccctggcgctgaagtcaggtaacttcggcgatatccagttctttgcccgtgcccagcaggagtttcgtcatgactgagcaacaactgcgagaggaaatggtgcagattggcgcctcgttgtttagccgcggctatgccaccggctccgctggcaatctgtcgctgctgctaccggacggcaacctgctggcgacgccgaccggcgcctgcctcggcgaactgcaggctcagcggttgtcggtggtgacgctgcaaggagaatggatctccggcgacaaaccgtcgaaagaggtcacttttcaccgggcagtctatttgcacaacccggcctgcaaggcgatcgtccacttgcacagccactatctgaccgcgctctcctgcctgcaggggctcgatccgcacaactgtatccgcccctttaccccctatgtggtgatgcgcgtcggcgacgtcccggtggttccctactaccggccgggcgatgaccgtattgcccaggcgctggccgggctggcgccccgctataacgcctttttactggccaaccacggaccggtggttactggctcatcgctgcgcgaagccaccaacaataccgaggaactggaagagaccgcacggctgatatttaccctcggcaaccgcgagatccgctacctgaccgctgacgaagtgaaagaactgagataaaaccatgccaaaattcgctgcaaatttatccatgctgtttaccgaactgccgttcctggaacgctttgccgccgctgcccgggcgggatttgaagccgttgagtttctgtttccctatgagtatgccgccggggaaatcagacagcgcctgcaggagaaccagctgcagctggtgctgttcaataccccacccggcgacgtcaacgccggagattgggggctcgccgccattcccgggagaagcgcggaggcccgacgcgatattgagctggcgctggagtatgcctgccagctcagttgcccgcacgtgcatatcatggccggcgtggtgccgccgggagcggatcgcgcagactgcgaggccgtgcttatcgataatctgcgctacgccgcggagtgctttgcccgccacgacaagcggatactcatcgaagcactgaatccgcagaccaaaccgggctatctctaccacagtcaatatcagacgctggcgatggtgaaacgggtcgacaggccgaacctggcggtgcagttagatctgtttcacgcgcagaaggtggacggcaatttaagccatcttattaccgaatatgccggccagtatcgccatattcagattgcctccctgcccgaccgtcatgaaccggatgagggcgaaataaactatccgtggctctatgcgctactggataaaaccggttatgacggctggatcggctgcgaatatatcccccggacagacacgctttccgggctggggtggttctcgccctaccggaaaaaataaacgccgttttctaaaaaaataactctctgtacacctgttaatacccgaggcaaacctatgtcgacatcggcgctgttacttattgcgttagccagcgtagtgctgttgctcctgttagtgatcaaagcgaaagcacatccttttgtggcgctcctgatcgtcagtctgctggtggcattcgccaccggcattccggcagataaaattataaccaccattgaaaaaggcatgggcggcctgcttggccacatcgccagcattattattctgggctcaatgctgggggtactgattgaaatgtccggcggcgccgaatcgctggcgaaaacgttgaccggcgtactgggtgcaaaacgaaccattgccgccttaaccatcgtggcttttattctcggcaccccggtcttttttgaagtcggctttatcatcatcattccgttaatctacggcttcagcaaagtcgcccacgtatcgccgctgaagtttggcctgccgatggccggcgtgatgttaaccgtccacgtggcgctgcccacccatcctggcgcagcggctgcggcaggcattctgcatagcgatgtcggttggctgatgctggcggggattggggtgtcggtggtcgtcggtatcgtgggctattttgtcgcccggtttatcaatcggcgccattatcatctgtcgattaacgtgctggagcagcaacaaacggcggaagtaccggatctctcggttaacgcgcagcagacccgtctgccgccgccgaatgcgctggttatcggtgggctgatcgtggtgcccatcatgctgattgtttccgggacgctgtgtcaggcgcttctgctgccggaaaacgcggttcgccagctgatgaccgtcattggtaccccgccggtcgccctgctgatctccctgggcctggccagctggacgctgggcatccgtcggcggatgagcctgaaaaagctgggcgaagtcaccggcagcgcgatcccctcgtcggcggacgtgatcctcgtcgccggcgccggcggcgcctttggcggcgtactggtcgcttccggcatcggtaatgccttagccgaggcgctggagacaatacatctgccgctgatgcccgccgcttttctgctatcgctggtgctcagagcctcgcagggttcggccaccgtggcgatcctcaccacctccggtctgctgtcgcaggcggttgtcggtctggagccgctgcaactggtgctggtgacgctggcgacctgcttcggctcgctcgggctgtcgcacgtcaacgacgccggattctgggtcgtcacgcgctatctcggactctcggtgccggatggactcaaaacctggaccgtcttgacaaccatcatgggggtgacgggctttctcatcacctggctgctgtggtttgcgctttgatgttaacctgggtggctccggccaccttaacttcgccccggcgcaggccctgacccactaccgctgtcagaccgcagacccgctgccgacagcgtcaccgggataaaatagcgtacgcgatagcgcctgtcccctgcctcttcgccttccgcatggcgggttataaaacattcaatgtcatagccgtcccgacgacttacccccagggatggcagcagctccatatacagatcgctggataaacgagcataacgtgaccagctgccgtagaattcaaccccgacataaagccctgaccgggtggtcagcgagctgttcatggccagcgcggggggcagctttcccgcctcatgacagccgacaaaagcgttaacctcgacgttaagctcatttttactcgccgcggcgtagtcggaaagtacggaaagcgagcctccgccagcggtgaaaaaacggtcaaccttttgtctgatgctcgtcttagcggtgctttgcaacaccaaatccgacaggcgcagttcatacttcattggatagccgtaatagacctgttccggcagagaaaaaaaacgagccagaggtaggctctctccgtccgggtgaaactttttcaacagctttgccgtgtcccagtgcgccgcgcaacggtattcacgtggcgagagcgaaaagcgcttcttaaactcccgggaaaaggtctgcggcgagtcatagcttaactgccaggcaatagcggcgatcggttgtcgtgttaagcgcagactgaccgctgcgatggtcaaccgccgcagacgaatatactgcccgatgggtaactggccatactggtaaaacacgtcgtacacaaaccgacgtgaatagcccatatacagcgccaggtcatcgatcgccgggttacaatagatattatcctccagccacgccagcattttcaaatagagcatctgcttcataagtacggcatacatcctgtattcttgtcctccgctaattttaacaacagagcgcggctatcactaagctttttatgcatcgcaaaaataaaaaaacagcaaacggctttaaatagttacaaatatatgcttaaggttttgtttattaggaactttcgcatatcaatataccgttatctcactttccccaccagatattgcattaatggaaaacatcccttagattaccacggctaaaaatagtacctgcatcatcattatattctttaatttatccagatatgttttttaatgcccacagggaagttatatgactaattttttgttcaatataaaaaatcactatttgcgagtcgctattgctgaactggttgatgaagcgatgaaggccgccgggcggccacactatcagttttctcaacaatgggatgcaggatcgatggcgcaagctgatgtgatattcacggaaatggtcgcgggggagtggtacttgtgccaggatctttttcagcatgccccggaacaatatacgctttttattttcccggacaatgaacacgctaccgtagatgagggtttaccgaattgtcttcagcatgcggtatttatgccgcctcacgctcgcgttcagcggctgaaagatgagatagctaacgccattgaacgtccgctgctaccgcggcaagatccgccgttcaatcgtctgcggcgttgcattaattgcgcctgcaggtcggtcagcgacgcgcaaaccaaagtcatttacgcgttcagtattggcctgagcccgcatgaagtcgccgctgcgctaaatattagtcccaaaacgatccattcacataaaaagaatattatgagtaaatttaatttgaatagccgccagcagtttaacaaccttgtgcaactgctcgccaaacgctgatacaactcgtcattttattctgtcaaacaatcatcttctggaacggaaaacataccgtctcttgcgcctttcctgaatataggaaaagccactccataaagaaatgatgggacataaaatcagacacaaaataataaagaagtcgctcatatcaaacctgacaaaagaatttaatttagagtgataatattcactcgattatattcaggcaagaccagcgcctcatttttgagagtgggaaatagaatggtaggataattcctggtagcgaatattaacaggtaaaataagacgcagcgccagtgtctgaggaaggaatgagaggcctgttagcgtctttttgcattgaggatgagaaaaagatagccaaatgtgtaattccctgtacagtggagggaatcacaaagtgaagctcgcgttccgcgtagcggacatcacggttggttgaatgtttgtacatatcagcctcgccctcctttagggtcaggccatactcatcttgcatgctgagcgcggatgttcttacgccgcgggagcgatcgtaacaactatgctaaccaccctgatttaccgcagccaggttcatcctgaccgcccgcccgtcgatctcgacgctttagtccatcgcgccagcagtaaaaatttgccccttggcatcaccggcattctgctgtttaacggcctgcagtttttccaggtcctggaagggactgaggaggcacttgagtcgctgttcagcgaaatccaaagcgacccgcgtcatcgcgacgtagtggagctgatgcgcgattactcagcctaccgacgttttcacggcaccggaatgcgcatactggatctccggctgtttgaaaccgatggcgcgctggaggaaattctgcgctttagcacgtttggggtcaccgaaccggtcaacgaccggatgttccggctgcttagcgccttcattgccgacggcggccgctattgcctgcccgagccgctgcagccctctcgctggatgatgatgcccgcgtcaggtacggccgcgccgcagcacctgcccggtcaaccttgccagtttgctctgcaggctattgtcgagccggctaaaaagcgagtttcttcctttgaggctctgatccgcagcccaaccggcggctctcccgtggaaatgtttgctgccattgcggcggaggatcgctaccgttttgatcttgaaagcaaagcgtatgcattcgctctcgccggccagctgccgctcgggaaacatcagctggcgattaacctgttgcccggatcgctgtatcaccaccctgacgccgtaggctggctgatggacagcctgctggcggccggcctcagaccggatcaggtactgatcgaggtgaccgagacagaggtgatcacctgctttgaccagttccgcaaggtgctcaaagccctgcgcgtcgcgggcatgaagctggccatcgacgactttggcgcaggttattccggcctgtcgttactgacccgttttcagcctgataaaatcaaagtggatgcggaactggtgcgcgatatccatattagcggcaccaaacaggcgattgtcgcctcggtcgtccgctgctgcgaggatcttggcattacggtggtggctgaaggtgtcgaaaccctggaggagtggtgctggctgcagtcggtgggcattcgcctgtttcagggctttctcttttcccgaccctgccttaacggcatcggcgagatctgctggccggtagcgcgccaggcaatggacctgtaaggccgcgcacccgggcatcgtcactgccagtgggcaagcttttcgctcagcgccgccagggcatatcgtaccgctttcgccaccacggtctcacagtcgccggcaaagcacatccgtttggtttcagtctggccgcgaaaattccaggcaaaccataccgtgccggcgggggtaccatcttccccgccctccggtccggcgtagccgctgacggcgatggcgatatcggccccggcgagcgccagaataccagaggacatctcctgaacgcaggcttcgctgacggcgctgtgtaccgccagggtttccgcgcgaacctgcagcacgttgcgcttggcttcatcgctgaaggtcactacgccggtatcataaaatgccgcggtatccgcctgggcacagagcgctgccgccagattccctccggtgcaggactccgccgtggtcagtcgccaaccgcgcgcgatcagcgcccgagccacttcagcggttagttcatgcgtattgtttgcgtcgctatcgatctcgtcagtcattcttcctcctcgccgaaattgaaagaaatagcagactcactgcgtctgttaacagaatagcatatcgatttctttgtcgtcggggggccatttatattttcagggggaaaggataaaggcccgcagggcgggcctttaaggtaacatcgtcggaacaacggtgaatcaaactttatgttctatcacgcgtccctgattctcgatcgcaattttacgcggtttttcgctctccgggatttcctggtggattgctatttttaagatgccgctatccagctgcgcctgattaatttgggcgtgttcaggaagagagaaactgagctggaaattagcgcggcggatacctttataaatccagcgttcaccgctgtctgtcgaggaatcggtttcctggcgtttcccggaaatatgcagattcccccctacggtttctatttccagctcatcatctttccagccaggcacgctgacgctgagcaggaaattgctgtcgtcgactttctgtaaatcataagccggtaaagtgcccaccggcgtatcgcccgttaactggctgaaaagacggtcaatacgattaaagcgatcggcaaaaagagaatcagcaaataccgggagtgctgacaaggttttgagtgccataattaacctcctgaatatccattcaaaagctcaacataaaggcaagcattgcttgtccgctatataaaataatatctaaggcgcgtttttcaagacccgaaataaaaaatttttcttcgccagcctcagtgaaaaataagcatgccggtggcgaagttacccccgcccgacggcgggggctgtggcgcttctgagtcccataactgatgctgtttaacattcaataaacagaagcgacatgtatatataacttgtttaaggggatgtcaacgtccgaatcgctccccctttgccgtcgtgtattctccccatgaacagcgcgtttagcaacacggctgcctctcagggtccccttgccaacagcggcgcttcgacgtggcattcgccttgttgccgtcaaccggacgccgctggtgaaaatatacccggccgggtaaggaacctttcatccgacaccgtgcctaatgatctgcatacgcactttctgaggcaccgccatggccagcatttttatctcaaccaccctgttcgccctcttcgcgtcgatgttgatcggcctgggaatggtgtggaaaagcatttccaacaatcctgataactgattctgttgtacgccgttgctgttcaccctccgcagcggcgggtctaccccgcccctttttatcaatgaccaccccaggtttcgctcaggcgcaatctcctcaaggacccacgcctgcaaaaggtatttttgaaaaagcaattcatacagtgaataagtcattctgattaatatatttgagaccagaattaacgcatgcaatataagcaatttaagcagtttgtgccaaattagcgatcatgcccgcgcaacgctaaaaaataagccattgattaatataccattaattttactcgccagctcaaagtccaaaattagacttattgcatttattgattattagaaatatcctaaaggcatacgcatttaatgttctccactttaaatgcatgacaactttcacgatcgccatgactatgcctgatattttaattaacactgaaaacatatttcttaatcgcggaatttgcgaactgcttagcgagatcgcgaaagaagaacacatccgtgaaccgtattccgttgtagactattccacagatatattaggtccgattgatatgctgttcacagaaatggccgctggtgaacattatctatgccacccgtttttcaaaaaactccctccgcacacgtctatttttattttcgtcgccaccgacagcgctttgcaggttgaacggttaccactttgtctacgcgatgccacttttatcagcatgaacagcgacttgcgccgcgtaaaaaatcagattgcaaaacgtctgacggagtcgacaacatctagttgcggtgggctggaaaaagacagcagacgctgtgtcaaatgccctcggttaaccttgaccaaatcacaactttatattatcgatgcgatcagaacgggaatgaacaatcagcagatagcgcaagaactgggcatcagccataagacggtcttctctcacaaaataaatattatgaaaaaattccaaatagctaccaaacaagagttaacgagattctcatctgttgttcttgcgctttccgcaggaaggatcggttaacgtcggaatttattaaagcgcatcttcatttttcttctttctctaacataggacaggccaaaaaacaaagatgtaaacaataacaccaccgccaggactaataatagtaagttactcataacaaccttttaaaagataaagatgactttttaaataataaggggtggatgttttcaaatacaacccagcgacaaccatttcagacaaaggtaaaactccgtgcgataattctgaaagataataaaaagagtaaaaaggatttcttttatcagacaggcgttagggtaataacgatgaagcataaacggacaatgccaggcctaacgcccagcgtgtactgtcgcgacgtcaggcaagatgacggcctgaaataatggtctactgacgtggaaggagcgtggtatttgggcaggtgaaaacaccgttttgcagctgttctatactgttagtcagacatcacgctggaggtggctatgtgcggacgttttgcgcaagcgcaaagccgggaggaatacctggcgcatctcgttgaagcggccgaacgagatattgcctgggacccggcgcctatcgggcgctataacgtcgcgcccgggacaaaagttttactcctcaatgaacgcgatgagcaactccatctcgatgccgtttactggggctatgcgccaggatggtgggataaaccgccgctgattaatgcccgggttgagactgcagcctccagcaggatgttcaagccgctgtgggagcacggacgggcgatctgcttcgccgacggctggtttgagtggaaaaaggaaggaaatacaaagcagccatactttatccagcgtaaggatggccagccaatttttatggccgcgattggtcggactccgttcgaacgtggggaccatgccgaaggattcttgatcgtgacggccgccgccgatcgcggtcttgtcgatattcatgaccgtcggccgttggtcctggcgcctgaagccgcccgggaatggatgaggcaggatgtcaccggcgcggaagcggcggagatagccagcgacggagccgtttccgccgacgattttacctggcacccggtaacgcgggcggtcggcaatgtgaaaaatcaggggcccgaattacttgcccctctcatcccatgacaaacgtaatcaaagcggcggataacgcatcatgttcagcgaagagataattaaattttataccgccctggagtagtgccgaacatccgacggaacaaggctatgaaggcactcacattgtcatatcccagatccagcgctatcgccgtcactggcttgccggcagccagaagctcaagagccctgagtaagcgtatccgctgtcgccattcattgaagctaaaacccgtttcggctcggaatcgtcgcgtgagcgtgcgtgatgacatgccggcccaggctgcccattcttccaacctgcgcccgtcgtccgggtttgctgacagcgcctgcgcgattctgagcaatcggctatcttgcggcattggaagcccaagattaaccctgggaagggaaccaatttcatcaagaataacgccagctaaacgtttttgggacgcagtaagctctacaccttgccatgcagccgctcgcgttatcgcttcacgcagcagatttgtcattgagagaacagatggcttatcaggtagctcgccacaggctttggcagaaacataaacactccatcctgaatatggaccgtgcgagcgcaggccgtgcggaacacctggcggtatccagacggcatgtgttgccggtaccacccagcgacaatcaccgccatcgaccgtaagtagcccacgtatggcaccgattaactgcccacagctgtgatggtggcgtggagtctcccgtattacctcagactgacgtaccgcgacgagtaaagtgggtccctggggtgaaaataccggttcgaatggaatcaatggatcgtgcatattggcgtgtttgaggcgtttaatgtcttttataccgtactgaagccagttagtcgattgtaaagtattcatcactttcacagaggactaaccatcaaaatgattactattactagggtattggatgacattatcaaccaccaacagataccactggatcggatactcagtcgctattttagtcccggttatcggcagcgtactgataacaagtgggaaggattagatggctttgctcagcatgcgcgtagactccgggaaattatcgccttcgctaaaattgagttacatgacgaacttcgtaacgggaatctttatgccacaaggcatcgcgttctgtgcaccaggcgcagcggagaagaggtggacatggaagtttatatgttcgctgaaatagatgattccgggcgcttcattcgtatcgaagaagccacgctaatgcttaaagggagagagagcgataaagatttaggcagcgtgaggtaaaagaaatataaggttacgactagatcagacaaaaaaccgggcagcgcgcccggttatcttgtcagactaaaattgccctacgcactcaacccgcgatttttcagcatcggctcaatatgcggatcgtgtccgcgccactggcgatacagttcagctaaatcagtgctgttcccgcgtgataaaatcgcctcacggaaacgctgaccgttctcacgggtcaaaccgccctgctccacgaaccattgatagccgtcgtcggccagcatctgggtccacagataggcgtaatagcctgccgcatagccgccgccgaagatatgggagaaatagctgctgcgatagcgcggggggaccgccgccagatccaggttctcttcccgaagcaccagctgctcaaacgcgtccatctcctccggtaatgccgaggtcgacaggctatgccaccgcatatcgagtaacgcagcagccaacagctcgctcatgtcgtaccctttattgaaggttgccgcacgcaacatattgtcgcgtagcgcctgcggcatcggctccccggactggtagtgcttcgcgtagtgggcaaacacctgcggctggctggcccagtgttcgaagatctgcgaaggaaattcgacaaaatcgcgcggcgtattggtccctgagagactggcgtagcgctggctggcgaacagcccatgcagggtatggccgaactcatgaaacagggtgatcacctcatcccacgacagcagcgcgctttgccctgcctgcgggcggacgtagttgcagacattgtagataaccgggcgctgcgcgcgcagggtcgactgttcgacaaacacatccatccatgcgccgccgctctttgagtcacgagcgtagtagtcaccgtaaaacagcgccatcccttcgccgttgtgatcgaagatctcccagacccgcacatccgggtgatagaccggtatatcgaagcgctcaacaaagcgcagaccaaagagctgcgaggccgtccagaagacgccgtcgtgcagcacccgcccgagggcaaaatagggtttgagctgcgcgtcatcaatggcataggcagcccgccgcacctgctcactgtagtaaagccagtcccatgccgtcgcgcgaaaacccccgccttcgttgtcgatcacctgctggatgtccgccagctcacgttccgccctcgcccgcgccgccggggcgatctgacgcataaagcccaatgcctccgccggggaagccgccatttgatcggtcagcgcccagctggcgtaatcagcggctcccaacagctcagcctgctgcgcgcggatcgccgccagccgcagtaccaggtcacgcgtatcatgctcatcgccctgctgattgcgggtccagccggcggcgaagagattctcccgcgtttgccggtcgcgcagcgcaagcagctgcggctgctgggtggtattggtcagcgtcagcaaccagcggtcgctaagccctctttcacgcgctgcgtcagccgccgccgctatctcctcatcgctcaggccagccagctgatgccggtaatcaaccaccaggccgccgctttttgccgctcccagcagtcgctgctggaactgactttgcagcgtagccgcttcggtgttcagtgcgcgcagcgccgcctgctgctcgggagccagcgtcgccccggcatgtacaaaacgttgccacgtcagggtcaggagacgataggactcgctgtccagcgccagcgcgtcgcgctgctcgtagacgctgttcacgcgctgaaacaaggccgcattaagccagatgtcattccccagctcggcgagttcggcggaaaattgttcatccagtgattgaatataaggattggtatgggcgccagccatggcgaaaaagacccgcgtcacccgcgccagcagctgaccactctgctccagcgcctcgagcgtgttggcgaaactggccggctgcggattgtcgataatagcgcgaatttcggcccgctgctgccggacgccctcatcaaacgccgggcgatagtggctgtcgtcaatcacatcgaacggcggcgcctggtaaggcaacgtactgacgctaaaaaaggggtttcgttcggacatctttctctcctgtacaggctaatgctgtaagattaggcctctccttaaggggtcgcaatgatttccgttaccggtcgccgcctgtgcgtgctatggtatgaaaacacaaaaagcgttgaggaacagtaagatgattatcatggtcaccggcgccaccgccggttttggtgaaagtattactcgccgttttatcgctaacggtcataaagtgattgccaccggtcgtcgtgaagagcgcctgaagacgctgaaagacgagctgggcgataacctttatatcgcgcaacttgacgtccgcaaccgcgccgccattgagacgctgattgctgacctacccgccgagtggcaggctatcgatgtgctggtgaacaacgccggcctggcgcttggtctggagccggcgcaccgcgccagtgtggaagactgggaagatatgatcgacaccaataataaagggctggtgtacatgacccgcgccgtgctgccggggatggtggagcgcaatcgcggccatatcatcaatatcggctctacggcaggcagctggccttacgccggcggaaacgtctatggggcgaccaaagcctttgtccgtcagtttagcctcaatcttcgtaccgacctgcacggcaccgcggtgcgcgtgaccgacatcgagccgggtctggtgggcggcaccgagttttctaacgtccgctttaagggcgatgacgctaaagccgaaaaagcttacgaaaatacccaagcgctaacgccggaagatgtgaccgaggcggtctggtgggtcgccaccctgccgaaacatgtcaacatcaacaccctggagatgatgccggtgagtcagagctttgccggactcagcgttcaccgtcagggctaaccgtcagccacccggcctgcgggccgggtatgggcggaaacgcaaaaaacgcgtaaaatagtgcgcataaccccctaaaaagtaaccatcaatggccgcagaatcgcaactgaatccgacgcaacccgtcaatcagcaaatttatcgcatcctccgccgggatatcgttcactgcctgatcccgcctggtacaccgctgtcggagaaagaagtctccgtgcgttttgcggtgtctcgtcagccggtgcgcgaagccttcattaagctggcggaaaacggacttatccagattcgtccccagcgcggtagctacgtcaataaaatctcattgtcgcaggtgcgtaatggttgcttcgtccgccaggcgattgagtgcgcggtggttcgccgtgccgccggcatgattaacgaagagcaactttatcagctggaacagaatcttcaccagcagcgtattgccgttgatcggcagcagttaaacgactttttcctgctcgatgatgaatttcaccagaagctgtcgattattgccgactgtcagctggcctgggagacggtggaaaatattaaagccgccatcgatcgcgtccgctatatgagtctggaccatgtcacctctccggagatgcttctgcgccagcatcatgagattttcaccgcgctggaaaaacgcgatgccgaggcggtagaaaaagccatgagtatccatttgcatgaaatcagcgaatccgtactgctgattcgccaggagaaccgcgactggtttagtgaagaataagagtcagacggctgccggcatggccgacgcagccgttgtcattgaagggattatctaacgaccaataccggcgttttggcgtagcgcagaattgactcggcgttggagcccagcagatgggtggagatccctggtttgcgggaaccaatcacaatgacatcgaactcttcgttgttactgatagccagaatttcgtcacgcacgttgccaaagactacgcgggtatggatccgcgtcatggggatggcgaacagtcgcgccacctcgcgcatttttttctccgactcttcttccatataggcttcaaacttacgaatatccgccgtaaaaccgcgcaatagcgaacggctgctgttcggcagaacgttgagcaaggtgatctcgccattttcggccgaagcgagaaattccgcgtgacgcaccgctttatcgcttaaatccatttcaaagacatcaacaggcaataaaatttttttatacatggcccgtactccttttgcagagaaagttctttttcaataacttaactatgccattattgcggtgaaataccagtcattgttcggaaaaataacagctaattatctttagtaaatcagggaaatatagagttatgtatagacattgcgttcgatcatattctgcgtctgctaaaaccgatcgctagcaaaaaatagacatcagcggagtatcgtagaaataactgaagagccggtgtcgaccccgggaccgacaccggaaaaagattattgcgcggcggcccacgcggcgacggtagctttagccccctgccgctgcagcgctaagtaggcgcgggtcaccgccgtgacaaagcgtgactcctgcggcagttcgacgccgaaaatagcctcaatacccagcagcgctttgactcgcgcttcgccatcggcgctggcagccaccgcttgctggataaccggcaacaacgggtcgcatatctcgattgactggcccgcatcgtcaacgccgccaacgtaacgcatccaccctgccacgcccagcgccagcagtgtaaaatcacgctgatgcaccagatgccagcgtatggagtccagcatgcgctggggcaacttctggctgccgtccatggctatctgccaggtgcggtgcttcagcgccggattgcagtaacggtcaatcagcaaactggcatagcgtgacagatccaccccctgcaccttcagcgttggtgcctgttcgtccagcatcaacgacagcgccgcgcgacggtagttatcgtcctgcatacagtcgttgatatgctgataaccggccagatagccgagataagcgaggaacgaatggctaccattgagcattctcagcttcatctcttcgaaaggcaccacgtcggcgaccagttccgctcccgctttctcccactgcggacgtccggcaacaaagttatcctcaatcacccactgacggaaaggttcgcaggccaccccggccgggtcgcgcaccccggtcagctgggtaattttatcgagggtttcggcagtcaccgccgggacaatccggtccaccatcgtcgacggaaaggtgacattctgctctatccatgcggcaagatcctcgtctaaagcccgggcgtaggcgcagacgacgttgcgcatcacgtgaccattttccggcatgttatcgcaggacatcacggtaaaagcaggcaggccggccgcccggcggcgagataaggcctccaccactacccccgccgccgattttggctggtgcgggttatgcagatcggcggcgatcagcgggtgatcgagctgcagttcgccgctggctggcgaatggcaatagcctttctcagtaatcgtcagggagacaatggccacctgtggctgacacatcgccgccagcaccgcttcgagaccatcaaccccggcgtgcagcgcctgcttcaccacaccaaccacgcgcgcggtccaggcgtcggcggacatttcggcgacggtatacagcagatcctgctgctggagatcggcgatctgctgctcgccgccaatcagattaacttcggtgtagccccagtcgctgccgtgctcgctggccagtatatcggcatacacagcctgatgagcgcgatgaaacgcgccaaaaccaagatgaacgatacgggggatcagtgcgctgcgatcgtaggtcggcagcgtggcgttagcggttaagagggtgttttccatgatgactctcgttgttatgtagcccatcaaccattctcggggagaactctcgaggagaatgcctttgtgcctcaaccatctcacgcaattggtataacatctttgatttctgtcaactaccatacaagaagatctcgcctgataaagcacggggcacgtggctgcaatcgccgcagtgacaggatagcgcaggagaagaacatggcggccgcgcgtccctgcgggcctgctgttgacgaatcgccgagcgttgttaatcgatgcgagttttgacgataaagaagtagcacagcgccccggcaaaggtcaccccggcggcgatcaccagcgccagattgaaagagtgagtcgtatccactacccagccggtcacgatcggcgcgaaggaggcaaacacaaagctgccgaagttctggatcgccgccaccgaagccactttatgctccgccaccattacctgcaccagcccccaggcggacgtcccggcaaaatgaacgcaaaacagcgccatggagataaaagccaccgcctgggctggcgtggacgattgcaccaccagcaaggtgcccagcgccgacagcaccagaccgataacaatcgccgttttgcgggttttcgcctgatcgtagcctctgcgcgccagggcatcgaccaccaggccgttgacccacatccccaccgccgcggcaagaaacgggatcgccgccacccagccggtacgggccaggcttaacccctgctgcgcctgcaaatagccgggtaaccaggcgatatacagccagccggtgtagttcacaccggaaaagccgaggatcatcccccaggtagtccgccgtttaaacagagccagccattcgctaaacttcagcgccgggcgggccgcctcctcactggccagatactgctgctcctcctcctgcagggtaaactgccgacggttacggtagcccacataccagcacaggccgaccacgatcccggctaaaccaatcaccacaaacatcgttcgccaaccccaggccaactgcatgatgaccagggccggcggggcgatagcctggcccagcaccgtcgaggagttgaatattcccaccgccgtgccgcgctctctttgcgcataccagtcgttgatcgatttcacgccggctggcataaacggcgcttcgccgatcccgaggccaatgcgcagcagaataaaatgcgagaacgaattgaccatcccggtcagggcctgcatcgcggaccagaaaatcagcccggcgcccagcacaatccgtggtcccaggcgatccaacaaaataccggagggcagttgcgcgaagccgtaggagagcgaaaaggcggagagcagcaccccaaactcggtggcgctaaggcccaggtcggcgcgtatcgcctccccggcgacgctcagcgaagagcggtcaagaaagttgacgataccggcgataaacagcagcgtcagggtgatcttctgcacccgacggatgcgtaacggcgtcgccccggtccgggcggcaagagtctcgatagccatcgttgttccttacagagtcatatgaaataggatgtctgataagtaaggcaacaggtcgactaccatacaagaattagggttgaaaaaagcggcagggatcacacatgacgggcttaggcccgtccccaccccgccacgatgattagcatgccgcacagggcgatggccgcgcccgcccagtcataatgggttaatttgaccccatcaacgacccgcagccagagcaatgcggtacaaacgtacaccccaccgtaggcggcatatacccgcccgctggcggccggatggagcgtcaggagccagacgaatagcgccagcgccagggcggtggggatcagcagcagcggcgttgccccgcgcttgagccatagccacggtagataacagccgacgatttcacacagagcggtagcaaagaacagcagcgttgttttgagcattaaaagattcgtaaaagagacaaagcgttgaaccattctacgcgataatggcctctgccccacgctgttttgccggctatgcccgacaaaagagctgtagtaaactgaacctgagggttaacccatcacttaaaggaaatcgtgatgaacatgacactgaataaacgctggtgcctgaccgccattctggcgttaagcgctgtggtctacacctccagctcctatgccgccaccgaccggctggtgattgaatctggcgacagcgcgcagagccgtcagcaggcgtcgatggaaaaagagcaatggaacgacacccgcagcctgcgccagaaggtgaacaaacgggcagaaaaagagtgggataaagccgatgtcgctttcgacgcgcaggataactgccagaagagcgccaacgtcaatgcctattgggagccaaacaccctgcgctgtcttgaccgtcgcaccggccgcgcgatcaatccctgagccgctccctgaccacgctggcgcctgcgggcgccgcctttctgtaatcccttttccgttttgaccacaggaatctccatgaccgacgcgctacacgtcaaactccgcccgcttgagcgcgaagatttgcgctttgtccaccagctcgataacaacgccagcgtcatgcgctactggtttgaagagccgtacgaggccttcgttgagctctccgatctgtacgacaaacatattcacgatcaaagcgagcgccgctttgtcatcgaatgcaatggcgataaagccggactggtggagctggttgaaatcaaccatgtgcaccgccgggccgagttccagatcatcatctcccccgacttccagggaaaaggtctcgccacccgcgccgcacgtctggcgatggactatggctttaccgtgctcaatctgtataagctgtatttaatcgttgataaagagaatgaaaaagcgatccatatttaccgtaagctcggctttatggtcgagggtgaactgatccatgagtttttcattaacggcgagtaccgcaacaccatccgcatgtgcctgttccagcaccagtatctggccgagcacaaaacgtccgggccgtccctgctgaagccgacggctcagtaataatcgatacggtttttaatggtgtagtggcgggtcagcggcggctggacgctttcatcgatcacctgcagctcacagctcagcggattgtcgtgatcgtcgtagtcgcaggtctgacgcaccgtgcccagcgtgcgatcgttgaaggtgctgatggcggtatagtccaatttcttacgcggatcctttgacggcgttgaggcgacggtaaatcgctcctctttggcggtggtggtttttcccagcggatagccatcgctgtcatagcggtaggtggcggtggtctctttgccgcgtgcgctgataataaaaccgttatcatccgtctcccaactcaccccggcggcaggtatctccgccagctgacacttgccctgcaggcgcagccgcttctcgtgggtgcgcccgtcgacgtaatagttggcgtccagcagcagcgtggcgccggttttgttctccacatcttccagggtcagcagatcgaaacacccttccctggagagctgagcgctcaccttcttgaccaccacatcgtgttcatccagcagcgtctggctaaaatctttcaccggcccgcgcaggggatcaaactcaaactcattggaaaaactcgccatctccggggtgaaggcgtccggggcgcttttacggtcgcatgccgtcagcagcagcgctgccgggatcagccaatacaatcttttcacagacgattccttttgtgtacatccgatcatattagcaaatacaattgtttacaccagttctgctatgcttaaatctggataacatcgataaggagcgtaagatgaaactatccctctgcaccggcgctgcgctactgctgtgctccacggccgtactggcggctcccgactcctgtgaacgggtcaaaagcgacatccagcagaagatcatcaacaatggcgtaccggaaaccgccttcagcctggccattgtgccaaacgatcaggcagaccagcccggggttcaggtggtcggtcattgcgccaacgacaccttcaaaatcacctatacgcgtaacagcgacagtcccgccgaaaacgacgctcagtaagccctcttcggtttcaaatgaaagatcttatccctgcattgaccagggataaggtctactggctacccataacgtattatcgctcacccctgcgtctgttaatggcacagcggcccttctccgtacaacataacgatcatggagtgagcaatgtcgaatcaggaatctcccggcggcgtcagccgacgcgcgctactaaaatctacagccctcggctccctggcgctggccgccggcgggctgaccctgccctttacgctgcgccgcgccgcggcggcggtacaacaggctacaggcgacacaacccgcattgtctggggcgcctgctcggttaactgcggcagccgctgcgccctgcggctgcacgtgcgtgatgatgaagtggtttacgtcgaaacggataacaccggcgacgaccgctacggcgaccatcaggtccgcgcctgcctgcgcgggcgttcgattcgccggcgcatcaatcatccggatcgccttaactatcccatgaagcgcgtcggcaagcgcggagaaggcaaatttgtccgcatcagctggcaggaggcgctggataccctcgccgaccgcctgaagagcgtggtagcgcagtatggcaacgaagccgtatacattaactactcttcagggatcgtcggcggcaacatcacccgttcgtcgccttccgcgtcgccggtggcgcgtttaatgaactgctacggcggctcgcttaaccagtacggtacctacagtactgcgcagattgcctgcgccatgccctacacctacggcagtaacgacggcaacagcacctcggatattgaaaacagcaagctggtagtgatgttcggcaacaatccggcggagacccggatgagcggcggcggcattacctggtatctggagcaggcccgcgagcgctctaacgcgcgaatgatcgtcatcgatccgcgctacaccgataccgccgccggtcgggaagatgagtggatccccattcgccccggcaccgacgccgcgctggtggccggtatcgcctgggtgttgattaacgaagatctggtggaccagcctttccttgataaatactgcgttggctacgacgagaaaacgctcccggccggggcgccggcgaatggtcactacaaagcctatatcctcggcgagggcgacgacgggatcgctaaaacgccgcagtgggcctcgcgtataaccggtatccccaccgatcgcatcattaagctggcgcgcgaaatcggcatgagcaagccggcctacatttgccagggctgggggccccagcgccaggccaacggcgaactcaccgcccgggcgatcgccatgctgccgatcttaaccggcaacgtcggcatcaacggcggcaatagcggcgcccgcgaatcaacctacaccatcaccattgagcgcctgccggtgctggaaaacccggtgaagaccgccatctcctgctttacctggaccgacgccatcgcccgcggtccagagatgaccgccagccgcgatggcgtacgcggaaaagagaagctggatgtgccgatcaagttcctgtggaactacgcgggcaacaccatcatcaaccagcactccgacatcaataagacccacgaaattctgcaggatgaaagcaagtgcgaaaccattgtggttatcgacaactttatgacctcgtcggcgaaatacgccgacctgctgctgcccgacctgatgaccgttgagcaggaggatatcattcctaacgattacgccggcaatatgggctatctgatttttattcagcccgccacctcagcgaagttcgaacgcaaaccgatttactggatcctaagcgaagtggcgaaacgactcggcgacgacgtgcatcaacgttttaccgagggacgtacccaggaacagtggctgcagtatctgtacgccaaaatggtggcgaaagatccggcgctgccggcctacgaggatctgaagcgcatccgctcaaaaccccgtccggcaaaattgaaatctactccagccgactcgcagagattgccgcccgctggcagctggagaaagacgaagttatcagcccgctgccggtctacgcctccacatttgaaggctgggacgatccgctgcgcagccagtatccgctgcagctgtttggtttccactataaagcgcgcacccattccagctacggcaacgttgatgtattacaagcggcctgtcgccaggaagtatggatcaatccgcttgacgcggaaaaacgcgggattaaaaacggcgatatggtgcgcgtttttaatcagcgcggcgaagtccgtcttccggcgaaagtgacgccacgcatcatgccgggggtctcggcgatgggccagggcgcctggcacgacgccaatatgaccggagatcggatcgaccatggcgcctgcatgaataccctgaccacccaccgcccgtcgccgctggcgaaggggaatccacagcataccaacctggtcgatatcgagaaggtttaaggagtaaaccatgagcacgcaatatggattctttatcgactccgctcgctgtaccggatgcaaaacctgcgagctggcctgtaaggactacaagaacctgactccggaggtcagcttccgccggatctatgagtatgccggcggcgactggcaggaggacaacggcgtctggcagcagaacgtgtttgcctattacctctccatcgcctgtaaccactgtgaagatccggcctgcaccaaggtctgtccgagcggcgcgatgcataagcgcgaagacggttttgtggtggtcaacgaagaggtatgcattggctgccgctactgccatatggcctgcccgtacggcgccccgcagtacaacgccgacaaaggccatatgaccaagt

SEQ ID NO: 79 - DNA, 53463 bp, Unknown
  source: /note="Description of Unknown: KP2-Mcoc1 Bacteria Sequence"
  modified_base (1901)..(1901): a, c, t, g, unknown or other
gctttattgtaggtgggccagttggtgattttgaacttttgctttgccacggaacggtctgcgttgtcgggaagatacgtgatctgatccttcaactcagcaaaagttcgatttattcaacaaagcctttttttatatacgatctgacgaattcagcagaaggaaactcatcattcgtgacgaaataaaaattagtttccccattaatatagaaatgagtgtttactcacagaaagaaaatcaggagtaattattctgaagacagataatacagaagtcgtacagcgcatttaactcacttctcaggaggttaatcactctctatttgtggacaaccgacatgtcttaaggctctggaataacgtgttgatatttcgatgcgtagcatgcagcggaatattaccggatcaataaagcaggaagaggcgttttaattctttccgcaggatgatagtagggtgactgccatgtctgattataatgaaaaaagtgcgatctccgcacttctcgcaggtcattgttccgatccattttccgtgcttggcatgcactcaaccgatgcgggtctggaagtgcgcgcattattacccgatgccaccgatgtatgggtgattgaaccgaaaaccgggcgcaaagtcggtaaactcgaatgcctcgacacacgcgggttctttagcggcgttctgccgcgccggaaaaatccttttcgttaccagctggccgtcacctggcacggtcagcaaaacctgattgacgacccctatcgctttggcccgctgctgcaggagcttgatgcctggctgctcgctgaagggactcatctgcggccctacgagacgctgggagcccatgccgacaccatggacggcgtcaccgggacgcgtttttccgtctgggcgccgaacgcccgtcgtgtgtcggtggtcggacagttcaactactgggacggccgccgccacccgatgcgtctgcgcaaagagtccggcatctgggagctgtttgtccccggcgcgcataacggccagctgtataagttcgagctgattgacgcccacggccacctgcgggtgaaatccgacccgtatgcctttgaggcacagatgcgcccggaaagcgcgtcgcttatctgcggcatgccggaaaaggtcgaacagccacagtcccgtcagcaggccaaccagtttgatgcaccgatttcgatttatgaagtgcaccttggctcgtggcgccgccacgccgataaccatttctggctcagctaccgcgagctggcggaccagctggtgccttacgcgaagtggatgggcttcacccatctggagctgctgccggtaaacgaacatccgttcgacggcagctggggctatcagcccaccgggctgtacgcgccgacccgccgttttggtacccgtgaagacttccgctacttcctgaatgctgcccatgccgcgggtctgaacgtgatcctcgactgggtgccgggccacttcccgtcggatgactttgcgctggcatcgttcgacggcaccgcgttgtatgaacacagcgacccgcgagaaggttatcaccaggactggaatacgctgatctacaactacggtcgccgtgaagtcagcaactttctggtcgggaacgcgctgtactggattgaacgcttcgggatcgacgccctgcgcgtggatgcggttgcgtcaatgatctaccgcgactacagccgcaaagagggggagtgggtgcccaatgagtacggcggccgggaaaacctcgaagcgattgaatttctgcgcaataccaaccgtgtgctcggtgagcagacgccgggagcggtcacgatggcggaggagtccaccgacttcgccggggttacacgaccgtcttcgacgggcggtcttggcttctgnttcaaatggaacctcggctggatgcatgacaccctcgactatatgcagctcgatcccatctatcgtcgttatcatcacgacaagatgaccttcgggatgctctacaactacaccgaaaacttcgtgttgccgctgtcacacgatgaagtggttcacggcaaaaaatcgattcttgaccggatgcctggcgatgcctggcagaagttcgccaacctgcgcgcctactacggctggctgtttgccttccccggtaaaaagctgctgtttatgggcaacgagtttgcccaggggcgggagtggaaccacgacgccagcctcgactggcatctgctggaagggggcgacaactggcatcacggggtgcagcgtctggtgcgcgatctgaaccatacctatcgccaccataaggcactgcacgaactggattttgacccctacggctttgaatggcttgttgtggatgaccatgaacggtcggtgtttatctttgtccgtcgcgataaagccgggaacgagataatcgtggcgagcaacttcacgccagtaccgcgtcacggctatcgcttcgggattaaccagccggggcgctggcgtgaagagctgaacaccgactcgatgcactaccacgggagcaacaccggcaacggcggctgcgtggcaagcgaggcgatcgccagccacggtcgggagcattcgctgtcggtgactctgccgccgctggcgacaatctggctggtacgggaatctgcagggcaataaaacgcgcagctgatttattgcagctgacttattaccggaggtgatcacttctgaattattttgcagaagagtgaggctttttcttcattattttcttttatggcttttatttaatagcaggacattattatgagtaaacttgaatatactgacaacttaatgctgtcgcgccagttaccgcttaaatccgtggccctgatcctcgccggcggacgtggcacacgattaaaagacctgaccactattcgcgcaaaacctgcggtgcatttcggcggtaaattcagaattattgattttgctttatcgaattgtattaactccggaataagacgtatcggggtcattacacaatatcagtcccattcactggtgcagcatattcaacgcggctgggcattctttaacgaagaaatgaatgagttcgtggatttattaccggcgcagcagcgggtgcatggtgagaactggtatcgggggacggcggatgccgtgacccagaatctggatattatccgccgctatgatgcggaatatgtcgttattctggccggggaccatatctataaacaagattattcgcggatgctgctcgatcacgttgaaaaaggggcgcgctgtaccgtggcctgcctgccggtcccggttgaagaggcaagcgcttttggcgtcatggccgtggatgagaatgacaaaatcattgaatttgttgaaaaaccggctaatccgcccaccattcctggcgatgaaacccgctcgcttgccagtatgggcatttatgtgtttgatgcggaatatctctaccagctgctggaagacgacgatcgggatgaacactccacccatgattttggcaaagatattattcccaggataacggcggcaggtgaagcgtatgcgcatccgttcccgcgctcctgcgttcagtcggataataatgccgagccatactggcgcgatgtcggaaccctggaggcgtactggaaagcgaatctggatttagcctcagtagtgccagagctggacgtttatgaccgtaactggcctatccgtacctatgtcgaatcgctgcccagcgccaaatttgttcaggaccgttccggcagtcatggcatgaccatgaattctctggtctccggcggctgtattatttctggctcggtggtggtgcagtcggttctattttccagagttcggattaactcgttctgtaatattgattcgtcggttttattaccgggcgtctgggtcggtcgctcctgcaggataagacgctgcgtgatcgaccggggatgcgttattccggaggggacggtgattggcgaaaatgccgttgaggatgcgcgacgcttttatcgttcggaagaaggcatcgttctggttaccaaagaaatgctggacaaacttgaggtatgagcccatttgcggaaaaagcgtgtccggcggcagagaaaatattgccctgtcgcgggtcgtctctgtggctgaataataaggagcatacatgcaagttttacatgtaggagcagagatgttcccgctgttaaaaacgggcggactggccgacgtcaccggcgcgctcccggcggcgcaaattgccgaggggctggatacccgcgtgctgctgcctgggtttccggcgatccgcaacggggttcaggatccgcaggtggtggccagcagggagacattcgccgggcggatgacgctgctgtttggccattttaacggtgtgggcatctatctgattgatgccccgcatctctatgaccggacgggtaatccttatcataaccagcagatgcaggattatcctgataacgtcctgcgtttcgcgttgctgagctgggtcggggccgagcttgccggtggtcttgacccgttctggcgtcctgaaatcgtccacgcccatgactggcacgcgggtctcaccccggcttatctggccacccgcggcaacccggccaaatcggtgtttacggtgcacaacattgcctatcaggggttgtttcaggcccggcatatggcggagatcgcgttaccgtggtcgttcttccagatgcacggggtggagtttaatgggcaaatctccttccttaaggcgggtctctatttcgctgaccatatcaccaccgtcagcccgacatatgcccgtgaaattaccgaaccacagtacgcgtttggtctggaagagctgctgcggcaacgtcagcgggaagggcgactgtcggggatcctgaacggggttgacaaaaatatctgggatccgcgccgcgatccgctgctggcagcgccttacgaccagaattcactggcggagaaagcgaagaacaagcagcagctgcagacgtcgctggggctgaaggcggacgatcgggcgctgctgttcaccgttgtgagccggctgaccagccagaaggggctggatcttctgtttggcgcgctgccgggaattatatctaagggagggcagctggcgctgctgggatccggggacccggatttgcaggcccgttttctgaccgccgaggcgcaataccccgggcaggtgagtatccggatcggctacgacgaggcgctgtcgcatcagatgattggcggcgccgacgtcatcctggtgcccagccgttttgaaccctgcggtctgacccagctttatggtctgcgctacggcacattaccgctggttcgccgtaccggcggactggcggataccgtcgccgactgttcgctcgaaaaccttgttgacgggctcgcgaccggatttgtgtttaccgacagcgagacggaatcgttattacatgctatccaccgggccagtgtcctgtggtcgcgtccctcgctgtggcgttacgtgcagcggcaggcgatgagcatggattttagctggcaaagtgccgcaaagtctttccacctgttgtatcagcgtattatttaattgctacggataagaaaaatggaaccacgcataagttatatttcacccaggctgaatgaagaagcgctgcagcatgctatcgcttataacctcatgtttattctcggtaaagacccttcacttgccaataagcatgaatggctcaatgctacgctgttcgccgtgcgcgatcggctggttgagcgctggttgcgggcgcatcgggcgcggatctcgcagcaggcgcgccaggtatattatctgtcgatggagtttctcatcggccgtaccctctcgaatgccttactgtcgctgggcatctatgaggatgtgaaaacagcgctggccgggatgggtctggatctggaagagctgattgacgaagagaatgacccgggcctgggcaacggcggtctcggtcgtctggcagcctgttttctcgactccctggccacgctggggctgccaggacgcggttacggcatccgctacgactacggcatgttcaagcaaaacatcatcgacggccggcagatggagtcaccggactactggctggagtacggtaacccctgggaattcgagcgccataaaacccgctataccgtgcgctttggcgggcgcattcagcatgaggggaaaaactcgcgctggctggaaaccgaagagatcatcgcggtggcctacgatcagattatcccgggttatgaaaccgatgccaccaacaccctgcgcttgtggagcgcccaggccagcagcgagattaacctcggtaaatttaatcagggagattacttcgcggcggtagaagataaaaaccattccgaaaacgtctcccgggtactgtatccggacgactcgacctactccgggcgcgagctgcgcctgcgtcaggaatatttcctcgtttcggcgacggtgcaggatattctttttcgccattaccagttgtatcaaacctatgacaacctggcagataaaattgctatccacctcaacgacacccatccggtgctgtcgatcccggagctgatgcgtctgctgattgacgaacaccgcttcagctgggatgacgctttcggggtgacctgtcaggtcttctcctacaccaaccataccctgatgagcgaggcgctggagacctggccggtcgagatgctggggaaaatcctgccgcgccatttgcagattattttcgagattaatgactattttctgaaaaccatgcaggagcactatcccgatgatattgcgttgctgagccggacctcgattatcgatgaatccaacgaccgtcgcgtacggatggcctggctggcggtggtggtcagttacaaggtgaacggcgtgtcggaactgcactcccggctgatggtggagtcgctgtttgccgatttcgccagaatctttccgcgccgcttcaccaacgtgactaacggcgtcacgccgcgccgctggctggctgccgctaacccgtcccttgccgcggttctggaccgccatatcggccagacctggcgaacggatttaagccagctgagcgaaatgggggaatatcaggattatccgctggttaaccaggccgtcagcgccgccaaactggcgaataaacagcgtctggccgattatatcgcccgtcagctgggcgtggtggtgaacccgaacgcgctgtttgatgtgcaaattaaacggatccacgaatataaacgccagctgatgaatgtgctgcatgtgatcacccgctacaaccgtatcaaggcggacccgcaggccgaatgggtgccgcgagtggtgattttcgccggcaaagccgcgtccgcttaccacacggcaaaacagatcatccatctgataaacgacgtcgccaaagtcatcaacagcgatccgcagattggcgacagactaaaggtggtgttcattcccaactacagcgtcagtctggcgcagatgatcattccggccgcggacctttctgagcagatttcgctggcagggactgaagcctccgggaccagtaatatgaagttcgccctcaacggtgcgctgaccattggcacgctggacggcgccaacgttgagatgttggagcacgtgggtgaggacaatatctttatcttcggtaataccgctgcagaggtcgaggcgctgcgcagcaacggttatcagccgcgtgattactacgaccaggatcaagagctgcgccaggcgctgacccagatggggaccggggtgttcagcccacaggagccgggccgctatcgcggtctgctggattcgctgatcaactttggcgaccactatcaggtgctggccgattaccgcagctatgttgactgtcaggacaaggtggatgcgctctaccgaaccccggaagagtggaccgccaaagcgatgctcaacataacccacatgggctatttttcatcggaccgtacggtgcgggagtatgcgcaaaagatctggtatatcgacaaaacgcaactctgagcgcgtactgacaaccaggaaacgccggggcgggtggcaggagaccggccccgtcgatgagcgacccggcagcaacacataaataagcctgacggatatgacaggagagaaaaatgacggacagtaaacgcgcaggggagcctgcacaacagagtgatttgattaacgtcgctcagctgaccgcgcagtactacgtactgaggccggaagcgggcaacgcggagcatgcggtgaagtttggtacctctggccatcgtggcagtgcagggcgccataacttcaatgagcagcatattctggcgatcgcgcaggcgattgcggaagaccgcgccaggaacgggattaccggtccctgctacgtgggtaaagatacccacgcgctctccgaaccggcctttatttccgtactggaagtgctggcggccaacggcgttgatgttatcgtgcaggaacacaacggtttcaccccgacgccggccatttccaatgccatcctggtgcacaacaaaaaaggtggtccgctggcagacggcatcgtgatcacgccgtctcataacccgccggaagatggcggtattaagtacaacccgccgaacggcggcccggcggataccaacgtcaccaaagtggtagagaatcgcgctaacgaactgctggcctcgggtctgcagggcgtcaggcgcatctccctcgatgcggcactggcatccggtcatgttaaaaagcaggatctggtacagccgtttatcgaagggctggcggatatcgtcgacatggcggcaattcagaaagccggcctcaagctcgggatcgatccgctgggcgggtccggtatcgaatactggaaacgtattgccgggcactacaagctcgacctgactatcgtcaacgatcacgtcgatcaaaccttccgctttatgcatctggataaagacggcgccattcgcatggactgctcatctgagtgcgcaatggcgggcctgctggcgctgcgcgataagtttgacctggcttttgctaacgatccagattatgaccgtcacggcatcgtcacgccggcagggctgatgaacccgaaccactatctggcggtggcgattaactacctgttccagcatcgcccgcagtggggccaggatgtggcggtgggcaagacgctggtctcttccgcgatgatcgaccgtgtggtgaacgacctcggccgcaggctggttgaagtgccggtgggctttaaatggtttgttgacggcctgttcgacggcagcttcggcttcggcggagaagagagcgcgggcgcctcgttcctgcgttttgacggaacgccgtggtcgaccgacaaagacgggatcatcatgtgcctgctggcggcggaaatcaccgccgtcaccggtaaaaacccgcaggagcactacgacgaactggccgcccgcttcggcgcgccgagctataaccggctgcaggcttcggccacttccgcacagaaagcggtgctgtcgaagctgtcgccggaaatggtcagggccagtcagctggcgggtgacccgatcactgcgcgtctgaccgccgcgccgggcaacggcgcatcgattggtggcctgaaagtgatgaccgacaacggctggttcgccgcccgaccgtcaggtacggaagacgcttacaagatctactgcgagagcttcctcggggaagcacatcgcaagcagatcgagaaagaagcggtggaaatcgtgaatagcgtgctagcggcgcaccagtagagcagttgacgtactccgctgagccggagtacgtcatagttacccggcgacaccaatacaggcaccactttgtcagaacataaggaacgggacgcttcgcaaaaggtattgctgcggggactatatgaatatctatgttattaccaataataatttcatgcttgtaggtctgaaatgtatgttcagcgacaacagcctctccgtcaacagggttgtgttttcacgggtcagcgatattgccttcagcaacagcgatgtggtgattgtggagtcagagctgaacaccggcgatgccgaacgtctcaagtacctacacatttcaccggtcaatcttatctttttattaaaaccggcgtcaggaatgagcgggacagggcgtgaagcggtatgcattgacactgaattaagcggtaatgaatatctcatgatgaggcaggcgtttaaaaaaatggggatcaatctgaagagggacaagttgtcatttaccaaaagagaaacacatgttatcaatatgattttaaatggttattcgatagatgaaatttcccgtagcctgctgatctccaaaaaaacggttcagtcttttgtcggtattgttttgcataaactgaataccaccaaaataagtggaatataccgcaaaaaaaatctcatcatcgacagttttgccaggaggagcctgcatcgttaggatgccctataaactaatgatctgcttatggaaagtcactatttcatatattaagtttcaactaaatttgttataaattattttatgttgttatgttgaacggggtttgattattggtatgcttcagaaaaaataaacatacatcatgggtgctaacatgatgaaaatatatgaaaccatagtcatcaaatgatttaagcatacaataaataatataggattatatcctctatctgtgaatggtgggcggcagaggaaaaacgggatatatatttatgcatttcatctttttattataaaaaactgttatgtaaattctgtagcgggagggggtatgtttagtgaagacgcacactatgaatttctaaaaagatattacagagcggagttttttgaaggaagaaatggttccatttggggaataaattattcttacaatttggcaagggtgggtatgaatatgcttgaaagatatggctatgggataatattaaagcatgaatctatcactggtgaaaccatttactatgatcgtagtctgacgatactatttggtgacagaattacacaggccctgggaggtcagtattgcaacagagaaatgagagaataatgatttaatatattttttaatcgctcgttaaacattggaacttttctcagaacgtgactgcaatgtcttcaacgcatctaacatgtcgtcgccgttcagtgagcgctgcgattatttctctgttggttttctgcgccgccgcaaagagccatcaccggcagggatcgcctgtgaacggttgttatcgcgtttatcctgaacatcaatctaaattgaaatgtccgcatgtaggttatgtttcagcctttgccgaagatgtctttactccgggtctgaagttgctgcagggcttccagcatgtcgttatggtccagacttcgttgtgatttcttgccgggttgtttctttctgcgtgaggtctggccgtccagtgatggcagggcctgtgagcgggtgttgtcccgtttgtcctgaaccagctttatcatttccagggcacgtcccagacgcttgttgtcgatgatggcgccctggtccagttctcccagtcggtcgtaagtggtaaagggcagggaagtgccgctggcccggagctcaatgtcaccatccgggtattgccatacctcgatgtacttcccctgaaaacgccggttttcttcattatcttcaagcagataaagctttttatcatactgtaatgtcaggtttttcgagaccttacgctgctcgcgccaggtgaatgtcgcctgcaggttttcgccattatccagctggcgatgtacgtcaaaatcgtgacgtggcggctttgcaaaccgacggttgtaatcttccatgaactcatcagcaaaggcgtttgcagcctcaggtgtgctgataccgcggagccgcagttccttgaccaggcggtcctgtaatgtcagatgagcccgttcaacacgccccttggctgaactggtgttggcacagataccagtgatattcagctcgttcatggcacgaccaaactgagtctggccatctccgccggtggcctgcttgttgttgatcctgaagacgctggctttgtcgctgtagaatgccagaggcttaccgtagcgctccagatatccccgggtggcttcaaaataggtgaacgtggactccgaactgacgaacagaagctgcatcaaccgacttgttgcatcatcaacgtaaacgagcagcgtgcaggccggaccacggtcctcgaaccagcgatgttcactgccatcaatctggatgagttcgccggtgcaggcccgacgtgggcgtggctgatgcacacgaggtggccgtaacttacgagggatccataaaccatcccgggtcataagcttacgtacagtctctttagcaagataaaggtcatgaatctcagcaagcttctcgcaggccaatgtcgggccaaagtcggcgtaacgttcgcgaatgatgcgcagcgcacgctcagcgaggccaggcatcaactgtcggttactaggctgaccacgtcggcggttaacccgcgatagcggtccgtgttcacgatagcgctcgagtagccggcggcagtgcctgtcagagatctcaagtcgggttgctgcaagacgcgtggtaagacgccggtcgataacgtcctgcaggatcctgagtcggtttacatcgttcatcgagaaaaactccgttccgtatgccgtcatgagtctcatcctttgaaagcagcgatcgcggtggcgagactgtagcgcggacatgtctatttggtcagagacggacatctcaatttagctgttacactgtatgtctagccaatgttgaaatgtcgtgctgaaaacaaagctgacctgacgtcagtggagagtctggacaatgcctttttaaggttgagtcaggctttggaggaagaacgtggttgccaggttttctcggctatcatcagtttacgtacggtctcttttgaaatccggacaccgtattctgtggtcagaattcgccagatggctgacggattcataccccggccgcgtgagcgaataagctgcagtgcctgatctctgatggtggtgtttaactgatgattgccgggctttccacggcgccggctgaccagaccggctggccccagctcgcgatagcgcttaatcaggcgggagcactgacgacgggtgagctccatggactctgccacttctgccagcgtgatttcccgcgccatataggcttcaatcaaatccaggcgtagcgcttcgtgaagtgtcaggagcactggtttgttgtcgtccatttttctctcatctgtcggccatatcagatccacaggtgagggaagggctcatcgcttcaggctggggataaaatcctgcggactggccagcaccgggttgatcgccctgagctcttccagtgcacgctcctgagcgcgcctgcggggcatttttgtactgcgcattcgctttccttcagcctccagctcgtcctgtttctgctgtgccagcctcagaacggcacccagtcgtttgttatcaacaaccgccccctgatcaacgcaggtcagtttatcgaaaatcttataacccagtggccggtgctgatgccggaaagtaatgcttccgtcagggtaatcataaacggtaattttttcacctgctatgcgcgtattttgttcggtgggttcaatgatatacatgactttatcatactgaaaagtcagtgctttcgataaggtccgtagctcctgccaggcgaagatatcattcagctccagtggactctgtgtgaccgcacggtgcagatctttagggtattttgccggccgggagaaacgacggttaaaatcagacatgaaatgttcaatccactgattggcttcagcaaccgagctgatgttctgcaggcgcatctctttaatcagtcgatcctggagcgttttatttacccgttccacgcgaccttttgcctggctgctgttggcacaaatcaattcgatcgccagttcccggagagcccgtccgaactgggttgtgccggtacgtcggctctcgggtccgctgaccctgaacaccgcatgcttgtcgctgtaaaatgcgacaggtttaccatgtttatcaatgtattgccgggtagccatcatgtagtcaaacgcgttttctgaatcacagaatcgcaggtgcatcaggcgacctgtggcgtcatccatgaagaccagaagacagcattttggggctcttccttcgaaccagtcatggtgagagccatcgatctgaaccagttcgccgaaacagtcgcgacgatagcgcggctggtaaacccgggttcgccggcgggaatgaggacgccagagaccgtcggctgtcatccagttacggatggtttcaacggagagatatatatgatggcgttcagccagtttttcggttgcgagcgttgggccaaaatctgaatagtggcaccggatcaaatccagggctttacagcgtgtttcttcatcgatccggttgtttgcaggacgtccacggcgggaagatgcaaatgcggttgcgccatctgtccggtacagacgcacaagacgctgcacctgacgaacactgagcttaagtatgtctgctgcgtcgcgctgaagcaaagcccggtcaaatactcgctgaatgatgccaagccggtaaagttctttgtctgtcatagtcaccaacataagatcgcggtcctgtgctgagcaaaatgaaggcttagcgtacacgacgcgtgtgaattgtgctgagacgacaataacgctttgtgctgacaatacaggtgcgcataacaaagattatgttaaatattaaaataaataacataaaaatcaatatgttaagacggtaaccagctactttcccattccagcaaccagtcatggaagctttagaaacagagtcctctcatgagtttgtgatgccttaaatccatggtgagcatagaaacctttggcttcttcagtaagcgcatgaaccattatcgcacgaaccccaatgttctcagctacgcgataacaccgtagaactgcatcgtggagtaaatcggcgccaaccccttttccgtgcaatgagacatctaccgccaggcgagcgagtataatcaccggtataggatctggcatgttacgccgaagactacctgtcgcttccgtatggttaacgctaccggtggccaaagagtaaaaaccagctacttgcttcgtacccgtcttgcaaacaacgaacgttcgggcagcgccaagagcttgattttttaaacctctctgttttagccattcatcgaggactgtctctccactgacgaactcagccagctgatgagagctggataacggctcgggcgtggttatacgtcccactgaggtttccttgccagtagtttattaatggcgggctcatcctcgactggtgcatcgagcatatcgatgaactctgcatactgttcgtcgttaaaattgaaaacacggcgatcaaggatcacattctccgcagccttgcaggccatctccaggataaagtcggttcgcgatttatgaaggatctctgcagcagcatcgatgagtgctctctgagactctttagctcttaggttgagttgaacatctgatttcatacacacctctcttgtatagcaattgatatacaagaataacacaacacgaacgtatagcaaatgctatacacttcaaagtaccgataatgcgttttatgttaaatatcatacatttaatgaaagatgatggctgatcttctgcaatagtcagctcattatcgctgcaggcgtggcttcattctggatagatggagtcttttctggcattaatgccctgaagacgaacacggtcgttatcaggcaaatggatacccatcatgcgaagaataaagccgcgccacccccggttaacctgaccgttatagtcatacaggtctgcattttcttttttaagctttgaccattcatgcatgagtgttagtgcatcgagctcggtgatgtgcttcacttcatcgccgatacgtactgtgttaatgcctcttcccgtcatgatgatcccctccggcaatatcagtttcagattaacgctgttatgatgatgatttaactacacactaaaggcaatctaacgtttaatcatacctctgataataaagaacatcatggttaatgaaaacacaatcagaagccagccaaagggtttggcatcaaaaacagtagtgatgcaatcattagtacaggtaaccaacttcggggtgacaatagaaattccccacccaaaaataactaccatagtgcctgctactgcggctaagaaaaaagtggtgaagaatgcgcatccgactacaagtaacaatccaatcagttcaaatatcatattcatgattgcgctccaggtgagataactgcgaacagactgatgctggctgttttatttaacatatttccagacgcctgcaggaattttatcataaaacttccccattgccatttccgccagccggtgatccactgcggcattaaagtgctcaagttcgtcatccgtcagggaatatttatttttttctattatcctttccagagtttccttagatgtacagcggcgtagtcttaaaatccattcctgtttcgtcattggttttttatatcctgaggtgtcccggtaatttcattttggaagaagatttcctttcagccggttatgagtgaaccattttgcatatatgatgtaacctacaaaagttaagagtgcggacagactatatatccctagaacaggtaccacgtgatgaaaacgtatcatctgaccggattcatctgccagactcattaatacattgctgtatatttcagtctgaaaaaactcgtagtaaggtaccatcactacatgaagaaaaaataaattaagcagatacgtcagagaaaacgcgtgttcctgcccgttatagggcgcatactgcgcaaaggcgaaaatccagcctgtgaaaagcagaaaacacatcgtgaaatacaccaccacccatatcgctgttttcatcactgcccctcagttatataatttttctgtaacgcaaatttcttcaggcgttatggcccgtgccgttctgcttcagataatcactgatgctcaggccggacaagcgaattttatccgaaatctccctgaactgctcctcccagccgtcctgcagctccctgattgccgcgatctggaaagcaacactgaaaggcgttctgcccagtttctcggaaagccagaaaagatgcgtaccgatctcttcatccgggaccggttcaagcgcatcactcagtaaggttttttcgtcttcctgccagggatgaccggctcgcggaaaacgcggatcaggctggcggtcttttttctcccttttttcccgtctggcaacggtcggcgcttcgccttttttcatgctgacgcgtgctttcatggcgccgatggccgccacggcccgcaccagggtttcacgctcctggcgcgtgagcaggctgtcctcacaaatcagggtgttcaggttatcgatcagcgtattcagtccgggttcagtgactttcattttatgctcctgttccttgtgtggtggcgatcagtcccggctctcattcacctgaacgatgaccggcaggcctgcatcaaaacaggcctgataccagctggccacctgcaggggatcgccctcttttatccggcgtatgccgccggcatccgtcagctgcaggcaggtggtaccgtccagacggatcacgtaggccgcttccctgatggtgtaatggccgtcacccagctgcagctccaccgcgtcaccggcagccgtctggcgtaacggcagacgccggacgtcggtcagtcgttgtcgtgccgtttcagcctcgcgttctgcctggaagagcggttctgcaatgccgcgaccggcctccgtcagctcgacggccagctgcaggttcggcgcgcgcagggtgcgcagccagcccgcggcttccatgcgccggcaggaggcgcgcaggttcggtccgtacaccggggcgtccccgccctgctccagcacccgctcgatatcccgcgtcgccaccggccccggacgtttcgcatcgagggcggccagcacaatcagtacccgtcgctgcagcggcgacggcctgcgggaggttgttactgctgccatgaacgttgttctgctgtgggagcgcgcaggagcattccggtgaggcgcagatggtccctgtcggcgacgtcttccggggcacggcccgccatcgccaggtggtaccagagttcgatcgcgctgcgtgcccgggcaatctccgcatcggcatcattgcagtccgcacggtttgcccgttcaagacacgcgttaataaaatcttccgtgtcgccaagcatggtttcataactcaggtgaaagaatactttctcatccatcctgcacgctccgtctgattatgtgattaaagaagataaatcatattatatatgatttgttattcatcatttaaacatcatatcagatattattatgcggttaatgataaatatcatatcaagtatgattttgtgagtgtgacttaattatcatatcacttaccggtttcccgccgcgcagatccgatttctggctaagtcggatctctgtaacacacatgtattttccccggaaagtaatggacgtataccagcgtgacagcgtcatctgacactttcacacattcgattttccgaatatatggttgttttttttgtcttcgggcgtatgctttacgcaaccgaacaggaggaataatgccccttacagcccttaagcttttcaaaaacctgtccgatgaaacccgtctgggtattgtcctgctgctcagggagctgggagaactgtgcgtctgcgatttctgcacggcgctggatgagtcccagcccaagatctcccgtcatctggcaatgctccgggaaagcggtctattgctggatcgcaagcaggggaaatgggttcattatcgcttatccccgcatattccttcctgggctgctcaggtgattgagcaggcctggttaagccaacaggacgacgtacaggccatcgcccgtaagctggcatcggcaaactgctctggtagcggtaaggctgtttgcatctaaaaaatttgcctgaacatatgtgttttttcgaatgtatgaggtattcagaatgaagacgttaacggtgtttgacccggcaatgtgctgcagtaccggtgtatgtggttcagatgtcgatcaggttctggttgatttttctgctgatatgcagtggctgaaaggacgtggcgtacaggttgaacgttacaacctggcgcagcagcccatgagctttgttcacaatgagaaagcgaaagccttcctcgatgcatccggcgcagaagggcttccgctgctgttgctggacggcgaaacggtgatggctgggcgatacccaaaacgcgctgagctggctcgctggttcggtattccgctggagaaggtagggttagctcccaccagttgctgtggtggtaatacttcctgttgctgaatatgtcaggaggacatatgaaattattacagaatatcccgccttacctgttttttactggcaagggtggtgtaggaaaaacttccatttcctgcgcgacggctatccaccttgccgaacagggtaagcgggttttgctggtcagtaccgacccggcctccaatgtcggtcaggtattcgatctggctatcggtaacacgattcgccctgtgacagcagttcctgggctttctgctctggagattgacccgcaggaagccgcccggcaatatcgggccagaatcgttgatcctatcaaaggtcttctgcctgatgacgttgttaacagtatcagcgagcagctttcaggagcctgcaccactgagattgcggcgtttgatgagttcaccggcttattgacagacgcttccctgctgacccgtttcgatcacatcatttttgataccgcgccgacgggccacacgattcgccttctccagcttcctggtgcctggagtagctttattgaaagcaatccagatggtgcctcctgtcttggcccgatggccgggctggaaaagcagcgtgagcagtatgctcatgcggtagaggcgttatccgaccctgaacgtacccgcttggttctggttgcacgactgcaaaattctacgctgcaggaagtcgcccgcactcatgaggaactggctgagattggcctgaaaaatcaatatctggtgattaatggtgtgctgcctgaagccgaagctgaacatgacgccctggccgcggcgatatggcaacgtgagcaggaggcactggcaaatcttcctgccggtttatctgagctaccgacagataccctgttactccagccagtcaatatggttggtgtttcagcattgaagggactgctggctacccgttctgaggcattaccgctcccggtaacgaacatcctgtacacgcctgaaaacttatcactctctggcctggtcgatgatatcgctcgcagtgaacacggcctgattatgctgatgggcaaaggtggtgtagggaaaaccacgatggctgccgccatcgccgtcaggctggccgacatgggatttgacgtgcatctcacgacctctgatcctgctgcgcacctgagtacaacgctgaacggcagcctcaaaaacctgcaggtcagccgcatcaaccctcacgatgaaaccgaacgctatcgccagcatgttcttgagacgaagggaagagatctggacgaagcagggaaacggttactggaagaggatttacgctctccctgtactgaagaaattgccgtgtttcaggccttctcccgtgtgattcgtgaagcgggtaagcgctttgttgtcatggataccgcccctaccggacacacgctgctgttgctggatgcgaccggggcttatcaccgagagattgccaaaaaaatggggagtaaaggtcattttactacccccatgatgcagcttcaggacccggatagaaccaaagttctgctggttacgcttcctgaaaccacaccggtgctggaagcggcaaacctgcaggctgaccttgaaagagcggggattcatccgtggggctggattatcaataacagcctttccattgcggatacgcgttctccgttgctttgtcagcgtgctcaacaggaactgcctcagattgaggctgttaagaatcagcatgctgaccgtatagcgcttgttccggtgctggcgtcagagcccgccggtattgaaaagctcagagagttgatgagttaattttttgacatctacagggcgacaaagtcgccctgtcaggaggttttatgttactggcaggcgctatttttgtcctgaccattgttttggttatctggcaaccaaagggattagggatcggctggagtgcaatgctgggcgcgggactggctctgatatctggcgttgtgcatgtgggcgatattccggtggtgtggaatatcgtctggaacgcgacggcgacctttattgccgtgattattatcagcctgctgcttgatgagtccggctttttcgaatgggcggcattgcatgtttcgcgctggggtaacggtcgtggccgtttgctctttacgtatatcgttctgcttggtgcagcggtggcggcactgtttgccaacgatggtgcggcacttattctgacgccgatagtcatcgccatgctgctggcattagggttcagcaaaggcacgacactggcattcgtcatggctgccgggtttattgccgatacagccagcctgccgcttatcgtgtccaacctggttaacatcgtttctgcagacttctttggactgggcttcaccgagtatgcgtcggtaatggtgccggtggatattgcagccattgttgccacgttggttatgctgcatttgttcttccgcaaggatatcccaccgacttacgacctggctcttctgaaagcaccggcaaaagcgattaaagatctggcaaccttcagaaccggctggatagttttaatacttctgctggttgggttctttgtccttgagccgcttggtattcccgttagcgcgattgcggctgttggagctgtgatcctgtttgcagtagctaaacgaggccatgccattaaaactggcaaagtgctgcgcggtgcgccatggcagatcgtcatcttctcattggggatgtacctggtggtctacggtctgcgcaacgccgggctaaccgaatacctttcaggtgtgctgaatgtacttgcggataaaggactctgggctgcaacgctgggtactggcttcctgacggctttcctgtcttccatcatgaacaacatgcctaccgtgctggttggcgctctttctatcgatggaagcaccgcaacaggcgttatcaaagaagcgatgatctacgccaacgtgattggctgcgatctgggacctaaaattacacctattggtagcctggcaacgctgctctggctgcatgtcctttcacagaagaatatgaccatcacctggggatactatttccgcaccgggatcgtcatgactctgcctgtgctgtttgtaacgctggcagcgctggcgctacgtctctctttcactttgtaatgagatactgatatgagcaacatcaccatttatcacaacccggcctgcggcacgtcgcgtaatacgctggagatgatccgcaacagtggtaatgaaccgaccgttattcattaccttgaaaatccaccgtcacgcgatgagctggtcaaactcattgcagatatgggcatttcagtccgggctttgctgcgcaaaaacgtcgagccttatgaagaactggggcttgaggaagataagtttactgacgatcagttaatcgattttatgcttcagcatccgatcctgattaaccgtccgattgtggtgacaccgttgggaacgcgtctgtgccgcccttccgaagtggtactggatattcttccggatgcgcaaaaaggcgcatttgctaaggaagacggcgagaaagtagtagatgaggcagggaaacggctgaaataaccgaaagggggcgatgccccctttctcctgcctcagcgtccgggtaccggactgtccggcagcgtacagctcccttttcccagctgacgctgcagcaacaccgtgtccagccagcggccatgcttgaaaccgatgtccttcagcgtgccgatttcagtaaatccggcgcgaagatgcagcgctacagacgcgacgttcgcactgtcccccacaaccgctatcatctggcggtatccctgagaccgggcccatgttaaggcatgatcgagtaaggcttttccgcccccctgccgctgataagccggatcgatgtacaccgaattttcaaccgtaaaccggtaggcatggcgttcgcggtagcgggagagataacagtagccgatgaccgtctccccctgcagggcgatataccagggaaatccacgtgactgaacatttttcacccgggcaagcatttcctgcgtgtccgggggttccgtctcgaagctgcctgtgccgtgcaggacatgatgggcgtaaatgcgccgtatggcgggaatgtgctgctcttcagcattgataatgtgcattgtatgactcctgtgacgttgactgacacactaccggaattcgcgacggcagattaagcgcttcatcttatgacctgtataaggaaatgttttaagtggaggtagggcgtcgccccacctgtcagcccgccatttcagccagcaggtccacgcctaccgggtcgtccttcagcagtggcgtcagggcaatgcgctgtgcataatgcccggcaacgtcgtcgatcagcggcagttcgcgacgggcacgggtgaccaggaacggggaggacggcttcgcggccgcgaggctgttattgatgacccacgcccagggttcaatcccggcccggcgtaagtcctgctgcagcccggccgcttccagtaccggcgtggtttcggcaagcgtcacgataatgactctggtcttctccggatcctgcagctgcatcattggcgttatcacgtgatcgtgagcctgccccatctggcgcaccatttcccggtgataggccccggttgcatccagcaacagcagcgtatgcccggtgggcgcagtgtctataatgacaaaatggtcgttggcctctttgatgatccgggagaatgcctgaaacacggcaatctcttcggtgcagggggaacggagatcttcctccagtaccgccagtccctcttcatccagaccttttccctgattttccagcacaaagcgacgatagcgctcagtctctgcttttggatcgatacggctgacctgaaggcctggcagcgagccatccagggtgtaagacaggtggctgccggatcggaggtggtcaggtggactttatgaccgcgtctggccagcgagaccgcgaccgcagccgccaccgtggttttccccacgcccccttttcccatcgtcatgaccagcccttttcccgctcggctgaggtcctccaccagggaggcaagctccggtaaatcgaccgtcgtgagcgtggctcccggatccggcagaacaagtgtgctctctgtaaacagcgccctcagggcttccagaccaaccagattaaaaggcttcagatacagcatcgaccggggaagatgcgcgaggttttcaggcatggcccgtaaggcccgttcctcccgcgccagaatactgtgcgccagcggatcctgttcaccggcaaagggaggcagcacgccattgatggcaaggtgctgatgctgcagaccgatagccgacagctcctcgtgggtatgggagacctctttcagggtcgacgcctgtgcgcgggcaaccagaaccagtcgcgtgagtgccgtatcagagagggctttcactgcgtcagcgtactggtcctgttgtttctccagccccaccagagggccgaggttcgccgcagcatcaggatgtgcatcgaggtacccgctccaggcgcccggcagctcaagcatacggatggtgtgtccggttggtgcagtatcaaagacgatatgatcatatttttcgcgcagttcatgactggtcagcagcgcggtaaattcatcaaacgccgcgatctccgtggtacatgaaccggaaagctgttcttcaatgttgctgatgacatcggcaggcatcagttcacgaacaggatcgagcacgcgatcgcggtaagcctgcgcggccgccatcgggtcaacttccattgccgcaaggttttccacggtgcggataccagtgatccggtggcccacagtctggctgaagacctgaccgacattggaggccggatcggtactgaccagaagcgttctccggccctggtcagccagccataccgccggcgcgcaggccagagaggttttccccacgccgcctttgccggtgaagaagataaacggggggatattctgtaaaaatggcatcgtcattgttgagctcctccgggattaaggcatacggggaatgctgcagcagcgcggctgcgtgctgtcttcattccagtcctgcgtgagggaaataccggcccagcgggcgatatcttcccgggacgggagcttgcccgccatcaccagctggccgtcaagcagggtagcgggaagggactccattcctgacgtgttcaggaaggccctgatgacgggcgtattcaggaactgctgcgggttctttgccaagctgtaacgctgaatattcacaccatgctttttcgcccattcggcgctggcgttccatttgacggcttcatcgctgaccacgacgctgctggtcgcacagcagcctgcggcttcaaagatctcaatttttgacatggactgtttacctcagtgttgaatgatggggctttacactgaggtaaacgagtgaggcgggaaaaagatgcgcggttaatccatttttttatggcagcagacggaagacgcatcatccacttccacctggcagagttccgtcatcgtcttcttcagatgtttccgggcgcgaagcaggcgcgacttaaacgccgtcagcgtgatccccagctcgtcggccaggcgctgctggggacgccggttcagatcggcctcttctatcagccatctttcctcgtcaggtaaggcctgcagggtttcaggcaggcaaatctccagcgttgaaaccgcctcatggaaggcgtcaggcagcgggatctcgtcttccagcaccacgacgtctctggcggcacggtactcatccgtcagcagattcctcgccgtccggtacagccaggcccgcgggttctccatttcacagaagcggtctgcacaggcccgggcgcgcaggaagacttcctgaagcagatcggctgcctgctcccgatcgcctgtccttgatgccagaaaacgggagagctctgcttcatgctgttgccagaacacgctcatgcagttgttgaatgccgttacatcactcataccagccctcagattttgctctgattcacccgccgggaaagtgcttctgccgactctttacgttcactgtagcgatcgacgagatacgctgcatactcccgggtcagcagggtaaacttcatcagctcttccattacatccacaatacggtcgtagtacggggatggtttcatccgtccgtcttcatcaaactcctgccaggctttcgctaccgaggattgattaggtatagtaatcattcgcatccagcggccaagaatacgcatctggtttaccgcattgaaagactgggagcctccgcagacctgcatgacggccagggtttttccctgagaagggcgtactgcgccctctgatagtggtatccagtcaatctgggctttcataatgccggtcatcgcaccatgacgttcaggagagcaccataccatcccttcagaccagcgcaccatttcgcgaagttccataaccctgggatgcgtatccgctgcatcatccggcagagggagaccggaaggattaaagatgcggacatccgcacccatggcggtaagaagccgggcagcctcttcggtggccagacggctgtaggaccgctctcgaacggaaccgtacaacatcaggatccggggaggatggtcaactgtctttacacccaggcggaccccggtgagacctgtatcaaacagctcaggaacaacatttttcagttcagcaatcattttttctccggtggtgacataaaaccaggcggggcatattcgtctgcacagcactcttctgtcagaaaggcaatcaatgcagcaaggttgtcataacaggcgtggcagaacagtgttctcccctgcctttcctggcgaaccagtgagacggatatcagcgatgaaagatgatgactcagggtcgaggccggaatggcgagatgttgctgcagttcccccacgggcagtccctgacgtccggccttaacgagtgttttgtaaatatcgagacgagtggtgtggccaagttctttcagcaccatcgcggcgattttcagctccatcccattcctcgtaattttatttctatatttccagaataatagaaatatatagtgagcgcaaccacgtccataatatgactccatctccggggccttacacttacgcggcatggagaaaacatgatcggtgtttatacctctcagaaatgaggtacgtcacaatatatatggaaaaatgcatatgaatccgtcacagtagaaaccgattcccgctaaaaataaaatgaccttcatcctttgctgacgggcgcattatgtcccgccgccgggaagcccaggcaggctcgttttctgactgcctatgaatacagcaaacatacggtacagagaaatggcagagatcatcattagaaaaatgcacgaagaggactggtgtgcagtcagggaaatttatcaggaaggaattgcaacagggaacgccacctttcagaccgcagcacctgagtggctggaatggaatgaagggcatcttcaggactgccgctacgtcgccactgttgataacagagtggtgggatgggctgcgctatctcctttttcccgccggcatgcataccgcggtgtcgcagagctgagcatttatgtcagtactcattttcagggaaaaggcgcgggcagggctttgctctccgggctgataaagggctcggaaagtgcgggtttctggacgctacttgctggcatctttccggaaaaccaggccagtgttgctttacatcgcagccagggattcagggaagtcggctgccgggaaaaagtgggtgaaatgaacggaaaatggagagatgttctcattctggaaaggcgtagccggacagtgggttgctgaaaaaaagaatgcctctgttcatcagaggcattctgtcctggaagggactttattccggtgagggtgacttcagttgcggcataaacagctggcagcacgcaacagctacaagcccgccagacagcggagcggcccagtacagccactgattatcccagtatcccatggccaatgccggcccgaagctacgggccgggttcatgcttgcccccgtcagcggcccgccaataaaagcatcaagaaaaacagcaatgctgataatcgcggggtttctggtcgttaggatgctcataatcagaataaaagtcatgacaccttcgatgaaaaaggcattgtacagtgatacccccatatggacccgggtcaccccggccagcagggagtggccaaagacagccttcaggcacagtgcagcagcgccggcccctaacaactgagccacgatgtaattcatggttgccctgaaagagcaggccccgatcagataaaaaatcaggcttaccacggggttaaggtgtgctccgctgtcaacaacgggtaaaaagtgggtcttccgcaacttaggtggacaaaaattgatgaaactttttagttaacaaggatctaagctgttttaagttatgtataacaaaatggcctcacttaagagacttttacagctaccgcgcgggtggcaaacctgccgacagattactggtactgatggaataaccctccatctccgcgccacacgtaaaacggcatcatgtcctgagtgcctcacgcacagtcattctgttcatagttgccggcggaggcgagtacagcatcttccatgctcaggccaggccctctggttagtcttcgccatccggcactggtactgtcgtaacccttcctgttcacgtaaaatttttgctgaatcgcttgctccctttgcaggcccgcagcagcagtcttctgcattgctgaaaaatctgcagcatcagctggggcttatcgcaggtggtgaagcagggagacgagctgcagtagcttcaggaatacagatcagcgcggatactttactgcgcagagtggttcaagctccggaacaaacagagaaccggaccaggcatgttggtattgacgagtgggcatggcatcggggccacaggtacggcacactgatcgtaaatcttgatacccatcgccccctggtgttactgccaggccgggagcaacgcactctggcggcatggttcaaaaaatacccagaaatacaggtcgtctcacgcgatcgtggggggatctatgcgttagctgctcgcgatggtgcaccgcaggcaatacaggtggccgatcgctggcatctgctgaagaatattggtgatgcgctggagcgcatgatgtacagacacatgccattgatacgactggtggccaccgagttatccccccaaaaaacagaatgctgaagcgtctttggtgccaacgtcaacgttacgtcgccctgaacgtattaaacgagagcgacgtgacaaacggtatcagcgctgggctgaggtagactctcttcataaaaagggttgtgggataagagaaatatcgcgtatcaccggactgtcccgggtgacggttcgccggtggatacagtcaaaagcgttccctgaaatatcaactaagccacccagacccgggttacttgaaccatggcaggaatggctggaagaacaacggataaacggtaaccataatgccgggcagctatggcgggagatggtaaatgctggcttcaccgggagcgaaacgacggtcagggatgctgtggctaagtggcgtaagcaggttaacagtcccgttatcgccccagttcgactcccctcagcatccagagtaagccgctggttaatgccctggcgaatgatcagaggagaagaaaactatgcatcccgcttcatcgaatcgatgtgccagaaagaaccgcaactgaaaatggcgcaacagctgtcgctcgacttctatcgaatgttgaaaacgaagaataaatcgcagttaaatcaatggttctctgacgtcagtcaaagtgggctcattgaccttcagcgtgttgcggccggtatggaagcggatgcaacagcaatacacgaagcgataagcagcagatggagtaatggcgttgtggaaggccatgtaaaccgcctgaagatgctgaaacggcagatgtacggtcgagctggcttcgagttactgcgacgacgagtcatgagccctctggcttaaacaactccacctaagttgcggaagacccagttttgcaccgttggtaacagtatagcagcggtgtttgacgttctggccatgcatgacataggcacgcatcgcgcggagctgggagacaatatctgctcgctgccggtggaacagcacatgatctattttgtgtcatcacattcggtggttatgatcattcgtattctcagccagtctcaggatacggcgcggcatgaaccctggatataggatataaccgggaacgaaaataataattaaaaacaatatgatactgatatttttttcatgaactgaattctcgcgcaacataagttaaattttatttgatcagggccaattatgataatggtgatggatgcttttgatgacacttattaattacgaaaaaaaacgctcccggcgggagcgtaagccagtgacttcggcgtcaaatgagggtctgacaagtggagctgcgggttaattctgggtgatctggctgcgatgcttttcagcctgctgctgatgaatcactgaagactgaccattattcgccttctcgtgtacaacagcggctttctcatgctcgttcatttcggaaaatgattttgctgtttcgttagaagctgctggcttggatttcatcatttttttatgcatttcagccatgtcctgatgggcagaagcgttgccgttttgcatcatttcatgggtcattgcagcctgatcgtgaccgctcatatccatcattgtcatactgtctccctgaacagcgcttttttcagaggttgactgcatctgatgggcgggtgcctgggcattatttacctggtcatgcatgttcattgtctctgcagccatggcggatgaagcgacagccataatggcaacaaatgatacaaggatctttttcatggttgggtctccggtgttttcatacccaaacaatcaacggcttataacagagaaagcatttgatctcagggctggttgatcatcacgccaggaaccgggcgattgaattatcacgctgtcctgatttatggctgattataaaaaaccgcctctgtttatcgcgtgactgaacgatgacatttttgtcaccttccgggtttctcctgaataacggtattaatccattaacagacgcacactgaacacaatttcccgcccctgctgttctgctgacagctcgccgccgtgagcatgaatgatcgaccttgtaattgataatcccagccccgcgccttccgtgttgtagaaccttgatgagtctgcgcgatagaaccggtcaaacaaacgttccagattagcgggaacctggccggacatcgtattcgtaatcatcacgttcacacagtcactgtcacgctcaatgtgtatcgctgtacaggtgttatcgggagaatacttgattgcattggaaagcaggttactgaaagcacgtcggagcatatcgctgtctccggcaacaacgccctctccttcaaccgtgattgtctttcctgtttcgtctgccaggggctcgaacaactcacgtaattcattcagttcggctgccagatccacatcatgtttatccagccgcagcagaccatgctctgaacgtgccagaaaaagcatgtcactggtcattcgtgacaaccttttcagttcttccaggttagcgaataaaatttcgcggtaatgcgaaacatccctttccttagccagtgcaaactgcgtctgcatcatcagattactgactggtgtgcgcagctcatgcgcgatgtcagacgagaaatctgacagtttccggaatgccccctccaggcgatcaaacatattattgaactcctgcatggtctcagagatttccggcggagccagatcgggatttagacgctgatccaggctgtgtacggtcatggaggaagccagactggtcatttcccgtagcggtttcagaccaatacgtgtggtcagccagcccagaaaaacagaaataaagaccagaccgatattgaaccagaacagccaggtactgagtttgtccataaacagggtgtgatacccagtatccgtggcaaccgtaatgatgacatgtttgcttttaccctgttccggcgtcacggcaacccgccgcgagatactgcggtacacggtgttattttcttccgtctggatcatatagtcgagaatatcacccgacttattaagcaggaccgctggaacaacagaatttttggcatagagttcaacaattttttcattttccatgttttttatagaaatgaataagccattgtgccccaccatcgcatcgtttattttttctgataatgacttaatatccgttttgttcctgaacgtctctgttttaagaaactcttcggtgagctgaagtttacctgtcagaaaatcgcggtcctgattatcgaaatagccattcagggtgctaatcaggataaaacttgataaccaccataccgtaagcatcaccgcagaaaaaatcaggctcaggcgtgtggtcagggaaattttgaacctcactcttctctgatctccaggacatatccggcaccgcgaacggtatggatcagttttggctcaaagtcatcatcaattttacttctcagacgtctcacggcgacatcaatcacattcgtatcactgtcaaaattcatgttccagaccagggacgagataagactcctgggtaacacttctccggtgcgttgcagcagcaactcaagcagaacgtattctttaccggtgagatggatcttcttccccgaacggatcacggtccggcgcaccatatcaacggtcatatcggcgatggtgcagactgttgcggcctgcgagcgtgcccggcgcagtagggttcttacacgtgcaaccagctccgtaaaatcaaagggcttaatcaggtagtcatctgcgccaagctccagtcctttcactttgtcccgcacgttgtcctttgcggttaaaaacaggaccggttcttcgtgcccggactccctcagtgcgctgatgatttgccacccgtcgaggaaaggcagcatcacgtccagtattatcaaatcatactgtcccttcgacgcggccccgagaccatcgcggccattattaaagagatcggcctgatagccttcctcaaccagtccctgctgcaggtaacgacctgttttttgttcgtcttcaacgattaaaatacgctgcatggtcaactcgctgatatgaaagtaaaaatctcacgcatgagctttggctgtcccctagctgatctgagacggagcaagcattccaagccacgctacggcgcccagaatgataatcgcaacaacgaattctgtcaggatgctgtttcgcatcagggcaacgctgcgatcataattcccttccctgaccataacttcaagccggggacccaggtgaaaccggtttgctgcagccagaagaagcatcagaacaaacagagccgtcttggcaagcaatatcctcccccaggaactgttgaataagggagttaagttaccctcagcaatatacagatagttgaccagcgcactcaggatcagggctacaacaatcaccgttcctgccgtggcaaattttgccagggagtcagatatcacaatgacgctctgtgcattatgctcgtttctgcgcatcagcaggatagcaaatgcaaccagagcacctgtccaggcacctgcagcgccgagatgggtcagatcgctcagtaaatggagatagtaatgcagaccgtcatgcataacggcgtgtcctccccaggcaagtgtagccagcgccacgcccccactcatcgtcatcagcaggcaggacaatactctcttattagtgtaaaggaacaaagcaccgagtgtggtaaacagggcacagagtctgacaatccagctaatacccacatcagtttcttctatcaccatctcgataacatggatggataattctctgaggtcagttactccactcatggcattagataccaggagcatattaatgccagtaagaatgatgcctgtaacaacagcaaaggttataaacgacctgaaattagtcaggttataggtttcatgtctgacaccgcttattccatatatctgaaaaaatggcaatccaaatattaccatcaaatccagataaagaagaaaacgaataacaatcataatcaggtcgttcataatattacttcactgtaaaggtgtaattaccggtaatagggtgcgtatctgaagaaaccgcgcgccagtcaacacgataagtgccagcgggtaaaggctctcgcggaataatgaccatcgatttagggtcagcgcctggcgccacttttgccgcgaccggcatcggagaatgtgatgacatgcctttcatacccgtcatcgttaattttgcacctgagaatttcacggtcagattttccgagaaattaagctgaatcttttccggggccgctacggctgaatcagcctgtggcacagagctttttaattccggatgggccatagcagagaaagcaacgcccataacgaggccacctgtaagaatggctttatttaaaatcgacattttatttacctgtttagttgagtgttttatatcagtgcgttaaaaccagattctggctcccgccaggaatactacctgatggtctttctcaccttctcttttcgccatatcggatgttttcccgtaaagttgattccaggaaacgcctatatagggtgcaaactcacggcgtatttcatagcgcagtcggagccccagctctgtgtcagtcagtcccctgccgcgaccccgcgattcatcatcctgactgtagaaattcacctcataggatggctggagtatgagccggttagtcagtaaaacgtcgtattctcctcccagacgaagggctgcttttccgccattactgacaaaacccgtaatttcagactcaaaattatagagtgccagcccctgaaaaccgacagcagcccaggtccgggcagaagcaggtctgaaatcctgcctgacacccgcaaccaaatcccaccatgggccaaccgcatgtccccagagtaactgcgcttcagccgcctccgtttccccattgcttcgttcaccttcactctttagccaaatccgatctgtgtcgcctccaatccagctgttaacactccagctgaaattgttggtgttatccgaccgttgccattccagttgatccagcagaaccagataattaatcgcactgtcgtgaatcgcatgcccctgtaaattgccgaatgcagccttccggtcggcatcggtaacaggcggaattggcgttctgctctcagttacaatgggctccattgacgtcatctcagtgaaattctcatctgctggcatctgcatggcagacatgtcgtgcccggcgtggggatctgcagagacggagcccgccgcaatagaaagctgtgaggtaaacaaaccggcgaccagaacaggtatggccttcaaatttctcttcattcgcatcattcctccacccggacttcacgaaacattcccatttccatgtgatagagcaaatggcagtgatacgcccagcggccaagcgcatctgctgtcactctgtaactgcgttttgtaccagggggaacatctattgtgtgtttacgaaccatgaaattaccgttttcatcttccagatcgctccacataccatgcaggtgaatggggtgagtcatcatggtatcgttgatcagcgtgatcctgagccgctcaccgtatttcagcagcaccggtgcggcatctgaaaacttgattccgttaaatgaccaggcaaacttttccatgtggccggttaaatgcagttctatggtacggccaggttcacgtccgtcaggatcctcaaagcggcttttcaaatccgcgtacgtgagaacctttcttccgttatttcgaagaccaatacccggatcatttaatttcggagagacgctcatcgcctgcatatcaaccagtgggttatccgtttctgacgcaggatgactttgcatacccggcattccggccatccgggaatgatccataccggccatgctgctgtgatccatgggcgcggaggatgtcccgctatccggaaggtcagcaccgtccatagacatcatctctccgctgttatccatgcctcccatctggctgtggtccattcctgccatatcatgtcccattccccccatacccatatcttccatggtcaacagaggacggggatcgagggggggaacggcagcacttaacccttctctcgtggccagtgtccctcgagcgtaaccggtcctgtccatggattgtgcgaagatggtataggcctcaccctgaggctccacaatgacatcataggtttcggcaacggcaatcctgaattcgtcaacggtaaccgggtttacatactggccatctgcagccacgaccgtcattttcagcccggggatacggatatcgaaataggtcattgccgagccgttgataaaccgtaagcgtatcttttcaccgggacggaacagtccggtccagtttttcagcggggcctgcccgttcatgagataggtgtaggtgtagccactgacatccgcgaggtcagtcggattcattttcatttcagcccacattttccgatcggcaatggtggctgacagccccctggtattcacgtcgcggaaaaaagagccaacggttggtttattgaaattgtagtaatccgactgtttttttaattttttcagcaggctgtgaggattttcatcggtccagtcagacaacatgaccacatgctcacgatcgtaagcaaacggttctggctccctggcatcgatgataatggcaccgtataccccctcctgttcctgcagaccggaatggctgtggtaccagtaagtcccgttctgcttaaccttaaaggtgtaaacgtaggtatcatcaggctctatgcccataaaactcagccccggaacaccatccatattggccggaagaataatgccgtgccagtgaatggacgtctgttcattaagacggtttttgaccttcagggtaatggtgtcaccttctttccagcgaagaacgggccccggcaggcctccattgattgttttggcctgacgctcactgcccgtgatattgacggccgtttcaccaatggtcaggtcaaactgagtaccctgcagggatgcggcaactggcaggctcagactggaacgcgcattgaaactccatacgccaagacttccggctacgccagagagggttaaccccttcaggaaagttcgtcgagacgttttcaacagcatgcgcattcccttatttaaagtatggttactgacagaattcgagaaccgatttaaattaaattactggttcatccacttacaatgaaatgaatctagcacaccttaagaaacaaattcattacaatcgtgtaatgtacgtggctgtattacatttacgtcatcttctccacaggttgatttttttatatatgatcataaggacatcttttatgtacctcagaaggtaattacacatgaatatattaatcacgaccactgcgtttacagctttattttgtggggcagcttttgctcagtccagtgatattgcccatgaagcacatcgatttgttaataatgcctcagccgtcagtcatgtgaactcctcgacgcatgaaaacttaccggacagggttaataaaaacaacacgccctcattctctgaaatgaatgaacatgaaagggccattgttgctcattcatttatgaacaacagcgcgtcctatgcgcatcagaaaatgattgaggaacataaaaaaatgctgtccggcagtgatgcaaattcaaagacctcgtcttcttcttttaacgaactgaatgccggagaaaaagccgctctcgtgcatgagcaggtcaataatgccggtgcggaagcacatcagacgcaggcaagaaagcttcgcgggctgtattcgaccaggtaactgcaggcgggttagtgcttagcgtcaggtgcgcagcagggctttactgacgggttacgtagcaggacatgagccccatattgctctgccgtaacctgtttcagtcccgttaatcatcaccgtcgggctggtcatacagttcccagagcttcaggagcaaacgggaaacaagatatgttacaaaaatgacgaccatcaacggtgctcccgattaactgacagatgacacgcctcctgaaaacccctagcatacgccgcagtgttcatgctaacggcgaattccagtaaatgtattctaccgatgtcgtaaaagaaaatgcctacctttcagccacccgctcggggctggaatcgaacgagatcgctactcttcagcgctccttgccttcccggtttaatctgcggcatttgaaaaaaaatgaatcattaaaactcgtactgcaaaagaaagcgggaaaatcacgtgtcgtggcctataaatttacgtccggttcatttaattacacggcgtatcgtatatcagataaaaagttctataacctttccgatacttccgggaaaggcagtctcgattatccgttaccggccacagcaagactcagttcgcctttcaatcctgcaagacttaacccggtatcgggaaaagtgagtccccataatggcattgattattccatgcccatgaacacgaaaatagtcagcgtcatcgacggaaaaatcacccgggccgaatacaacagtaccatgggatattttgttgaagtaacgggaaaagccggtgttaaaactcgctatctccacctcaataaaatactcgttactaaaggggccagggttacccggggagacgctattgcgttatccggtaacagcggacgttcatccggtcctcatctgcattacgagctggtcatcaataacaatcctgttaactcactggcgttccgggcagcggcacccgctgataacaaacttgaacagcatgcctttgcgcatgccagagactacgaacgatacctggaatgataacggggccgcgacgcggccccgtctgccggattaattttttttatcgttttcacttccttgatgttgatgatctccatgccctccgtggccgtggaaaagatgcattagcgggcagaccagcaataacagatatggccagtaacctgccacatgtgaccagtgttcgcgcaggagggcaaatgccgcaatcgcggcgacagcaataagcgcataggtggtacttttcataccggactccttctgttagtaacagacccttcattcagggttatttcccgagcctgacacttttcagacgcaacgcatttgcaatgacgctaacggaggaaagggccatagccgccgccgcaataactggcgacagcagtattccatacacaggataaagcagacctgcagctacaggcaccccaagagcattgtagataaacgcaaaaaacagattctgccggatatttttcatggtgatttctgacagatgacgggccctgttgagtatcatcaaatcgcctttgagaagggtaacgccagcactttctattgccacatctgtacccgttcccatggctatacccacgtcagccgctgccagcgccggggcatcattcacaccgtctccggccatcgcaaccacatggccagacgctttcagtcgggttatcactgcttttttgccatccggcagaatcccggcttcaacctcatctattcccagtttccgtgcgactgcttcagcagtaagctggttatccccggtgagcataacaatgcggatccccgcctgacgcaaagctttaagcgcatccggcgtggttgctttcacgggatccgagatagctatcaggcctgcaaggttcccgtctgtggccacatagataacggtagcgccttccatccgcaacgtatccgcaacggccttttgattatcaataacgatactgttttcctgcatagccagttcattaccaataacaacccgttgaccttcgacatcgcctgagacacctttccccgacggggcattgaaattactgacggcaggtatcacgatccccttttcatgcgcggctctgacaacagccatacccaacggatgctgcgaacctttttccactgcagctgttacacgtaaaagagatatttccccacccggactgagactgataatccctgtcaccgtaggcgaaccttccgtgagcgtgcctgttttgtcgacaaccagcgtgtccactttttcaagacgctcaagggcttcggcattcttgattaacaccccggcctgggcgcctttgcccacccccaccattatcgacatcggcgtggccagtcccagcgcgcagggacaggcaataatcaggaccgacacagccgcaatgagaccgtgcgccatcctgggctcgggcccccagagagaccagatcaagaaagcaacaaccgcgataagtatcaccagaggaacaaaccagcctgaaacgctgtctgccattctctggatgggggcacgcgaacgctgtgcatcagcgaccatctgaacaattcgtgagagcatcgtttcatcaccgactttctctgcacggatgataagactacctgtctgattaatcgtccccccaatgacagggtcacccttcgttttggtaaccggcatagactccccggtcaccatcgattcatcaacggttgttttgccttcgatcacgataccgtcgaccggaatactctctccaggtctgatgcggagcttatcgccaggcaggacatcttccgcattaatatccgtttcatgaccgtcatgatccagccgtctggcggttttgggggcaaggttcagaagcgcagtaatggcgcctgaggtttgttcccgtgcccgcagctcaagaacctgtcccagcagaacaagcaccgtaataactgctgcggcttcaaaataaacggccaccaggccatccatgtttctgaacgatgcaggaaaccaggaggggaagacggttgcaatgacgctgtaaacccaggctacgccggtccccattgcaacaagggtaaacatattcagggagcggttacgtaacgacattccggcccgggcgaagaatggccagccacaccacaacacgacaggggaggccagaagcaactgcagccatgtgttgtactgtggcggtactgtattcctcaagtcgggaaacagatgagatcccatttcgagtaccagaaccggaaacgccagcaacaaccccagccagaagcgtcttgtcatgtcgtgaagttcatcactcggccccgtggatgccgtagctacgagcggctccagtgccattccacagacaggacagcttccgggaccactgcggcgtatctccgggtgcatcggacatgtccacacaccttcagaattctctttttccgcctggttgtgaggctgttttatctgatcagggctgacttcgtgatgatcgtggtgatggtgatggtgatgggaatgttcactggcatcttcggtaagataacgatcgggatgggctttaaatttactctcacagctggcggagcagaaataaagttggtggtcctggtatcgaatgctgctgtgcgccctgtcgggcaggatggccatcccgcacacgggatctctcaccttatgcaatacgtggccctcgtccggggataatgtctgctcagaagcagtctggttgttgtgttgcactgcattgtcatttttcacagtaactctccttatgcataccgaagcatcttctgtcttcagggtatgtcatggatgcgattaccacgaatatcgccggcacaggagtgcctgctaccggcgtcccgttatcagccgttccgctgactattcgattcgctggaagacttttttacttccatccggtgagaatgcgataacatcgtaagcctcttttcgggctcccatctccattccaggacttcctgctggcataccgggggtggcgagaccgtatatacccgaaccagactgcattgccttatgtatcgttgtcgcaggcacatggccttcaatgatcaaattaccggcaaccgcggtatgacaacttcgtagtcctgcaggaatagcatgcttttctttcagggctgacagcgcctgatcattcatgacgtgagttcgtacttcaaacccgtctttttccatcgctttgccccacagggaacaacagccacagttttcagatttgtacatatcaatcactttttcactcgccatcgcgggtagtgaaaggccgagagccagcgccattagaaccacttttttcatactcacctctgtatattatcgatataaaccctgacgtcagggtgaatcagtaaagaaggacacccacagggggtgccctttcaggttcaggacacgctttttttatgtctgcgcagccagattaatttgtaggcggcaggaataatgaacagggacagcagcggagccgtgatcatcccaccaatcatgggtgccgcgatacggctcatgacttctgaacctgcaccggttccccagagtattggcagcagacccgcaatgatcaccgccacggtcatggctttcggccggacacgcagtacggcaccatgatagagggcttcatcaaggccttccggtgtgaacgtctctttacgggacaattccgggtgcgcttcaatggcatgacgcagatacatcagcatgaccacgccaaactctgctgccaccccggccagggcgataaacccggttccggtcgccactgacatatggaagccctgccagtacaggaaccatatcccgccaaccagggcaaacggcaggctcatcagaataagtaaggcctcatcagcccggcggaatgccagatataacaggatgaagatgatcatcaccgtcatcggtaccatcagttttaatttcttattggcgtgctcgagtaattcaaactgtcctgagaatgccacactggtccccggtctcagtttcactttctcactgatggccgtcttaatatcgttcaccaccgacaccatgtccctgccgcgggcatcaacataaatccagctggctggccgggcattttcggttttcagcatggttggtccggaaacgaccttaatatcggcaacatcgcccagcgtaatttgctgcttcattggggtcaggattggcatctctctcaacgcctgcggactgttacggtaatcctgcggatagcgaatgttaatagggtaccgggccacgccttcaaccgtctcacccaccatagccccaccgattgctgaagagacgaacagctggacgtcgcccacagtcatcccgtaccgggaagctttctcccggttgatatcgatatcgatgtagcgcccgccctcaagtcgctcagccaggacagacaccacgccaggcacggttttggctaccgcctcgatactctgcgccgtcgcgtcgatatcggacagaacagtcccggacactttgatacctatcgggcttttgatcccggttgagagcatatcaatacggttacggataggcggcacccagaggtttgccagacccggtaaacggactgtcctgtcgagttcatcaataatcttgtcaattgtcatgccgggacgccactgatcctcaggtttgagctggatcgtggtttccaccatttcgagcggcgcggaatccgttgcggtctctgctttaccggtcttgccaaatacagaagccacttcaggaacgcttttgattaacttgtctgttgtctgcaggagcgctgcagcttctgccggagagacgccaggcaaggtcgacggcatatacagcagatcgccctcgttaatcttcggcagaaattcaccgcccacctgactcagtggccagataaccgtgaaaatggacaaggccgcaaccagcagggttgtttttggccagtggaggacccgcagcagcaaaggatgatacgctttgatcagcacccggttcagggggttacttgtctcggcaggaattttcccccggatccagaatcccatcagaataggaatgacgatgatggccagtgcggccgctcccgccatggagtacgttttcgtgaatgccagcgggccaaacagacgaccttcctgcccttccagggtaaagataggaataaaggacagggtgatgatcagcaggctaatgaacaacgcgggtcccacttccacggaggcgtcggtaatcaccttccagcgggtggcgttgtcaatctgctcacccggatgctgatgatcccactcctcaagccgtttgtgcgcattttcaatcatcacaatggcggcatccaccatcgcaccgacggcaatcgctatccctcccagcgacatgatattggcgttcagtccctggaagtgcatgacgataaaggcgatacacaggccaagtggcagagaaataatcgccaccagggcagaacggacatgccagaggaacagtgcgcaaacgacagcaacaacgataaactcttcaagaagcttgtaactgaggttatcaatcgcccggtcgattaactggctgcgatcgtaggtggtcacgatttcaacgccttccggcaggctggccttcagcgtctccagtttatccctcactgccgtgataacgtcgcgcgcatttttacccgaccgcaggatcaccacgccgccagcgacttctccctggccgttcagctcggcaataccacgcctcatttcgggcccggtctgcacgcgggcaacatcccgcagataaaccggcacgccgttctcacctgttttcaggacgatgttattaaaatcatcaatgctctgaagataaccgctggcacggaccatatactccgcttcggccatttcaacggatgagccaccggcctcctggttagacgattcaagtgcctgtttcacttcgggcaggctgataccgtactgggacagttttaccggattgacctgaatctggtactgtttcaccacgccgccaaccgaagcgacctcagccacgttcgggatggttttcagctcaaatttcaggaaccagtcctgcagagagcgcagttctgaaaggtcgtgttttccgttgcgatcgacaagggcatattcaaaaatccagcccacacccgtggcatcaggaccgatttcagaactcacaccggcaggcagttttccctgaacctgattcagatattccagcacgcgggaacgggcccagtacagatcggtgccgtcttcaaaaatgacatacacatacgaatccccgaactgtgaaaaaccacgcacggtttttgcgccaggtacggacagcatggtggtggtaagtggataggtgacctggttttctacaatctgcggggcctggccgggatagctggttttgataatgacctgtacatctgacaggtcaggcaaggcatcgaccggcgtgttaataatcgtccatgtaccccagatgctgagaaacagggcccccatcatgaccaggaaacggttggcgacagagcgccggataatccattcaatcatcgtcgtctcctcagtgccctgaatgcatatttacaggctggtcagacattgctggcatactgctttctgttttttcagggtggcgcatacgttccagcgcgcccgtaatattggcttcggagtcaatgaggaacaggccactgaccaccacggtatcgccttcattcaggccggaaccgatgccggactgttgctgtgattcatgcagaacgtggatctgtttcggcacaaacttgccttcatcatcaacagtaatcacgcgctgttctttgccggtatcgataacggcctggcttggtatcagcagcatctcctggctcttggtattcagtttcagataggcattcatgcccggcttgagaaactcatccttattagaaacctggagacggacctgaagcgtacgggttgtctgatccacgctgggaagaatgttccatttttcgacatggaatgttttatccggataagccggtaccgaaatttcaaactgcgacgtatctttcagcagatatgcgatagattctggcactgcagcgctgatccagaccgggtccatcccctgaatctgagccactactttatctttcgaaatattcatgccggtgcgcaggtcaaacgcagtaatgacaccatcaataggtgctttaatggtaaaacgggtctggattgtgcgggttgaacgcagcctttgaatatcctcttccggcataccagccagacgaagtcgctccagaaccccttttatctgggttgacgtaccgcctgtaccggataacagcaggaactcactttgtgcctcaacccattcaggaatggtgatatcgataagcggagtgcctttcttcacatgatcgccaatcgtcaggggatacactttttcgacgaaaccgtcagagcgcgcctgcacaatgacaaactgatactcgttgtaactgacattagccgggattgtctgggaataattcagcattcctcgcgtgactttttgcgtttttaatcccagattctgaacctgcgttggatcgatacggatcccgccactgcttttatcgccactttcatcagcatatttcggcaccaggtccatatccataaagggagattttccgggtttatcaaatttggtatccggtttcatcgggtcataccagaaaagtacctttcgctccggtgccttttgttcggtttgtactgttttttgtgatgagtttacatactgccaggcagtaaccgatatcagcccccctgctatgaggctgctgataattattgcagcatattttatctttaaagaagccatacaatttctcgctgaaaaatcaaaacacctggcatatgcgcccgatcattcattcacagtaatcccttaatgaatgttcaggcgcactggatgtattcgctccggactgataatcaggattgcgtaacgttaatgcttttgagtaaggagatattgccctgctgaataaacgagaaatcgacatggttgccggttttcagggcattgatagcgtcgtctgcattaacaaaagtgaagcgcatggtcattgcaggccagcccacagcagggattgcttcgtgcgaaatggtaatctttttactattcatatcaatgtctttaacgacaccggtgcccttgataacctgctgtaccgaagcatcactggcagcattcatatcgccatgctgatgtgtttcagcatgaagaccggcagaaaacatgacagagaaggcaccaaataaaacggctttaagtgaattacgcatttttaatttcctgattaattaaataaatttactctacccaaccgccacccagcgcggtaaacagattaatttcgttaacctgtcgggaataggtaagatcgagaatggtttgctgcgtagcgaagagggaacgttctgcatccagcacttcgatgtaactgacagcaccacttgcatataatcctctggcacgctggagagttatctgaagtgaatcaagataacgctgctgtgactcaagttgctggctaagactgtcgcgcagcgcaagcgtgtcggaaacatccttaaaggctgactgaattttttgttcgtaattaaccaccgattgttgctggcgaatttcagccagcttcagattggctttattcctgccagcattaaaaataggaatttcaattttagggataaaattccacattccacttcctgacgtaaacaggcttgacagctccgtactgcttgcggaaagaccactggtcagggtaatggaggggaaaaaggccgctcgcgctgcgccaatattggcatcagccgctttcagctgatattccgcttccataatatccggtcgctgcagcaaaatttgtgaagatagatttggtggcaattttactggtgcgatctccccgcctttcatccctttttctgacggaagtgcgcggtacgttcccagcaccagttgcagggcattgtttgcctgagccagatcgccttctcgtttggctatttcggcgcgggtactttcgatttgtcctctcgcctgttcaagtgccagaacgttcgtactcccggtcacgagctgttgctcaacgaaagcataggactgttcataatttttcagcgtttcccgcgcaatacggagttgttcgtacgccagttgctggctgaaatagctctgtgaaacgttggagaccagcaggatgtgtacggcacgacgggcttcttcgctggcaaagtagttctggcgatcagcctcactcatgttcttaagtttgccaaaaaaatcgagctcatagctgagctccagacccgcgtcgtactcctgtgtggtcggcttgtcacctttcagaccaccgttgtatgtgatcccggatgaggcattcagttggggataacgatctgcatccgtgacgttgaactgggcccgggcctcttcaaccttcagggcagccattctcaaatcacggttattattcagggcttcaccgatcagcctgctgacctggggatcgacaaaaaagtttcgccagcccgtatcctgatagctgtttaccgcaggcgtcagactgtttttagacaatgaaaactgctggggaaccggagctggcggacgctgatattcaggtgccagagaaacacaaccagccaggatgaatatggtactgatgctgagtaattttaatttgaacataacgcttctcgtacaggcagacctggtaaatggttcaaacgaaatccagagtattgatagggatactttaccgaacgctctctgtttgccgggtgacaggataatgacaatgttgtcatttttgctgtaatccgttgataacgatcgtgggcgcaataaaatgacattagcagccagccggggagcatgatgaaaatattaatcgttgaagacgaaattaaaacaggtgaatatctcagcaaggggctgacagaggcggggttcgtcgtggatcacgctgataatggtctgaccggatatcatcttgccatgacagccgagtatgatttagtcatcctggatatcatgctgcctgatgtaaacggctgggatatcatccgtatgctgcgcagtgccggaaaggggatgccggtattactgctgacggcccttggcacgattgaacacagggtcaaaggacttgagctgggtgcggacgattatctggtgaagccctttgcgtttgctgaactgctcgcccgggtaagaaccctcctcaggcggggaaacacgatgatcacggaaagccagcttaaagtggctgacctctcggttgatctcgtatccagaaaagtcagccgcgccgggaaccgcattgtgctcaccagtaaagagttcagcttgctggaattcttcattcgccatcagggagaagttcttccccgctccctgattgcctctcaggtctgggacatgaattttgacagcgacactaacgcgattgatgtcgcagtaaagcgactccgcgctaaaatagacaacgattacgggacaaaactgatccagacagtgcggggcgtgggctacatgctggagatcccggatgcatagcaaaccgtccagacgacctttctcactcgctctgcggctgaccttttttatcagcctgtccacaatactggcgtttatcgccttcacctggtttatgctgcattctgttgaaaagcattttgccgagcaggatgtcagcgatctgcaacaaatcagcaccacactgagccgtatactccagtccccggcagatccggatgaaaaaaaagtaagcaaaataaaggaatcaattgccagctaccgcaacgttgcccttttgctcctcaatcccaggggtgaagtgctctttagctcagctcagggggcggcactacgcccggcagtgaattcagcagattttagcgagcacagccgcgcacgggatgtctttctctggacggtggaggatcctgcgggaccgatggataccgggtccgaaatgaagatggaaacatacaggattatcgcctcctctggtcaggcgatatttcagggcaaacagcagaactatgtcatgctgactggcctatccattaatttccatctccattacctcgatgcgctgaaaaagaacctgattgcgattgccgtcgtgataagcctgttgattgttctgatcattcgaatcgctgtccgtcaggggcacctgccccttcgtaatgtcagcaatgccattaaaaacatcacctccgagaatcttgatgcgcgactggaaccgacacgcgttcccattgagctggagcaactggttatctcgttcaatcatatgattggaaagattgaggatgtctttacccgccaggccaatttctctgccgatatcgcgcatgagatcagaacgcccatcaccaatctggtgacgcagactgaaatcgcactgagtcaggatcgaacacagagggaacttgaggatgtcctctattccagtcttgaagagtataaccggatgaccaaaatggtcagcgatatgctgttcctggcacaggcagataataatcagctgatacctgacagggtcatgtttgacctcagagcggaagtcatgaaagtcttcgagtttttcgaagcctgggccgaagaacgcaatatcacgctcaaatttaacgggatgccctgcctggttgagggagatccacaaatgttcagaagggcgatcaataatctgttatccaatgccctgcgttataccccggagggacaggcaatcaccgtctcaataagagagcaggagagcttttttgaccttgtgattgaaaatccggggaaaccgatccctgaagaacatttatcaaggctgtttgaccgtttttatcgggtggatccatccagacaacgaaaaggagaaggcagcggcatcggccttgcgattgtgaagtcaatcgtggaagcacatcacggaagagtgcaggtggaatcagacgtacgctccacgcgttttatcttatccgtgcccagactggagaaaatgatcccggaaacccaatgctgaaaataaagatgtaaatgacaaagatgtcattagcctgtcatgcagcaaacagaagccattcgatataattagtgcaacttatcaggaaggctggattgcttcatcaatacccggcgtcagagtacgccaggaaatgaatatccagccctcttccggagaaataaacgctgccgaacttgtttcagttatggaactgaaaacaccggttgtacttccccggacatcactaattcagaaatggagagttatcatgaaaaatatcgtattagcatctttgctgggctttggtttaatttcatcggcctgggccactgaaaccgtgaatatccatgatcgcgtcaacaatgcacaggctcctgctcaccagatgcagtctgctgaggctcctgtcgggatccaggggactgctcctcgtatgaccggtatggaccagcatgaacaggccattattgctcatgaaaccatgacgaacggctcggcggatgctcaccagaaaatggtggaaagtcatcagaagatgatgggaaataacacggtatccacgaccgtcccgtcaacgtcttacgcggcgatgaatgagcatgaaagagcagcggttgctcatgaattcatgaataacgggcaatccggcccacatcaggccatggccgaagcgcaccgccgcatgatcaatgcaggctgaatgcgacggtagtatccgtgctgttaccttttccctgatagattttcctgaaacaacgttgctacatttttgccccccgtcagggggcttttttgtctgactcagctacacttaaccggtacctgtctgaaaggaattattatatgggctatttgcattctagggttggaattcatccattctaacccttgattcttagtcggacaaaaagctgcttctggttggatttttctgtttttcaccaccctgcgaaaatctaacattggttggattctcagacgcgccctctctcgcgttaatccaactctccaccttctgcctgcttcaacaatgtcggaatgtgcggtccatactcgaccttgcctcgtcctgctcgaataccactgccaaccttgcgggcttctttggagtacaacgtctttgcacggatgatctcatagctataaccccgacctaaccggttggacatcttgatcaaaccgttgagcccttcggtatagccattggtgagtgagaacggcgcatcccagtaggcaaagatgtcgtcgtaatggttgtgtaccgtttttaccagttttttgaaaggctccatgccataaggcggcaggctgttcttccaagcctcaaaggcgttctgagcactctgcttgtcgggttcgtcgtagatgcagaagaaggcttccttgaagtcataggccatggcaagtgctgggatcgcctgctttacaacctccagcgccttttgctctgcgggcgtcaggttgccgggtcgcttcagggtaagccagcgaatggactttttgacgtaaatgcgatcttctttgcttaactgtgcctgggtaatgaccccaacttactgatagtgttttatgttcagataatgcccgatgaccttgtcatgcagctccaccgattttgagaacgacagtgacttccgtcccagccttgccagatgttgtcgcagattcaggttat

SEQ ID NO: 80 - DNA, 49641 bp, Unknown
  source: /note="Description of Unknown: KP2-Mcoc1 Bacteria Sequence"
ggcatacggttcgtgcgacctgccgttaatttattcaccattgttgctgaaactgccggtgctgacggcctcaaaatcgctgagacgttcccggaaggccggggcagcccgcatggatgcgggctgaaggccgtgttttgcacggatgctgcctcggcccgacccgaagcctgcagggataagtcgaagggaccgcgtagcggcgattttgctggctggagcccgggggtacagggggcggcggcgactggccgccccctgtgcgctccctgcgccatgccaggcataacgcagacaattaaccgggagcgcaatgtgcgctgaaatcacatgcgacaaacgctttacccggattaatagagttgcataccaataacattatatccggcaccccgcaggcgcatataccccaggcccggcaagcgtagcgccgccgggcaggacacctccggcgccatacccgcctttgtgccggatggcggcttcgccttatccggcctacgggatcctcccgtaagtccctatacaccaggcccggcaagcgcagcgccgccgggcaggacaccgcagataccgtagccatttttgtgccggatggcggcacaaatgccttatccggcctacgggatcctcccgcaggcctatactgcgccgccgagtaacaaacgccaggcagcctatctcacgccttctgcttggcctcggactcctggctgctgttcagcgccagcgaaaccgccagcgtctgggccagacacagggaagcaacctgcgaacggaagccatccacctgcgcttcacgcaccacaaagcagacatcgctgaaggccgccagcgggctgacctggctgtcggtaatggcgatctgccgcgctttgcgctgcgcgcccagctccaccagctcgaccacttcccgggcgtacggcgagaagctcaccgccactaccacgtctttcggaccgaccaggctcagctgctcggtgaacatgccgccgaggccgtcgatcagaaaggctttgcgatcgaggtgacgcagcgcataggtcagataggaggcgacgctaaacgaccggcgcagaccaatgacgtaaatattttccgcctcgcccagcagggccaccgcgcgctccagatcatcgctggaggtctgcatcgccagctgctgcaacgcctggttgttcaccatcgtgaacatattgaggatttccgtcggcgtttccggcgggctggactcatcgctggtggtctggcggaacagacgggcgcgctcggtatagttggcggtctcttccatcaaatgttgcttgaacatctgtttcatttcgttaaagccgctgaagccgaaggcgttggcaaaacgaatcaacgtggaagggggaacatccgcctgttgcgcaatggaggccacggtatcgaaagccacgctattgctgttatcaaggatatagcgggcgacctgtttcaggcgtttgcttaacgtatcgtagcgacgcctgatttcatcctgcaggatggtcagctgtgttgggttattggccatagagtgcgctctgagaaaatggaaggaatatggcttccagtgtaccaaatgaagcgaatttttcatttattgcgacgaaatacgcgattcatttcacgaagaaacagaaaaacgcccgctccgcaaggtgacggagacgggcgtcgggggatcagcggcgggcttcgcgccagtagccaatgagcgtcaggtagttgcgtttcacttcttctatcagggcctcatcgctgagctcaccctgcatccagcgccgcgacggctggccaaagatggtgcgcccgacggcgaaacctttgatcatcgggtgtgcggccgcctcggcgaaaccggcgcgcagtttgtcggaaggcgcgtcaagcccgaggatcaggatccctcggctccacggatcttcacgctcgataagcgcggtgatctgctgccagctggcgctggagagcggcggcagcttccaccagtccggcttgatccccagctgatagaagtgttccagcatagtgtggtaatggcgctcgtctttgtccgggccattttccggcaggatcacctccaacagcagttcatggcctgacttgttacaggcctgccagacctcgagcagcagggcgtcctgctctgcacgcagcgccgccgggtcgtccgggtgatagaagaccaggcatttgacgacatgctccagcggccagtcgatcagctgcgagccgatgttgccatgctccagacgcagcggtcgcgagctgggcagttcgatagggcgcccgatccaccagcccttgccggtaatggcgttgagcgcacgctggccgtaggtgccgtcggccagaatgccgctgcgctgatcgagacctgcctcctgcgccgccgcttcggccgcggccaacaacagcagtttgagctgcggaatgcaggcttcgtcgcgcccggtctcccgcgccagatcggccagctgtttgcgatggtcgaaggcgaaaatgcacagctccggccactgttgacggcggctggtgacccggtgcaggtggttgaggcgctcgtcgacgtccgggcgcggcaccgattcggcgcgctgcaggtagtcatcaagttcgactttggtcggcatcgccggcgcgcagccgtggcgggagaccaccagcgccccgcaggcgttggcgtaacggcaagcctgctcccagccttcgtcgttgagccagccgcgcagcagacccgacataaaggcatctccggcgcccagcacgttgagaacctccacgcgcacgccctgctgcagcggcacctggtcccagctgtccgggatgtcgccttccagcaccacgcagcccatcggcccgcgcttgcagacgagggtggctttggtggcgttgcgcacatttttcagcgcggtcagggtatcggtgctgcccccggcaatatgaaactcttcttcggttcccaccaccaaatcgaacagatgcagcacttcctgcagctggctggtgaccggtccggactcaatgaaacgggtttcgccatcgccgagcgaggtgagcccccacagcaccggacggtaatcaatatccagcgcggtacgcaggccgtgacggcgggcgtactccagcgccttcagcaccgcggcgcgggtgttggcgtgcgacaggtgggtgccagtcaccgccagcgcccgggaggaggcaatatactcctcgctaatgtcgtcaggcgttaaggccatatcggcgcagttatcgcggtagaaaatcagggggaaggtctcctgatccttaatccccagcatcaccagcgcggtcaggcgagatttgtcggtaatcagatactcggtatccaccccggcgcggttgagcgtttcgcgcaggaaacggccgttgtgttcatcgccaacgcgcgccagcatggccgatttcagcccctgaatcgcggtgccaaaggccacgttgccggaggagccgccgagatatttcgcgaaactggcaacgtcttctagccgcgaaccaatctgctgggcatagaggtcgacggccacccgacctatacagatgacgtcgagccgctttactgctgcattcatagctaggatttcctttttggtgtctgctgcctggaagggtcgggatcccgacgtcgactccgtgaacagcctgagggttattggttacccttagtttgagaaataaatatttcatttgcaaactcgttcgaaattaaaaaaccaaaagtgtgagggatctaccactctgccgcactgagcctcgcgcgagcgcggatcgccccctctgtcgacccgggggaaaatgaaacgccaaatggcatccatttacctatgatttttaaggggatattgccgtctggtgcggcaaaaaaggccccgaaaacgtgtctggaatgtaagtgaaacgtatgaaatgggtagagagtttgatccttctcgcaaaatgaaatatttcttctgtatttgtatttaatgaaaaaaatgtttgcctataatccacaggtattccagtgacgtgaacgacggccccggcggcatcggcgcgacgccacacacaaatactgaacaataaggattgtgcatcatgggcaaactgagactgacaacggcgcaggcgctggtgaagttcctcgataaccagtacctggaagtggatggcgtagagctgaagttcgtgaaaggcattttcgcgattttcggccatggcaacgtcctggggctggggcaggcgctggagcaggacagcggcgatatgcgcgtctatcaggggcgcaacgagcaggggatggcccacgcggccaccggttttgcccgccaggccctgcgccggcagattatcgcctgcacctcctccatcggtccgggagcggccaacatgatcaccgccgccggcaccgccagcgccaaccgcatcccgctgctgctgctgccgggcgatgtcttcgccacccgccagccggatccggtgctccagcagattgaacagagctacgatctcagcatcagcaccaatgacgccttccgcgcagtcagcaaatactgggaccgtattacccgcccggaacagctgatgagcgcctgcatcaacgccatgcgcgtcctgatcgaccctgcggaaaccggcgcggtaacgctgtgcctgccgcaggacgtgcagggcgaagcctgggattacccggaatccttctttgcgcgccgcgtgcaccgtctcgaccgccgcccggccagcgccgcgcagctggcggacgccgtggcggccatcaaagccagccgtaaaccgctgatcgtctgcggcggcggggtgaaatactccggcgcgggcgaagcgctgtcccgtttcgccgagcgctacggggtgcccttcgccgaaaccccggccgggaaggggacggtggtctcggctcaccccctgaacgtcggcggcgtcggcgagacgggctgcctggcggcgaacctgctggcgaaagaggccgacctggtgatcggcgtcggcacccgcttcagcgattttaccaccgcctcgaaatggattttccagcacccggaggtgcgtttcctgaatattaacgtcagcaacttcgacgcctggaagctggacggcattgccatgctggcggacgcccgggaagcgatgaccgctctcgacgcggcgctggcggacagcggctggcaggccggctggggcgcgcagatcgagagcgtgcagagccgtcagttaaaagagacccagcgcgtctaccaggcggtgtggcaggagaaatcctttgtgccggagatcgacgatcatctcgatcgcgaatcggtgtatcgcgagttccgccagatcaccgactccaccctgacccagagcagcgttcttggggtactgaatgaaacgctgccggccgaggcggtgatcgtcgcggcggcgggcagtctgccaggcgatctgcagcgcgtctggcgcaaccgcgcggaaaacacctaccacgtggagtacggctactcctgcatgggatacgaagtcaacgccgcgctgggcgtgaagctggcgcagccgcagagcgaagtctactccctggtcggcgatggctccttcatgatgctgcactctgagctggtcacctccctgcaggaacgggcgaagatcaacgtcgtgctgttcgacaacatggccaacggctgcatcaacaacctgcagatggagcacgggatggacagcttcggcaccgagttccgctaccgtcagccggaaaccggccagctgcagggcggcctggtgccggtggacttcgccaccatcgccgccggctacggctgcaaaacctggcgcgtcactactctggacgaactgcgccatgcgctggacgccgcccgtcgcgaaacggtcagcaccctgattgatattaaagtactaccgaagaccatggtgcacaaatacggcagctggtggaacgttggggtcgcccagacggcgctctctgagcggatccgcaaggtggcgcaaatgattaatgaaaagcgcgcccaggcgcgtgattactaaaacgaacctctaccctgaatcctacagacttacggagaaaaccattatgtcgctcaaattaggtgtcatcggcgctggcgctatcggtaaagaacacatccgtcgctgcacccaggttctgcagggcgccaccgttgtggcggtgtctgatatcaatgccgacaacgcccgcgcggcggtcgcgctgccgggcgtgcaggcggaagtctacgccgacggccacgacgtgattaacgccagcgatgtcgatgccatcctggtcacctcctgggacccgacccacgaagagtacactctggccgccatcgccgccggtaagccggtattctgcgaaaaaccgctggcgatgaccgcggaaggctgccgccgcatcgtcgatgccgaaatgaaggccggccgtcgtctggtgcaggttggctttatgcgcccgtacgacgaaggctatctggcgctgaaaaaagtgatcgacgatggcgatatcggcgcgccgctgatgctgcgctgcgcccaccgcaaccagtcggtcggcgagaactacaccaccgatatggcgatcaccaacaccctgatccacgagctggacgtgctgcgctggctgctgaacgatgactaccgttccgtgcaggtgcgcttcccgcgctccacctcgcacacccatgcgcgcctgaaagatccgcagatcgtctcctttgaaaccaaaaaaggcaccctgatcgacgtcgaagtgttcgtgaactgccagtacgggtatgacatccagtgcgaagtggtcggcgaaaccgggattgcccgtctgccggagccgtcggccgtccagatgcgcaagtccgccagcctgtcgaccgccatcctcaccgactggaaagaccgctttatcaaagcctacgacgtcgagctgcaggcctttatcaacgacgtcaaagccggccagctgcacggcccgtcggcctgggacggctacgcggcgtcggtggcggcggacgcctgcattaaagcgcagggaaccagcgagccggttgaagtgacgctgcctgagtgcccggcattctacaaacgttaagcgcgttttgctgacggaacttctttgcacaggtaacgacgatgaaaattgcctttgatgtggatgtgattaaggacctcgggatcacccgcatggtccatcaggtagcggagtggggctacaagtacattgaacagtcgccgcacccgcagattaacccgttctacaagcacccgcgcgccagccgggagatcatggcggagtacaagcaggcgctgcgcgataccggccttgagctgtcgtcgtttatctgcgtctaccgctggtccggcccggacgaactgcgccgtcaggcggcggtgaaaaactggaaacggctggtggaaattgcggtggagatgggcgttcaggtgatcaacaccgagttctccggcgatccgaatcagcctgagatctgcgatgaaatgttctatcgctcaatggaagagctgttgccgatttttgagcgggaaggcatccgcgtggagatccaggcgcatccctgggatttctgcgaagagaacaatgaaaccgtcgatatcgtgaagtcgttccgcagcgataacgtgaagtacgtctacagcgtgccgcacacctttttctacgacaaaggcgtcggcgacgtggcgagcatgctgcgctatgccgggagcgatctctcccatgtcctgattgcggacacccgcaatcatacgaaacattgccgctatatcgttaacccgccgggcgtggatgccgtggtgcaccagcacgtaggcgtcggggaaggggatgtggatttcgacgcgctgttccgcactctgcgcgaaatgaaattcgccgagcagaccttcaaggtcggcggggagccgattgtcgccacctcgctgtttggctacccggaaaaaatgaaataccaggcagtggaaacccgtgaacttattgaacgtgaattgctgcgccgctaaggcgcagcggcaggagccctactatgaacaaagataacgtcaaactggctatcgccccaatcggctggactaacgatgatatgccggagctcggcagcgaaaacaccttccagcagatcgtcagcgaaatggcgctggccggctttaccggcagcgaagtcggcagcaaatatccgcgcgacccggcggttctcaagccgatgctggatatccgcggcattcagatctgcaacgcctggttcagcacctttttcgccaacggccagcgggaaaaaaccattgatgaattcgtcaatcacatgaacttccttcatgcgatgggcgcgaaagtgattggctgctccgagcagagcggcagcatccaggggctggataaaccgatcctcggcgatgcgaagccgtgcttcagcgacgaagagtggcagcgggtggcggaaggctacaacaccctcggccgcctggcggcggagaagggaatgcaggtctgtctgcatcaccacatgggcaccggcattcagaccaccgcggaaatcgacaaatttatgtcgctggtggacgagcgcgtcttcctgctgttcgacaccggacatgcctggtattccgaaggcggcgaagcgccgatgctggcgatcctcaaaaagtatctgccgcgcatcaaccacgttcacctgaaagacgtccgcccgccggtgattgaccaggtgcgccgcgacggcctgtcgttcctcgacggcgtgaaaaaaggcaccttcaccgtcccgggcgacggggtgatcgatttccgtccggtgttcaagctgctggacgactttggctataaaggctggatggtagtggaagccgagcaggatcctgctctggccaatcctttcgaatacgccgtcaaagcgcgcaaatatattcgcgaaacggcagggatctaatcgttgtgacattttcaggccataccgggtatggcctgcttttttcctttcacaaccggactcagggcttaaccacagcgccggacagttccctctccctcagggagagggccagggtgagggtgaggatgacgggtaaagcgtcacttcacttccgccagcgcggtcttatccacatacggtttcatcagcgcgtcggcttccttctgcgccgcctgcaccgccgcttccggcgtcactttggcatcattgaccaccgccgccagctggttctccatcgccttacgcaccgccacggtctcccaggtggagtaccacggatgggcgtacttcagctgctcaagggcgatcgccgcccgcggatcctgctgcagataggccttcatctccggcgtatcgtatgacgccttgcgcggcgagaagtagccggtgaagcggctccacgcgccgttcacctcggggctcaccagataggtcaggaactgatacgccgctttcttctgcgcctcgttgatgcctttaaagctcaccaggctggcgccgccgatcggcaccgcgcgctgctctttggccggcagcatcgccaccccaagctcaaaatctttgctgttctcgcgcataaagcccagcgcgccggtgctgagcatcgccatcccgagcttgccggagaagaacgcggcgctgatctgcttcgagttcagcaccccggacggcatcaccttgtccttgtagatcagatcctgccagaagcgcagggcgccgatggcggtcggcgagttgtaatagacctcgcccggatagtcttcgttaaagtatttcccgccgttggcgcgcaccagcgccgagaagatccagccgccgtagtcgtcgttggtcgacggcagcatgatcccccactggcctgtgctctcgtcggtcagctttttggcatcggccagcagctcggcccaggtctgcggcggctgtttgatcccggcccgatcgaacatcgtcttgttgtagtagaggatcggcgtcgagttatggaacgggatcgcataggtggtgcccatcacctgggcgttcttatgcatcgcgggccagaattccttttgcagaaaatcgccggccttttgatcgccatatttaaacagctcatccatcggcaggatcgcatccttcagcgccagatcggtggtgaagttggcggacatgatcaccagcgccggcggctggccggccttctgcgccgattcggctttgatcttggtggtgtcgtagttgccggtgaagatcccgcgcacttcaacatcctgctgcgagtcgttgaattgcttaatgacgcgggtcatctccatggtcagcttgccgtccaccggcgccgggaacatgaagtctattttctctttcgccagcgccgcgccgctcagggcgaggctgagcccaaccgcgactagcgtgaggggtttaaacatgatctgtctccatcagtaagcacctgtccacaggctattttatttgccagtttggccctgggcagtgctcagaatcctcacgtactacgtgtacgctccggttcttccgcgctgtccgcgtccaaactgactgcaacaattacgcctgatgtaccggcgctaaattatgctgggtctcagcatgaaaaagatgcacatcggcaggcgaaaagccgatcggtagcgactcgcctttctccggcaccgtgccgcggtggcggcggctaaagcgcagggtgccgatcggggtgttgacgtggagcaggtaatcggcccccatcagttctcgttgcagaacggtggccggcaggcgcagatggccctcttccacgcggtcggtaatatgttccgggcgaacgcccagccagacgcgggtctgatcccggtggcgcggcggcagcggatggcgttgttcgccaagctgaacgttgccgtcaacgcaggggagcgatagcaggttcatcgccggcgaaccgataaatccggccacgaacagattggccgggttggcatacagatattctggccgtcctacctgctgcacgtggccgccgttcatcaccacgatgcggtcggccatcgacatcgcctcggtctgatcgtgggtcacatagatggtgctggttttcagctgctggtggagcgccataatgctgtcgcgcacttcgctgcgcaggcgggcgtcgaggttggagagcggctcgtccatcaggaacagccgcggattgcgcacaatcgcccgggccatcgccacccgttggcgctggccgccggagagcttcgccggtttgcggtcaagcagcgcctccagctgcagcatctgcgccactttatccacccgcggctgccagctgcttttctcttccttgcgcaccttcatgccgaaggtgatgttgtcgcgcaccgacagatgggggaacagggcatagttctggaagatcatcgcgaagttgcgctcgcgcggcgtggcggcggtgatgttctcattatgcagccagatttggccttcgctgaccggttccagccctgcgagcaggcgcagcagggtgcttttcccgcagcccgacgggccgaccagcaccacgaattcaccttcgtgaatatccagcgacagggcgctgagcgccggtttgccgtcgaaacgtttactgatgttttgcagactgagcatggcggttagcgctcttccgttgggcaactgatgttatcgtcgtacagccacggcccggcgtagtgggccagcgagtgctggtagctcacccactgctcaccgacctgacggtgcatcaggcacgaggccggagagaggtcgtaatagggccgggtgtcttcgtggcagtacggcacctgatgaacggtgccgggaatggtggagatcagcgcctggcgatactgggtcatggtcaggctgtggttgtggccgcagaagatgcgcgtcagcgacgggaaacgctccaccagcgccagcagacggtggccgttttcgcaggcgatcgggtccatctgcgcattgcccagcggcagcggcgggtggtgcataaagatcgttgccggtttgtcgccgccctcgaacagttgcgcctccagccagctgatggtctcgtcggtcagccagccttttgacgtgccggcatgactggagtcgataaacagcaggcgggtggcgaagtcatccaccacatagcgcatattttgcggatcgttgcccagctgcgggcacagcgggtgaagatgctccagaaaatgggctttgtcgtcgtggttgccggggatcagatacagcggatagttcaggctgccgaggatctggcgggccacctgatactcctccgggcggccgcagttgacgatatccccgctcaccaccaccgcgtccgggcgctcgcgcagcgcgttaagctgggagaccacgtcggcgttggcggcattgacgtcgataaagccgtacagcttctcgccgcggctgcggaaatgggtatcggaaatgtgcgctaacagcatgaatcactccttatttgatcccggagaagccgaagctccgcaggaactgtttctgaaaaaggatgaacgccagcatcagcggcagacagaccatcagcgtcccggcgccgatggtgccccactggccgccggattcggcgcccatggcgaaggagaccagcccgacggtcagcacctgcttatcgggatcgttgagcatcatcagcggccacaggtactcgttccagtggtaggtaatgctgacggtggcgaaggccagcaccgacggccaggacatcggcagcagcacgcggaacagcacctgccaccagcggcagccctccatcagcgccgcctcctccagctctttcgggatggcgaggaacgcctgacgcatcaggaacacgccgaacgccgaggtgaagtagggcatcatcaccccggtgagggtgttgagcaggccgaaggttttcagggtcagcatgttcggcaccatcatcaccaccggcatgatcatcagctgcaccaggaacaggagaaacagcgtctgcttgccgcgaaactcgtggcaggcgaagacgtagccggcggtggtgatggtaaacagctgcacgaagaaggtgccgaaggtgaagataatggtgttggcgtacaggctcagccagtcggcgctctgccaggcgtcgcggaagttatcgagggtcagcggcaggcgcggcagcagcgacgccatatcttccccgaaggtggtggcgctgaacgaggtggccagcatccagataaacgggctgatccacagcagcgccaggcagcacattaatactgtaagcgtaaagggcgacgagcggcgcaggcgcaaccatagtggacgggcggcggcgggcgtgcggaccagcagcggcgagatttcagcgctcatagtgggctcctttctccagcagtttcaggttaatcagcgagaaggcgaacagcccggccagggtgaggaaggtggcggcggaggctttgccgaggtcgtgggtatcccaggcgagattctggatgtaatagagcagcacggtggtggcgttgtccggcccgccgcgggtcatcaccgccacgtggtcgatctgggtgatggagtagatcagcgcggtggtgatcacaaagctcagggtcgggcgcagcagcggtagcgtgaccttaaaaaagacctgcgtgcgggtagccccctccatcagcgccgcttcccgcgtcgaggccggaatgctctgcagcccggcgaggaaaaacagcatgtagtagccggcgaacttccacacgccgatcagcgccagggccagcagcgcgctgttgctgcgccccagccagttgttgttcatcggcccgaacagctttgccagatagtggtcgagcaggccgaggccgggcataaagataaacagccacagcgcggcggcgctgaccatcgggataatcatcgggaagaaaaaggcggtgcgcagccagcggttgacgcgatggttctcgctgagggcgaccgccagcagcagggcgagggtcaccccgggcactaccgtcagcaggatatagagcaggttattgcccagcgactgccagaagacgttatcggcaaacaggcgggcaaagttatccagcccgacgtactgcgcgccgtcgctggccatgcgggtatcaaacaggttgtcatacaccgaacgccccagcgggaaccaggtaaacagcagtaaaaacagcagggaaggcgacaggatcagccagggaagccaggtctttctcatggtgacgcgcatctcgttcagccatttatcgaagcccggattgtgggaagcaatgactacagaggcatggcggggagatgacggtttgatgaagcgacggggaaaacgccgggcgagcgggccgcccggcgggagagaatcatcagaagtcggctttcagcaccgcgcggtagcgggctttgccttcgcgaacgtgcttcagcgcttcgttaatttgcgacatcgggaacagctcggtggtcggagccactttgctgcgcccggcaaacttcatcagcgtgcgcagttcggacggattaccggtcgccgagccggagatgctgcggtcgccgccgatcagggtaaaggccggcaccgggaacggcctcatcaccgcgccgacggtatggaagttgccgccgtaagccagggcttcgaagtacggctgccagtcgaggtccaccgccacggtgttgatgatcaggtcgaactgaccggccagcgcttttaaggcttccggatcgcggctgttgaccacgcgatcggcgcccatcgccagcacttcctgctctttggccgggttggagctgaaggcggtcacttccgcgcccatcgcccgcagcagcttaatggcgatatggccgaggccgccgatgccgatcaccccgacgcggctggtggcggtgacgtggtgggtcagcagcggtttaaagacggtgatgccgccgcacagcatcgggccggcggacgccagatcgatgctctccggcagggggatcacccactgccagtcggcgcgcagcttattggcgaagccgccgcggttgagaatggtcggcaccgagccttccagacagttgatctggttgccgctgatgcaggcgtcgcaatggccgcagctgcgcgccgtccagccgatgccgaccttctggccaatcttcagccctttatcctgagccgcgctgcccagcgccgccacccggccaatcacctcgtgaccggccaccagcgggtagctcgacatcccccattcgttgtcgatcatcgacaggtccgaatggcagatcccgcagtattccacttcaacttcgacatcttccggctgcagctcgccggcatcgtattcccacagtgacagatcggcgcccgcttctttggcggcgtagcttttaatgatgctcatgttcatttccttggggttggcgtgataacccagaaagtgtagagcatggtattccccggcgcttggcaatcggaggggtcgcgaagcgggcggaccagccgcccgttaaggtcagcggctggccagcggccactgattaaggcggatgccgcgctgcggggcgttctcggcaaaatcatccagcaccgcccgcacgtccgggtcgagatagccgacgctgtcgtgctcgacgatcaccacgctcttttccggaatcttcgccagcagggccagcagatgcggattgtgcataaaggtcagattctgctggatgcgcagcacgtagtggtcatcgtagcgcgccagctgcagcgagtggcgatggctgcgccagaggctgaacgccatctgggtggcaagaccaatcccgatccccgccagcatgccgcaggcgataatcccgccgatggtggcgaggaacggaacgtactgcgccgcaccctggcggaactgctcgatgaacagccgcggcgtcgccagcttatagccggtatacagcagcacggcggcgaggctggcgagcgggattaaggtcagcaggccgctgaaccacaggccgcagattaacagcaggacgccgtggataaagatcgacagcttgctctgcgcgccattgctgacgttcaccgagctgcggacgatcaccgcggtgatcggcatcgcccccagcacgccggagagcagattgccgacgccctgggcgaccatttcgcggttcggcgaaggcggcggattttgcggacgcagctttttcagcgcctcctggctgagcaaggtttcgaggctggcgaccagcgccagggttaccgccaccacccacaccgacggattgcgccacgcgctccacgccggagattccagctcgcccagcagatcgccgaggctgccgaacgccggcagggtgatgcgtggcagagtggcaagctgctgcggcgcggcctgggtcattaatacgatggtgacacaaccgagcaggacagcgatcagcgggccggggatccagcgtaggctcttcacccggcggataagcggcgaaccccacagccagagcaccagcaggccgcccgcggcgacggcgatagcactgagggagaaggtggcgttacccttcacgatatcaacgagcccggtctcttctgcgctgccgagcgcgacggggatctgctgcataatcagcaggatgccgatcgccgccagcatgcctttgatgacgctggcgggaaccagcgagataaagcgcccggcccgcaggatgccgaacagcagctgcagcgcgccggccagcaacagcgccatcaggaagagggagaaggaacccagggattcaatggcggcgacgacgatggtgaccagtccggcggcggggccgctgacggcgaagcgggaggggctgagggcggtgacgaccaggccgccgatgatgccagtcagcagcccgacgaagggcggtaagccgctggcctgggcgatgccgaggcacagcggcagggcgacaaggaagacgacgatgccggcgagagagtcctgacgaagcgtgttcatggggcgtgctcctgcggtgagaggtgttcgacgagggtggttaaatggccggaagccagatcgtagacgcagccgtgcaggctgagcggtcgcccgctggcgagcaccgtctgcaccggttcactctccagcagacgggcgaactgggcgcgaacgttggcttccaccagggcgtccagcgcatggcgagaacgctccgcgttggcgctggcgctggtgctggcgccgggggaggccgcaatacaacagtcatcggcgatctgcgcaatttcgtgatgcagggtgtggcgcagctggccgatgcggcgagccagcgccgaggactcctgcgccagcggcagggtgggcagagagagcgccgcctgcacgccgccgcagccgtagtggccgcagagcaccacccgctccacctcaaggtagtggagggcatactgcaggacgctcatgacgttgtcgtcggcgggatcgagcatgttggcgatattacggtggacaaagagctcgccgggctggctgccggtgagcacctcggcgggcacgcggctgtcggagcagccgatccacagcgagtggggccgctgcccgtcgatccatttttcgaaatagtccgggtcatgctgacatttctgcagcgcccagctgcggttgcgggccagcaaaggttttaacgtcgtcacaagtattctcctgagttaattcatcgagtgaatatgtccatcaagactcgtacagcgactagtaaaaatagtgtttaccggaacccttcacgcctgaggaaaatcctggaataaacggcaaaaagaaaacttttcattaatgtaaagttataaaaatattgatgaaattaatgttttgccgcggagcggatggataacaaaaaggcattggctaaaactttctggaatatatgggaatggtggtgggtggggtggggggaatagttggggagtggatattggggatgggtggggaacgttgggttgggttgagtaattcgggtgagcatagcgtgagaaaaatttgagataaatttgaatggagtttgggtgttattgagcgggaagggggaacggctggcaggtggggttgggtttgcgggaggggcggtggtgatggggcgccctggaatagcggcaaaaggtgacgccgcgcaggatagcgctgtttttttcaacacttagcgcaatgacgacacgctgtcgcttgcatgaccgccgccgacaggtataatccagaacgtttccgcatccccttcagtgccgaagtggcgaaatcggtagacgcagttgattcaaaatcaaccgtagaaatacgtgccggttcgagtccggccttcggcaccaagtgatgcaataattagctacctaagggtggctttttttgtgtcttgatttctatgcaacttctgaaaacctgatagccgtgtagtttggatgggatcgaagcgaaagttgtataaagtagtatttggtgccttgttcttgcaaaactatgatgacttaattataccttcattggatataaaaccgagggagagtcatcgatgatgtcatttgatacacatgctgctatggatatgatcacccactcaacgggggggtttagttatgatactcttgccagggctttgatttctaataaaaaggccaaagcaggtggatgtttgttaaaagattgtcaagaattttgcgaatatttagaatcccagggagttatcaaacgtaatgccccgtgtgatagggatgaagatgtttattatgagtattctccacattaattgaattcgtgataggttacgataaaagttttttacctaattaggcttgcaacgaacccctacatacggtagctttgcggggggattcttgagggtaatattgtgagccgactaaatctgattacaagttgcactaatagcaagcataataacggtcattcagtactgaatcttgccatcttttctgaaaaatataaaacgccgaaaggtttgattcatgcctggggtgaggccgtaaattcggctctatcgacgaagttagttgttcctgtagaaaagttatataagggggggcattggtcaacggcaatgtcaatatatgacgctcaacccattgaattatgggttctttcagctggttttggactgttgaaacatggggatgctatagttccttatcaagcgacatttgctacaggacataaagattccatacctcttttttccgataaatatggaaagaaatcctttcatcaagaatggtggggaaaattaaatgaagcatccccattaaaaaaatctcatcctgtatccttatctgacttaatgatggataagtccgatgagtattttattatctgtgcatcacctgattatataaacgcaataaacatggatttaatgaaaggcatctcttacttaaaggatgtcgatagacagttaatcattatatcttcttcgcaggctaaattttctttgaaaaaaaacctattggtaagcaataaatcaatcgctgagttttttaacagtaatatgcttatgttaaatattaaaatagctcagtatgtaattgaacagtttatgagtatggatgatggccatttagggttgcttgctgagcgtcttcgttcaacattttcagtactgcctaaaaagcatactgttcgcggggtgcgcaggagaccagaagaggtaactatttggatttcttcgtatatacatgcaaatccagatggaagtgcttcccgggcacttcggtcatttcgtgatcaaggcaatagttttgaagagaagcggtttcgaacgctgtaccaggcagttttgttgactaatcgataatgtcgcagcaataagactatgctaaaatctcacgttttttgacagtaaaaggcgtcacaggagatcagtgttgtcgaagctaaagtattttttcccggatagtcaggattttatcgatcctagtttcgacttccttcgagaaacgcgcaatgaacatcgtgttcgccagcgtgacgacctctatccgcatgaggttttcccccacccttatgatggaatgctagtttcgaaagcggttgtagatggcttaggtcgcggtgaaagtaaatatacgcgagcacaacgattacggtacttccggaatggaatgaaacatttctttcgtttgccagagacgatgcaaacaatgggagactgtggtgcatttacttatgtaaatcaagatgttcctccatatcgcgtcgaagacgttattgaattctatgaaacatcccgctttaactacggggtatcacttgaccatatcatttttggctacgaaaaaccgggagaatctttctcaggtgaggtgctggcagaatgtcgtcgtcgccaggatatcaccttgactctggcgcaggattttttagttaaatcgcagaagagttgcttcacgccctttggcgttgcgcacggttggaacaaggcatcttacagacaatcagtagaagcactgctggctatggggtataagaatatcaccatgggggggatggtgcccctgaaaacggcgcagatccttgaaaccttggaagagattaaaccacttctcaaaagtgatacccgggttcatctgcttggtattgcacgtccggagagctttacggatttcattcgtcttggtgttaccagtatcgactcaacaaccccccttcagcaggcgtttaaagatcgcaagaataactaccatacgcctgagggacgggcttatacagctgtgcgtgtgccgcagttcgatgccaaccctagtctcagtcgtaagataaaatctggcgttattgaccaggatgtggcgcgtcttctggaaaaagatgcgatgcatgccttggttgaatacgataaagacgcgttgtcgctagaaaaagttctggaggctgtaatggcctatgaacgtctacactcgggtgaaaaagaagcggagaagatccgtgccgattacgaacgtacgcttgccgaccaaccttggcggaagtgccagtgcaatatctgcaaatccattgggattaacgtgattattttccgtggcgccgagcgtaatcgccgtcgcggattccacaatattcaggtgctgtacagtcgcttgcagcacacattgtcattacgctcagaggattaatcatgagtgagtttcgtgtccccgccctgcgtattcgtcagggtgagaagagacagctttacagcttggccattgaaggcaaacaaatcagcaaaattgctgcgatttcacgcattcgacgcggagatgagaacctggttggttatcagcgtccggaagtacgtagccatattaaggaaatccagcgctatattgaaagcgcgaatccgatgatccccaaccccgtcattatcgctttcgatcagcgcgtacgctttgaaccgctgctggaaaacagtgatatggggcatctcgttattccgtattctgaggaggcaaacttcgacaaaccggggtttatcgttgatggacagcaacgtacagctgcgttaagagaagcggacatcaactcttttatgatgccggtatcggcatttatcgccaatgatgcagaagaacaacgcgaacagtttatgctggtgaactccaccaaaccgttgcctaaaacgctgttgtacgaactggctccgcatacgcatggccgcttgccttccgatctgcaactgcgcaaattcccttcactgctgacacagcgtcttaactttggtgaggggccattggctgggcgaattaagactgcgaccaacccggacggagtgattgctgacaactcaatgatcaaaatgatcgactctagcctacgtgagggggcgttgtatcgcttccgcgattcggcgactggtttgggcgacgaagcgaagatggtgaagctgctgaataacttctggtcagctgtagaaactgtgtttactgacgattgggataaaaaacctcgttactctcgcttgttacacggtgtggggattcttgctctcggtagcctgatggatgaaattgatcaagtgcatcaggagtacaaaggggaaccaggatggaccgagatcccttcctattcccgttttgtcgaagagttacatcgtatcaaaccgctttgcgcatggagcagcggtgtgtggaatttaggcacagatattgatggtcagcctattgtccgtaagtggaatgaagttcagaacctgtcgaaagatatatcgctggttactaattatctggtcacaaattatatcaaagcggcgaacgcaaccatttgaaaaaggggcgaaagccccttatttttgtctatgagctcatgaaccaagtcgtaatgcctgagggaatttatcctgtaatattcatggcatgttgaacacgggcgatgaatgcattcagaattgaacccgctcctttaccttcagggtaaataagatcgcgtcgatacggtgttaccgcatacagagcttgatgtttcgcgcttgaggcagcaaaaataaagtaatccgcctgttttgccaaattgactaacttgtccgtcgcggtatgatcatgattcacatctactttgattccctggaacaacgtctcaatcatccctcttgctcggcgcgcagcgccttcagtcaaggtataaatggcgacgcgttttcctgcaagattcggaagtgtctcaaactcactgtcatcacttcgtggtggttccggcggaaacgcagaatcggcacccctgcccaatacgtcgatggccagattacgcatgatcgtgcgggttgagtgatctagacgcggccacacaccaacagcacaagcttgaatattcatccacagagcgtttctaacctctttatcgtgttctggtgcatccaggaacagttcgatcatctcgccaagtgaagttatatttttaagcgaaccgcagcgttcaataatgagttgcagtgtcgcaacaaattcctgatagtcagtccgactgagagaaccttgaaggaaatgctccgttgctagcgtcgccagttgaatatctgccggactgacactttgttccatcgccagaacatccatccatttaagccaagttgagctcattaaaagcacttggtttttcctcagccagttaatgaaggccggcatagcattacgcagggtgggaaatgcctgtggcggaatattctgtgacagtaggcgaatgaatgtggattcttggaaggaggaggtggaccaatgttcgctttccagagcgacaatctgcaacagtgcatttccatcagcgttgggattgcacagatgtgagaaccaactatcccagccggagatatgagtggtagtaagccgttcgatactttcaatcagcgttataagtagtggaactttctttgcttgatctagcagttgtatatctatgttgcggagtgtgtcggcgtatgaattcagcgtgtcggttgttgccgtcagcgatgtttgtagataagaggccagtgattctagcgatgtaggaggcaaagagaatgagactggagattgtgtcgagatatcgtacctaattcctctaaggtcggcccactgctgtaattcttttagccagttggatttcagcgcttttggcagggcacttagcagggttggttcaccggctagcgccactccgattgcccaagttttccagatgttaagctcttcctcttcgtatcccagcagcggaacctgcataaagagcggatgtagagaaaggaaagcggggcgcaatactgagggggcctgctgcgcgtagctctgcatatcataacctaaatagcggttctgataagcagtgagcagcattctaaccagtgaagtaggaatgcgtcctctgatcagttcggggagatctggatggtttagcagggagtcccatttctgccatttcccagcctgttgaagttctagcaacagcaaattgcgtttagacagcagaccgttgtcacgtagttcctgtagatagctgtcactggccgctatctcattttgattcgttgccaacatgaaatcgctaaggatacgaccaaacgggcgcttgcgggtacgaacaagcgatggacgttggcgaaataacgtaattacttccgtcagtgcagtaaaaacccgcattttcgccagtttatcatcacgtttggcggccaacaattcaacacgaataaaccccgttgggcagtgctccaacagtatggtttccacggtgagcgtgggaccagaagcgggactcaggtaaatcctgcggtcaggttctacatcagcagaaccgagtcgggctccgatgacgttactgagttctaacagagtgcgctcatcttccgccatcgcaaagaaaacccagtttttgcggtcacaccacggcagaataatgggccattcgccatctcgtgcgctatccaccaaaggtagcagggcatttttttgctcttctggataagcaccaggtccgtcagtcagtaatttttcgaggctgagcaaattgccttcgccgaaaaaggctcgaagccaggagggaacattagtcatctctgtctccgaatgtatattgtccactgagctcaattagtgtgtcagaaataatggttttattggtggagaacagcaaatgttcatcattgaggtttgcaccactccaggtgtagttcatcgaacctctcaagaggaagtgctttgttaacatatccttagcatgcaagttctcatggtatgtgtattgcacatcatgatccggagagagccttgccagcagtcgttcaacgaacactttgttacgagtatcagggcgagtgacaatcctgagtggacagccgttatttgccgctgtagcaagcaattcctggaaactgatcattctggcaccccacgatgggtcaagaaaactccattggccgccgcgattatcaatgatgtcaaaatcacttatccagggcgagatcaaccagatgagttctggataaaggattagtccacagaactgtgcgctcagtacttccctaagttgtcgctgtccgagaggtccgtggagaaatatttgtcgttgctcttccattcattgctttccttactgcagggcttcagctagttcgattcgcaacacgatgttaccaccccgatagtctacggctcccattcgtggatagagatgcaggccgaaataatcgataggctccagttgtagtgtggacacgatctgtactatctgataacgggtttcccgagggatcaacagttcagcaaatccttcgcgagagattgctatatggatctgctgaagccagtcgctattggtcacatcaacttgtgttgcttgctgctggaagagagtgctgagcagcaatctttctgtcagtttcggcccattatcaaagggattgtagtagctgagtactgactgacgaaggggactgccacgctgccataacatgccctgaatctggcaaaaacggtcgaaaattttggtgacgttcgcatcaggcagttcctgagttgcttgggtatgggcgaatatatttaggctaacttcataacccgctttggcctctagtgcctgccattcccgcagatactctagcaagcgccgatcgtgagaggagtggctgccagggcgaagaatacgggtatgtagcacggacataaagctgtgagaaagagcaaatccttgttttttcagctgagcacgcagttgtccgttcgctgttcggcgatcgtgatgactttccgccatgcgcaaatcgttcagcgcattctgtaatgtagtgcttgaaggaagtcgagagagtagttcgaaaagatcatcatctatttgctcgtaatcgctggcggcgaaactgcgtataaacagatttagcagggcgactggatcgctgtggaacgcttcttcgaggcgggtgataattccacagcccccaggctctgattctgtgagccagatatcgaggtgctcgccatcaaaaacggcgtcaacaagcaatcctttgtcgtccacatctggtagcagtagatggccggtctgttttacggctccggagaaggtattgatcaacaaggtctgaagccactgacaaaatgaataactctggctgagatcttcagtaaacacagcactatgcgtatcaagcatcgcgagaagctgcggctcattgaacaggcttctcaactgctgctgtaactcttgacgttctgcaataccgttaccatcatcgtcgttttcaaagatattttcagcctggaatagtgaatcggcaatggttgccagcgactctctaccgtccggcgtgcgcagggcatgaattgcatcggcgacggtattgtggctgacgatctctttagtcagtgccgccagatagcactcgtagatccagtctgcagtgaagctgtcatgttcgaaacgcgcctcactgctaatgcggtgatggaaatagagcgtcctgagcgaactggctaatttggcgtcgttcatgacctgctgatgtagcgtggaaggcagggtgaagctcagcttcagaccatccacccactgacgagtacccaccgcaaccggctgaccattctcaacccatctgaaattaacccaagcctgttgtttgcttttactgcgcagcgaagcactagcggctgtggtataacgcgttagctcaagtggtgtcatatgctgatgggtatagaacgtggcggactgcaacactgtgctccatggacctgcgggaatcgccatcgtttcggcctgagcatttgtggcaaagtgagtatgccacttcagctgagaattgcttttctcggtcagattttgtttgaaatcaagggcccgagtaagtacctgcagaggacgaataactttcattggtggcgcatccgcaagcgtaatcaaacactcaggcagccaggtatcaccaaatgcctcgttgatctcgaaatcgacttctgaaacttggtttagtaacagaacaaaattgtgtggcaccagccagtcggcttcaagatcggaataaatggcgtagcgtttggagatgcggcccggtgcaaactccttcagcccctgaataaatggtaggtattcatgttttgtaaaagggcgctcaagctggatgctcagctcaggcaaattcagctcgctgaagagggctgccggaataaacaaaggcagcggtgagcggcctggtgttctgtctgcgccgggaatgcccatcagtgaccattgggtagtcaactggcgcttcagggtcggaagtagttccatcataatggaacgcggcggtgaccacatgatgtgctgaagctgcgattcggtaatttttagcgcgtagaacaagtactgttccagcccctgttgccagacgttttgttccagcacgacagaaatcagattgagcatctgttccagatgcccgtgttgctctctgtttttgggcggcttgtttagcagtgaccagatgttactgccggggatcttcatactcagccagtccagggttgccatcgccgcctgcattttctggatgtggatattatctaatggtagtgattggcccttgatttccggtgtcaccagctcttcataacgctggtacaccacgcggtcgcggccgaattctgacaacactactatcatccaagggcgcatagttcttgaacgtccggcgcgacctttgcgctgaagataagaagcgacgttacgcggtgctttgtgctgaatcacaaccccgactgagggatcgttaaagccaacttccagcgaagctgttgccacgacaacttcggctttggggtccaccccggtgtcctgactggaggtacgcgctacgatagcccgatcggaattatcaagcgggtgtccaatatcaatagctattcgccagttttgaccagcaagggtcagcgcattggatacaccgttgcgttcgttacgctgagccgccagcgggggctcgttgggcacaagttgcttcccgcgtgtacgccatccctcggcgtcgcaaagttggtgatagaggcgattattgatatccagatcgtcggtaaagacgaaagttttacggccccaggtgccgtgcgatgtggctttgcgggtatccattagtcggcgcgccaacatgctggtctggatggtggtagagagcaaggccgtttgcgaaacagggtcaccccgcagtgctaacaggtattcagcccctttatcctccatctcttggtaagtgggctcaattagcatgacatgttttttgttggcgcccactaagtctgcgaagaagcgttctgcgtcactcagtgttgctgagaggccgacaaagtgcgggcgacagcgtgccagttgcatccagcggcgtagcaaatatgcggtttgagcaccgctattgcctgaataagtatgaacctcatcaagcaacaccatcggcggtgcaattacatttatgcccacgccgaacaagtggttggccttgttattgccgaggtgttggttaagcatttcggtcgtggtgaacaaaatatccggtggattgttcattagtgatacacgagtgagcactacttcgtcttcacccacactatgtgtgcaatgcgtacagcggaggatctctttgccccggctgatatcttccgctttccagcgcatttcgccttggcatttaggcgtgttacagcgcagtaagtcgaaaggaatatctttgtctttatcaatgtactggatgctgtggggggtatcgccaaagaaagatccgatgcgtattttacgtccagatagttcaactgactgagcgtccacttctcggcattttccccaagtttccataaactggtctttgagtagttccttacggggatacagggccagcgtacggacccgtgctgaacgatcgcgttgcaggtcattgatgagcgaagttagtgcaggcagatagaacgccagggttttaccgctgccggtgccggcacatacgatcgtagccgttgcttctttgacgcgcgtatgattgctatggaaatcccatgctcgcaggatgcgagcagttgcccgggattgaaaaccagcaattgagaaatcaccgatcagtgctcgcaaggcttgacgcttgatgtcattcatccattcgacatcgctcaattggctcagaaccttctcagccggatacttcctttccggatagcttcgagggcggcggataaaacgataatccgccaccaacgtccgggtacgactcagttgctgaccgcgaaaccactggcgttggtgacgaaacagatgaacggattctgccattcgcgtgcgataaagttgcgtacctttagtatttgggatgctaaacaacattgcggcatcctgcagatcctgcatcaatattttgccattttcgtcgggaaaatggtgggtaaacagagacagaatatcagcatctgtaaacgcgccttccgtgtctccccagaccagcagttcggcttctcgcccttcgagtacatcaagcgccgcgtgtagacgagctaaatcctcagcaatcatgtcgctatttccttgtaatcacaaagtcttccaacatgtcttcatcacgcagccactcaaaaacttctgttgtaagtgtgctgagggttggtttgccattctgtggcccgttgattcggtcaaagaagtgttgaaccgccaaaggccagtcggttttcatcatgccgcgtaaggtgttcagatgttccgccatcgagcggatctgagtaatgctgtcgccattctcaggtaaggactgaaccagtacatcgaatttattgcgtaagtttgagtactcatcggcaatttcttttagtttgccgactttctgctgagcctcgagagttttgttgtcaacatgaatctgttgacgcaactcttgctgccactcttcccatgcgttgttcagttggccactaagtgtacggtacaggccaagtgacaggttcatgcagttggttaaggagtcattctgaatgatgtcataagccgttggctcttttgtagtagagtcttcgtccaactgtggatcgggattttcggtgctgatggcagcgccagccagagtctgatttttcagccagcgactccactgggacagcagattattaacgctatttgcagcgtttttaagttcattacgctgattttcgttccaggtaactcttaattctggcggcagacgttgcagggccgggtactgatacttcagacgactataatgcccagcgactgtatcggttttcgacagtaccacaccgcatttttcaataattagcgtggccttacttgcctgaacactcaaatcaagttgtttctgcatgtctgcaagctgttggcgtaacgtactcattcattcgctccagaggcgctgatatcagccgccagatttttcagtcgctcttcaacctgcttgcgagcattttcaagttttggcgcatcacccttactgtttatctgttgcagattaaaactgattttcgattgaatattctgccactgtgtaagcaggttgccgatgcgattgacataatcgccatccagatgggagatgtcgtgccatagcatgaagacatcctgttgtctggtgagggaattaagtgtttgcagggtatgtaggctggcttcagcatccactttcagtgcaccgatttcatccaatagccatgttgaatttctaatctgttcggtttccgctggatagtactgggtgcgaaccacttcgataaacgttttccagtcatcgagaagggcaatgaattcatcctgatttttcacatcctcaaagagttgtgcattcgcgatcgttgatgcgatctcttttctggctgtctctgccgcgcgttgtatctccgcacccagcggctcttttaggatctctttcaatgcgagggtgacaacttcggcttccaaggctcggattgaactgagcccagaactcaactcaggaactgcgacctgagaaagccacgcgtctcgcgcctcgtcccagccctgaagggcaacttgccgcgcttcagccactttaatgctggtgtgaggtttttgattagcttcaagcccgtagaaacagagagcggaaggggtagtgtctgctgtacgtcctcgggtttttccttgggttctgccaacccctttctgcgtcaggcaaagcgtatcaatcagttccgctggattctcttttcctgtcatcagtcccagcagtagtgctttttggtaatgattgcgcagtgcgggtttcaattttcgtgcgcgggcatgattaattgctttttcagtggtttgtgggacccaccaactgacaaagttttcataatggacatagtcttccagcgcttcagggtagtctcccccttgttcaagatcgatataatgttgaatacgcagtattgccagggacacgttgtagatttcgatcctacgtaacgggtcgttcagatctttacgatcgtagaactttacaatggcgttggaaggatcggaagctgaaagcggcaggctaattaacgggatacgctcgagcaacgagggcttttctaccatgccgaaaaactccgcttgggcgtagagctcataacaactgttaagtccggctcgcagatttcgggcaatatcttggggtaaaacgactttgtcgtttacccaagctttgagatgcctgataaaaggcagagtcgtattttccactagtggttttggctgtggaggagataccggtggtttaggaactatagctattttcttatcagtgtcgccatttctggttgaagtttcaggcattttgcctttgccgttcaggtgttcggctaattcattcagaccgaaagctttggcgacgcccggtgatagttgttttctgacttcatcccaggagtgacagttgtagccccagagtccggtcagtgtcgccgcgctggaaactcgatgggtagttaattggcttattttgtactgaatttcagcatccgtggtaatgcctgcaagattaggcggtgggaatgaaccttgttctgcttcaacacgacaatcccgcagaatatccaacaggatacggctaattactacgcgaggattgtaaacaagttgattgctgccgtctcgacagtatttatttgccagtgcccggatagcattgcggttaaatgggaacagcggaacgccctgtttggctgtactaccaaaatcatccagccattctggtacttcttcgtcctgccagactggaggccagtcatttaaaccttgcgctcgcgactgcttcagggctgctgcaccatgacgcgccgcgttcaagtagcgaccgcacagtgaaataatactttcttcacaactgtcgcttttatgtgtgctttcaatgctccattcatagccagccctcgttaccagcgtgccttgtcgacgtttataacctggatactcgttagtgaccgctatgaccgaatgtaccgggcagagtgttctcaccccgtcacgaacgccttcttcgattaggctatcaatcaatacgtcttcgatcgctgaaatagcagccatatcttccactaggattaccaggcggcgatcctgcgcaagtaattcacggcggatctcttgaaatagttcctgaaaattgccgccgttaaaggtgaagagcttggcaaataaagatttcagtgctgcatgcatcgcttcattcagaacatttacggcctgaactcgcgccttttcattatcatgttcatcaatacgagaatgtcgaatatattcgcgggcaagcgacgacaggtcatcaatgttgtcttggaaaaagaggtcgctaggcaccagttcgtacttgtcgtgatcctcatcactagcctttagcccatcgctcatacgactggcgcgtttgtagatgcaatgctccggcttgagcagattcagcttgaagttaggatcggttatcaggttgccaatgccattttcgacttcttcaataatggtattaatgcgtttatcaatatcggcaggaatctctttcccctgcttttcgtattccataccaagtgccatcgattcgtcgtacatgctctgtagttggtgtgacatcatggtcaatagcaggtcggcgaggtctttagcggaatgcgcttgggccacatcgtcaacgcgtttgcgcgcgtcatcaaaaaggcctccgtgcaggtttttcaggatcagtaacagcacttggcgcaagctggcgtttttcggaatacgaacaatttcccactgtgtaagctgacctttcgtctccaggtagcttttgagacggcagtccaaccagcgcaccagatgtgattttcccatccctgagtcgccaatcagtgggatagcacgctcggtagtaagcagttggtcaaaaagatcctcatcttggaggatctcctgattgttattgacgtcgcgacggatgagagccatcttttcatgcacagctagaagcacgtcatcctgcaattcttcagcttctttacggatgcattgctcgatgttctcaagggatggccagtagttcataatgctcattatgcgatctccctgagactaaccttgcttacggggcggatttcactagtgggaagttgcagggataacgattcggcatcatcacttccgaaagtcagttggatctgttggctgatctccagacgacggagcgcaagcgaagtgctggtactgatgtttttgccttccggtgcggaccacccccgttcggccatcatttcctgcactgtcactctaaaatcgccaccatccatcattggcatcgcttctgccatattggccataaaggctttgatgggcagggttttctggtcgccaaaaatttgcggtaaaaagcatttaattgcccgggtaggatcagtgtaatatttttggtctggagctaattccaggaagccaaggtagcgaccatattctataggtaatttttcactattactgttgatcgttcctgctggcaaccatttatgtacatttttagcaacttcagttactgaaagaggttctgcccccatcaatgtatgttgttgcaaacttagcaaacacgacagcactcgccacataggttcgcactcattcccttcggcgatgcctttttctttgcaggcttcgatggtgcattgcagcactcgctgatagagcggacgtgtttcttctggttgcggtagtagcgcttcattttccataggccaaagtcccaaacgacaccagaaggcaaggttctctctaatctttccccaggcattgtcgttcgcggggagattgtttgggcgatagcgagctatgatcgcatcctgagaaagcgaaacacgggcgttttgtacaatgcgatcaaacaaagggagcagcaccaggctgctgccagggttggcattattgatgattgacatattgtgattgcctgataaaagtgtctaggggcagagagttttctgcgctatcccaccattttctgtacggatgcagtggatctgccagatgctgcggggcgataataatacgttcataacgtgaggctggtagtgtcggtagcactgtggcggtatttgccacgatcacaatttctgctccgtttgacgttggtgctgcaagtttttgtacgctccagaaacgagacacagaatctaaagcgcgttccagatgaataaagttaactttatctgctcggatggtttcgtaattgccggaaccgatcagatggcgaagggtaacgcgaagttctgacagcaaagttcgaatatccatttcttcgctgtaatacacttttttttcagctccaacgaagcgtgcttttttctttggtgtcgattgcaagatttttacatcggtgccaacggttggagagaatgaggccttgccctgagcccggcaacctgggcagcctccacaggttagctcaggttcattattttgataaatataaaattttcttaaaacctgacacaaagatggttcgagatccttcagccattctcttaacaacgtaaaagctgcttgcctcttattcaattcttccctacgggctttttccacaaagttattccagtactcttccgaaaggtgtgaatcgttgcagtgacgaatatgtacttggctataataattggcaaaccaaccacggatcgcctgatcgtttttttctccaccttctcgtaagctttccggtagttcaggtgcagcaaacaccagttcaatcagtcctgtacgctgcatcagtaagagggttctgcggttccaggcttggttgcgatctccctgatagtcgatgtaatcgggtttggtatccagagagatacaatagttggcgatatcacttggctgacgttgttcaaacatcgctttccagcgtaagaaacctttttcgacgctgatgagtttttcaactgagagattttccgccgtctccatctgcgctggatgccagaccagatgtgcctgacacgctttgccgtcacgccctgcacgtccgcactcctgatagtagcgatcaatattttccggaacagcggcatgaatgatcgtgcggacgttgcttttattcatcccaacgccaaacgcagaagtggcaatcattatatctagttgatcgttcgcccattgtgaaattagctttctacgcgtcagcgtttccgtatcaccatggaacaggccgacacggtgatattgttgtagttgaagtcgttgataccagctttctgcttcttcttgagtcgtgcaatagagaatgagtggacgtgggagtgacatcaacaactgttcaacacgttgcttatgtgaggtcggattaggctcggtatgcacgaagtattcaggttcgggacgcaggaagttcgccgtgatttcaatgagttcactgtcatctgcacggaattgctccacaatgacgtcacgagtgttctggctccaggtggcggagagcagcagggtgcggaaacggcaatcaggctgggctttcagtgaacggatcaatggcgcaatgagctgaaagtcagggcggaattcggctccccattgatcaattagatgtgcttcgtcgataatgacggcaccaatcagattattttttgccagctcaaatagcaccggaaccagcgatgatttagctgcttccggtgagcaaaacagggctcgctgggtgccgtttttcagccgctctttcagtgtctggcgcgtcgtctgatcctgcccgccaacccacgcgtagcttccgccatgatcctgttcggccttgcgcagcatatcccgcatcaaatcggcttgttcaatcgccagtgctactgtcgggacaatgactaaagttaaggaacaggcaggagcgctgatagcctggatttgagttatcaggcttttgccgcaactggtaggtagatttatcaccaacgtactgttgatgtctgaggtgagcaacgtgcggattgctgcctgctgcccaaagccgcgatagtgcgtatgtggtgtatctaccagcaggtttttaagcgccggatccatctccggttgtagtaaattacgccgggttctgcattggtaagtagcttttgtgctatctaggtgcatatctacagagagtgacaacgtctgccctgcgactgattttaccagaccccaaagaggatggggcatatcctttattgttggtggagaggggagccacggttcttcgatgccattcgcctgtgcggctcgaagggcatcggcgtaaccagcaaaaatatcattctgaccagcggaggaatcggtaataatattcattaaccgtttaagaaagggattttcaatcccttccgtaaaggtcacatcttcattaaaacaggttgtcagcgccaactgtagacgcgaccattgttcaatcattaggcgactccggataaaatattgctgctacagatgatgatcgcttttactgacattaactggatataagcgctgtctccgaccaaaccacgctgtttttgcaaagctttatcataaacctgctcgaccatttctttccaagcatcagcggaaatcagttcttctatttcctgccatcttgaggcgcgcaggttgagatcaacatagcttttcgttgctgaaggatttttgctgtactcgctgtttagtatcttaaggagttgtggactggtcacaagagaactgtcagcagcaacccactcctgcactatgcgtggcggtgcaagctcgtcgcttttacgaaggtaggcgtaagggctgagggggtcgcaaccggtaatgagccaagtcatctcgaagaagtagcgaggggcgttgagttgcgcgttaatcatacgcagcaatgccacagaacttccacgtgcatcttgattcaggagttgccaaattgcatcgacaaagggctgaccatagcgcaaaggatataccgctgtcccgtcaatagccgagatacgctttgcgctcatcagatgtgtggaaggagggtaacccccctctttgtcaaagctgagcatacaggtcgtgaggaatgttttaaagtcgactagcgtacctgaactgcgttcagccagttcgaaacggaaccgtatgccctcttcagtatttcccgatgagcggaagcgtaatccctcggtgatccagagcgtcagggctttgctctgttctacagcggttaggtcgtcattgcttaactgctgcgcgaaaagtgcagcttgcacgacgtcttcatccatcgccagcagtttttcctgcatgttgattttgttagtttctctgaacaacacgccgttttcgcctggcaattctgtcgcaaggttttctagtacttgtggaccttctcggaacaacctgctccaggcatcgccaatatagtcatcaagcacaaattgaaggctggcgatagtgttgttaaatacgccaatgctgttcaccagaagatctgcccacagattacgtaaaccttgggcagcataattctttagcaaaaggctctgaattggtttgatccttatcagattggcactatagcgattgaggcgcccaagtcgctgctcgatacgactgcaggaacgcggcaagccgtagtgaacagccagacggcgccctccatggagattcagcccatcctcgccacttttatcgcacagaagtacccgaatggggctttgcggttgggtaaattgcaaagtttgacccggtagataacgttcaaccggatagtccaacaggatacttagtttgaccgacagatgttgcgccaactcagggcgatcgcagaacacaattgctttaccctccgggaattgcttcagccagtcattgagtgctgcagctaacatattgtcgatggcctgtagttcgtttttggccgttgagactatgtgttccagcaatgcctgttcatcggaaggaagagggtttgaagatgcaagagtcgcttttgcacgctgcatcacgcacaatggactggaaaatagatcgtcaacccagtcgatatagctcgcttcttttagcgaccagttatggttttgcggcagcactgccatggcccgatattcttccagtaactcgtccagcgtcagcccttcggtttgccagtgatactcaatcaccccatccagtccagggaatagcagatttaaattcaggttcttactttcgtcctgactaagggcgacttggcggcggtttctcaacaaacgatgatggattcgataatgttcaccaaggtgcaggcgtatcgctttaatacccgcttcacgctcaggcgttggctgagagaatctgccaattaacggaaacaagtcctggcacagcgttgttaactgatggtcatccggaaattgcgcaagaatttcatcaaggttacggcggagactgatgttagacactgacggtacaagggccgagaaaacgccaccaagactttcacggtttttcaccaattcggtgaacgcctttagatggttctcgtcaatctgataagcctctggattgatacaatgcagcatcgacaggaagttacgctcatgtccatgaagcggtgttcctgtaagtagcaacacataatgtgctctgtggcacgcctgtgaaatcaggccgaaattatggcgttcgtcttcatctattgaccatggccagtttgcaatttggtggatctcatcgacggtaaccagagatggtttgaatcctctgctaagcagaaggctggcttcagtataactgcagataactatcccttgcgcgatcccatcttgccttaatgaagagagtgttgtcgtcacatctacgagcaactgtctcagctgaaaacgttcacccaattcttcccgccactgcttaacgagttggttgggtacggcaatgagcatgctgacatgactggcttcttctagcgcgtgttcacgaatgatcatgcctgcttcaatcgtttttccgagccctacttcatctgccagaatatacttcggcgttttatcttgcagtacgcgccgtacaacagctaattgatgaggttcaagttcaactgcgctgcttgaaagggaagccattccccgacatgacgctcgctgctggatatacgtattgataaaggattgacggcgagggaagaaaaacggagcatcattcgtctgagaggcaaggaaatgggccggattaatcgggatatcagaggctttattgagaacgtagactttatcgatcgggagagtcgcagattcgtcttctcgaaagattaccagaaaatcgccattgggacgggatccgccaaaacgcgcgcgtacccatcgctggctttctggttcgatacaatatatcactgcctcatcgtgaggaattgtcggaatcaacttatccagacgagtatcagtgtgccgggcgaaaggttgcaagggggactcaaaaaatgcaactgttgcgcggttggcatcaatatcaacattagtaactttgccaatgccgtcaaaactatccgaaataaccaacgacccaattggtaatacactcatccacacaatccttgaaaatgctttctcagacacatttgattgaaaaatgtacagtcatgggatgcgattagagattttccacgtctgagtgacaatgtaagggaaagcaaaatttacgtacatgaggatagaatactgtgataaaccctatattcaagtagaaaatgtaaaaaatctctttggtttcacagaacgtaaatcaatgtggttaaacacaataagatatgtgaatcgccacggataatctagacacttctgagccgttgataatataggttttcatattcagccggtggcatctgctcgctcgaaccatgccgacgcttactgttataaaacatttcgatataatcaaaaatatcgcttctggcttcgtctctcgttccgtagatacttttcttaatccgttcgcgtttcagtagtttgaaaaagctttccgcaaccgcgttgtcatgacagttaccgcgacgactcatgctgccttccagagcgtgcgatttcaggaacgactgccactcatagctcgtatactgactgccctgaacagagtgaaccagtaccggctttgagggttacgcctccacaccgccataagtaatgcgttcaggataatctcttttatcatgcggggttacattgaccagtcgataacttttcgggagaacaggtcaaccaccacggccagatacagccagccttcgtgggttcggatgtcggttatgtccgtcacccaacgctcatccggtgagtccggattgtactgccgctggagcctgttggatgtcacgatgctggcttcacctttacgtgcacgtgggctacggtacccaacctgagcttttattccggcacgcttcatcagccgccaaacccggttcactacgcactgctgtccggtatcacgcaaatcgagatgtgtcttgcgataaccatagatgcagccagacttaagccagaactgtttgatctgcccggtcagcatctggtctgtctggtgacactgtgaatgtggctgcttaagccagaaataaaatccactcggatggacatccagaaccctacagagcaaacgaacaggccagcaacggctgttgtcgcggataaaggtgtacctcagtcgtacagctttgcgaagtacgccgcggctttttttaatatgtcccgttcgtccgtaatccgcttcaactctttctgaagacggcggatctcggcctgagcatctgactgttcattatgagtggaagaaaccggaccgtacttctttatcttggcgtaaaggctgtgagtggtgatatcgagacatgttgcaacactggaaacagaatgaccacgatcaacaacctgtttgactgcttcaattttaaactcttcaggataacgcttaccgctcatgggcacctctctttaagtcatcttaaatgactctgagatgtctgttaaatccgtggcgattcaatgaaatttaatttcaactactatttatggtattaaattatttcgattgatgttttgtattgagattttttattattttatgacactatttgatatatgctaaatttttatgatggcggttattgaaggtgattttttattttaattttatgtttaagcatttagatagccacaatttagttcttggctatctaaatgagtcactacacaccgcgataaatacatcccgcagtgcatgtttctttcacgactacagcacttagtattggtaacagaggcttaacctgattccatacccattcagctaagacttcactagttggattttccagacctggtatatcgttgagataatagtgatccaaacgatctaatgttggtttaaaaatcgctttaagttccgcaaaatcgataatccaaccggtatttttattcacctctccagtaatctcaaggcgaaccacaaaagaatgcccatgtaggcgcccgcatttatgtccgtcgggtacattaggtagtcggtgtgcagcttcgaatgtgaaatctttatacagggtcgttttcatagttacctcgtcttttgttataatataacaaagtaagttagggataggaagtgctacgatcttagtgacgtggcgctagtgttcattaagtagttcatcttttgacgacattactgctgattagcaactctgcataaatagttaggctcctaaagatctaggttagagctagcaaactagcgtttatgaagatggataagtttgtaagttgatatgggttgcaatatttagtctttgcacttctctccgagagatataactttgtctagtaacgccactttttggcgctattgacgttcgctcgattaacgaataaccatcacggatgttcctattcttcaatctctgaatcacttaatgcttgccgtcagtaatttgcaaagtagcctgactttctgacgcgatttgctggggttgcagcttcatgctgagtgggataccggtgcttaccttacctgtggggacctttggatctgtctttcttatgacgtatcacgcaactacgtagccacgcaggaaggcgactacacccactatgcattcagcatcgcgccagaggattttgagtcgttctcgtataagctgaaacaggcgggagtgacggtctggaaagacaataaaagcgaagggcaatctttctattttcttgacccggatggtcacaagtcggagttgcatgtgggagatttagcatctcgactggtgcaatgccgtgagaggctttactctggaatgcgtttcggatctggaaagtaagcacgcaactttgtgatcttccacccagtattcaattttatgtcccattctgggggcaaacccccaaactaaaatctcataaccaatttattttcaacaaattaaacgaaaaggcgagtccagccttcgcccccactctcaagcatcaatatcaaaacaaccaataaataatccctttaatctaacaacgacgaatcattgatcaaccacgaaatcctctccgaaacacagtcacaatccctaaaccctacgctccacattaaaccccacacaccatcccccctcatcccctgaacacctcccgccggtgccatgccacaaacccttcctgcggatagcattctttcccctgcggcaaggtaatcggcttaccatcaaaatcccagaacagcctgccaacgatgcccccgccgttcaccgccggcgaaacctggatgcgcatatcctcatccagaccaatggatcctttatcaaaagccttatggtgaatcgcgcagagcgccaggccgttagggatttcacatgggccgccgtgctgcttccatttgatatgggccgcttccagggcgacggaggtattatcatggcgcatattgaagccgcagatcgcgcactcatagttataggcgcgcagcacctgctggcgaaaatgcgggtcgcgctctttacggatctgctgcagatcaaatcccatctcttcagccagttcttcctgaatactctccgggaaatgcgcctcgaggatcagatgggcgagggtattgatcagcctcttatttttgttgagtaacgcaaaatgcggctcatcgaagccgccggcgacgttacagagctccagctctttgccgggcggctgtcggctgccctgggttgaacactggtcgctgttgtgcagctcccagaagccgtcgcctttcaggcgccagaagggcatatccggccggtactggcggcgctgcgggccaaagcgttccagcaggctatgcagctcatcgcgtatctccgaggcgtagtcgaacatccgcgcatggccgcgccggtactgtgagaggacgtacagcagcaacagtggcttatgcggcgcacgctgttcgcctttgcgccagatggtgatgttttcgatcgcgtgttgcagggtcgtgctggagggcatagcgttacagtggcagctaaataaatgcgatgatgctcgcaaaatccttgccgatcaacccaccagatgcggcgattccaggtggatcactttttaagtattacgacggatcttgctgtgggagtggagaccgcgttcgccgcctgcgacgcaagcctgaaaaaatcggaagcgcataaccgttgcgttcccacagttcacaaaccccacgctacctcaccggtagcgtgggccagctttctcttacttatcccgcgtctcgccagcctcccagctgtagctgccatcggccgctaacctatcgcccagctcctgatactcgaactgataaaactcagcctgggtgccgtacccggcgtagtctaccgccgccaggccgacgaacgccccggtaaagaacccgccgtagctctgcaatacatagtcatcggacagtaccgcggcatccagctgaaccgggatctcggtgaaggtcacgccatcgaagctatattcatagctgtaggtctgcttgcggaccttggtccggaaccagacgtattccacgccgtccggcaccatgatggcgttatctttcaggtacgacgtgtattttccgcggttattttcgccgacttcgatgaccttgccgttaatttcattccaggtcaggaagacgaagctccagtggcggtcgttatagtagtttgttaatccggccatctgctggtagctgaagggttcgaatttcaccttcaccgcggcgtcaaaatagaaggcctgccagcggcgggcaatcagcgacaggtcatgcgtattggctaacgaaccctggccgattaaggttaatttgccgtcgccggtggtgcccattttggccgtaaacggcactcgcagggtattccagttcgggtcgagcgctggcgaggtaaagtcatcctgctggctattatcgctggcgctttcggtgaagatggcgtctttcggcccgtcgacgaaggttttcccgccgtgaccgccttcaatacgcggccagccttcgtcgtcccagtatactttctggatcgcggtttcccggccgagggttgaccagccgcgcgggtcgtagatagattcccccgggcgattccacggccgggcgcagagcgaggcgtaataccattcgccttccggggtggagaccagcgcgccatggccctgtttctggatgtagctgtccggggtatcgacgttggttaagaacacgtcgcccggctcggtttcgaagctgtcggcctcgagggttttcgaccgcgccaccacctcctggtgggtaaacacggtgccgccctgggcggcaaacagatagtagtagccgttcagtttatagaggtgcggcccctcgaccagcgccacggcggtgccgcggtagatggtgcgcgcggtttccggcattaacttcagcgtcttggtatccagctccgttaaggtaatgccatcgaaggggtgatggtactcccggtgatcccaggtttgctggacgatatatttccggccatcgtcgtcatggaacagcgaggcgtcaaacccgacgccgttcagcttgatcgggtcgctccacgggccccgaatatccttcgccgtggtcaggtagttggtcatgtctttaaaggcgccttcggtgaccttcacatcggtatacaccaaccagaattgcccgtcggcccaggagagcgccggggcccaaatgccgccggaggaggggttgcccttcatatccagcagggtggtggtggagagcggcgaaggcagcaggttccagtttttcaggtctttggactcatgtaaacgcacgcccgggaaccactcaaacgtcgagttggcaatatagtacgtatcctcgacgcgaataatactggggtcggcattaaagccgcgtaatatcgggttttgaataagtgacatttcattacaccttttaaaatggaaagttaaggatcggtctgatttataatttttttaactacacgcggatctcatccagctgacggttgatgtcggtcacatgtttatcggagatcggataaacctgcatgatcaccatcgaaatagcggccagcgcaattgggatccacaccgcggtcataatgatcccgtcgatggcgctggcgctctgcacggcgccgctttcattaaatccatacaccgccagcagccacagcgggatagcgccgccgatggtgaagccgatcttgaagaagagtcccataatggcattgataatggcggcattgcgtttgcccgattttaattcgccgtacgcgataacttccggtaccagcgcccacataaagccggtggcggaggttaagccccactgtttaataaaggtggcgatgtaggccagccacagggcgtcgtgcatcccttcgcgggaccaggcgtaggtcagcagttcgccgacgatgaacatggcgaggaacagatggaagaagccttttttaccaaagatttttttcagtttcggccagaacaccgggaaggcgatgccgggaatagacgcgacgaggcccacggcgcccatccattcggagtggccgacgacgaactggttgaagaagccgttaacggtgttcatgaagaacatgaaggtaaaggccagcataaagaacatgccgagaataaccagcggacggttatgtctgagctcgtggaaaaggtcggtagttttgacgttggcggtctgctcggcggtcgcgaccacgcgttctttggtgcatttgtagcagataaacagggccaccgcgccgatgatcatatagatggcgtacacgccgaaccaggcgtagttcgctgacggatcggtatagttccccagattcagctcaaggccgaaaaagccggtatctttcaggctgcgatctttcggcgccgccatctgcacaaacatcgggaacagggtatagaccagcaggttggcgctgttggccagcatcatgcgggtactggtcagcttatcgatcgattccgggtcgcgggtcagcgacgcattcagcgagccatagggaatattgactaaggaataaaccaggtccagcgccagataaataataaaggcgaaagccaccgaacctttcaccccagggattggcgcgaacagtaatgccgacaggatcaccagcggcacgccggctcgtaacagccagggtcgatatttccctgcttttgaggttcgtttatccacgtaggttccgaccatcggatcccaaaacacattaatgatacggacaaaaagaaaaataaagcctgccgttgccgtgctgatggtatttaccgtcagcatatgcaaagccagaaaacccccaattgtgccgaaaaccaggttttgcgcaaagtcgcccatgccataaccaattcgttctccacgggttaatttatgatattcatcatgccgactgtgcattatgtttttactcattctaagcagactccggtttgttttgtgtaggtgaaacactttctgacacagttgacctggaagaatctattacgtttttaaattacgtaattatgtttttttacttctgtgatcctcgaagcaaaggcctgtatcgcctgcgttgaaccgttatccgccgctaattttttggcaggcgggcattgtgacaaaaccggcattttaatttggtatggatacctgaattccccaggaagtgtacgctatacgcgcgcgaagcgagatatttaaaatagttttatttgcgagatggctcacatttgagcattttctcaatcgccgagtgaaataacgtaattgagcaaccgacgatgagaatacacgatgtgtcacagttgttaattttcctgtttctcaatttcggagttcatcatgcaaacctatttcgaccaggtagatcgcgttcgctttgccggacccaaaaccgataatccgctggcgtttcgccactataatccggatgaaatcgtgctgggaaaacgcatggcagatcatctgcgttttgccgcctgttactggcataatttctgctggaatggcgcggatatgtttggcgccggctcgtttgagcgtccctggcaggccgcgggcgatgcgctggaaatggccaaacgcaaagcggacgtggcgtttgaatttttctacaagctcaacgtgccgtattactgcttccacgatgtcgacgtctcgccagaaggcgcgtcgctgaaagaatatctgcacaatttcgccatcatgaccgaggtgctggcggaaaaacagcagcaaaccggcgtgaaactgctgtggggcaccgccaactgctttacccacccgcgctacggcgccggggcggcgaccaaccccgatccggaggtatttgcctgggcggccacgcaggtagtgaccgccatgaatgccacccaccggctcggcggcgaaaactatgtgctgtggggcggccgcgaaggttacgagtccctgctgaataccgatctgcgccaggagcgcgagcagattggccgcttcctgcagatggtggtggagcacaagcataagattggctttggcggcacgctgcttatcgagccgaaaccgcaggagcccactaagcatcagtacgattacgatgtcgcgacggtgtatggtttcctgaagcagtttggtctggaaaatgagatcaaggtgaacattgaagccaaccacgccaccctggcggggcactctttccaccatgaaatcgccagtgccatcgcgctgggcattttcggctccgttgatgccaaccgcggcgatgcgcagctcggctgggataccgatcagttcccgaacagcgtggaagaaaataccctggtgatgtatgagatcctcaaagccgggggattcactaccggcggcctgaactttgacgccaaagttcgccggcagagcaccgacaaatacgacatgttctatggccatattggcgccatggacgtgatggcgctgtcccttaagctggccgcgcgcatgattgaggatggcaagctcgatcagggtctggcaaaacgctatgccggctggcagggcgagctggggcagaaaattatgagcgggcagatgtcgctggataatattgcccgatacgctgagcagcataatctgaatccgcagcctcagagcgggcgtcaggaattactcgaaaatctcgtcaatacctatatctttggttaatttttgctgacatgcccccgcgggggcatgtattccgccgtctatccgctgccgggaaatagcgtttattggttcgtgctgtgttttttttgtcagtggcgaaagaccacctgtttaatatcagcgaaggaggaagggtaacgataattgtgtaacgcctctgtgaccgtacaaaataaaaaataacttgttctgatgatagcgacatattctgtcagctcagaataggctggttattgtctgaataaaattaacctatattgagaaactcatgacaatgataaaaaagcttccattaaccatggcggttatcgccgcgttttttccgcttacctctgtaatggcgcaagaatttactcaggaacagatcgacgccatcgtcgccaaagccgttgataaagcgctggccgaccgccaggcgaaaatcgacgccgcggccgacaaaaaggtcgacgtgatcaccaacccgcagaccaccgccgcctcgccggatatggccattccgtttggcctcaagttcagcggctacgcccgctatggcgcccacttccagaccggcgaccagaaatatgtcggcgtcgacggctcctataacggcgcctcggcgatcggccgtctgggcaacgaaagcaacg

SEQ ID NO: 81 - DNA, 39172 bp, Unknown
  source: /note="Description of Unknown: KP2-Mcoc1 Bacteria Sequence"
cgctctcctctcgggtctcgtgggctctgatatgtgtatcagagccagatgcctcctaagcgcattccggtggcctgcgcggcgatcctgaccgccgcccagcgtacgccggggctgatggcgacgctctacgccagccaactccagcagcatgagcgggcgctgggcggctggcaggcggagtgggagaccctgccggagctaattaccctggtgggcggggcgttggcgcaaagcgaggcgctggtgcgcgacatgcaggttttcccgcagaaaatgcgcgccgatctcgatatcacccatgggctgattatggctgaggcggtgactctggcgctggcggaattcattggcaaagccgaggcgcatcatcatatcgaggcgctgtgccgccaggcgctggaccgtcactgcccgctggtcgatctgctcgcggctgacccacaggtcagtcagtatctctctcgtgaacgcttaaccacgctgctggacccggcaacggcgaccggcagcgccgaacgctttgtgcgccaggtgctggcgcgttatcaggagcaacgtgatgaatcttgattatcaactcgacgggccggatggcgcgccggttatcgtcctctccaattcgctgggcaccacccgggcgatgtggcagccgcagatcgaggcgttaaccgcacatttccgggtgctgcgctacgacacgcacggccacggtaaaacgacgaaaaatggcaaagtgaccctcgcccagttgggtgaggatgtgattgcgctgctcgatcacctgaatatcgaccgcgcctggttctgcgggatctcgatgggcggtttgaccggcctgtggctgggacgctttgcgccggagcgttttcatggtctggcggtcgccaacaccgcggcgcgcattggcgatcaggccagctggctgtcgcgggcgcgggccgtacgtcaggaggggatggcggtggtggccgccggagcggcagaccgctggtttacccacgcgtttcgccagaaggcgccggaggtggtcgaggcgctttgtcaccagctgacccataccgatgctgaaggctatgccgcctgctgtgaggcgctggccgccgccgacctgcggggcgaagtggggcagatcccgctgccgacgctaatcatcgccggggaaagtgaccctgtcaccacggtcggtgacgctcatttcctgcagcagcagatccccgcctccgaggtggtggttctggcggcatcgcatctgtctaacattgaggcgccgaaaagctttacttcagcgctgctgagctttttccagggggaacgccatggatgataaacagcgctatcaggacgggatggcggtacggcgcaaagtattgggcgacgcccacgtcgaccgtacgctgcagcatctgacgccgttgaatgatgagtttcaggactttattacccgctatgcctggggcgagacctggacgcgtccggggctcgatcaccatacccgcagcatgatcactattgccatgctgatcgctctcaatcgcgaggcggagctgaagatgcatctgcgcgcgtcgtttaacaacggggtgacccgcgatgagctgaaagagctgatcatgcactctgcgctgtactgcgggctgccggcggccaatgccacgatgcatctggcgcagcaggtgtttgacgacatcgacgccgcgcagggttgagtcgtcgtccgggtcggattgcccggcagtcgttgtaggccgggtaaggcgcagtcgccacccggcgaaataacgtcacaactgaatatttccctgttcgcgctgcgtctggcagggctacaacttctatgttaattccgggcagattgcgctcccggttgatcttctgcgttatgtctcgtatggcgcagggagcgcacagggggcggccagtcgccgccgccccctgtacccccgggctccggccagcaaaatcgccactgcgtggtaccttcgacttatccctgcaggctgcgggtcgggccgaggcagcgtccctgcaaaacacggccctcagcccgcatccatgcgggctgccccggccttccgggaacgtctcagcgattttgaggccgccagcaccggcagtttcagtcgcgcaagtgggtaaatgagtgacaggccgcacgaacccctaggccgggtaaggcgcagccgccacccggcgaaatggcgggtacggcgccgatagattgcccggcggcgcagcgcttgccgggcctgggaagcgaagatcgcctgtataccccgtaggccgggtaaggcgcagccgccacccggcgaaatggcgggtatggcgccgatagattgcccggcggcgcagcgcttgccgggcctgggaagcaaagatcgcctgtagaccccgtaggccgggtaaggcgcagccgccacccggcgaaatgacggcacaaccggaaatgtccctgttcgcactatgtttggcaggaccacaacgtttggcagggctacaacttctatgttaattccgggcagattgcgctcccggttgatcttctgcgttatgtctcgtatggcgcagggagcgcacagggggcggccagtcgccgccgccccctgtacccgagaaagatgaccagcacagcatagagtcgaacttcaatattgccgagatagcgccgccagtgctgcggtatggcgctacgtttttcgaggatccgcagcaggaaaaaacgtcgcacccgccgccaggcgcggaaggcgccgtagtaaaacagcgccagcagcagcgccccggccagggctttaccggcggagatgaacagatagcggttgttgaactgctcctggaggctggtgcgctgggcttccatacgcgccagcacccgctgggctgcctggtcgagggttaaatcatcgccctcgtcgagatccgcctggctcagcagcagcaccggtttgccgttcatcagaaacagtctgcctggctgaccatagcggataaccggcacgacccgcagcggctggcgaatatcatcttcggtgaaggcgcgcagggcgctacgggtgcgcaaaacgcgctcttcgggcgtggtctggccaaaggtggcctgcaacatgacgacaggttggtggaaaatcgtgaccgtgcgtgcctgctcgcgcgcggttggctgctgtcgcggttcggcggccagcgccggctggagcaccagcagcgccagcgcccagaggataacgatgcttatcctgttcattgaggcacctgagataagaattattgttatttttcagcaaaaaacggagggcttgtagttgagcatagcctggtgcgaagtgaattcaagctggggaaacgcggacataaaaaagccgtcgcccaaacggcgacggcctgatatcagcgtcagaggatagcgttagccgtgctgtttacagcccgcgcactgcttattctggatctgctggaagaagtcgttgcctttatcatcgacgaggataaacgccggaaaatcttccacttcgattttccagatagcttccatccccagttccggataggccacgcactcgaggctcttgatactctgctgggcgagcactgccgccgggccgccgatgcttccaaggtagaagccgccgtgtttatggcaggcatcggtcacctgctggctgcggttgcctttcgccagcatcaccatgctcgcgccgtgcgactgcagcagatcaacgtaagagtccatgcggccggcagtggttgggccgagggagccggaagcgtaaccggctggcgtttttgccgggcccgcgtagtagatcgggtgatctttgacgtactgcggcagcgcctcgccgttgtcgataagctccttcagcttggcgtgggcgatgtcgcgggccacgataatggtgccgttaaggctcaggcgggtggagaccggatgtgccgacagctgcgccaggatctcgctcatcggctgattcaggttgatgcttaccacctcgccttcgccggcctgacgcagatgctcaggaatatattttcccggattgctctccagcttctcgatccagataccgtcgcggttaattttggctttgatattgcggtcggcggagcaggagacgcccatgccgatcgggcaggaggcgccgtggcgcggcagtcggatcacccggatatcgtgggcgaagtatttcccgccgaactgcgcgccgaggccgaggttctgcgcttcctgcagcaattcctgctccagctgcacgtcgcggaacgcctgaccgtgttcgttaccttcggtcggcagaccgtcgtaatagcgggtcgaggccagtttcacggtcttcagcgtcgcttccgccgaggtgccgccgattacaaacgcgatgtggtacggcgggcaggcggcggtgccgagagtgcgcatcttctcaacgaggtagtttttcagcttcgccggggtgatcagggccttggtctcctggtacagataggttttgttggcggaaccgccgcctttcgccatgcacaggaacttatattcttcaccgtcgacgctgtagagatcgatctgcgccggcaggttggtgccggtgttaacctctttatacatatccagcggcgcgttctgtgagtagcgcaggttatcttcggtataggtgttgtaaacgccctgcgccagggcggcttcatcgccgccgccggtccagacgcgctggccttttttccccatgataatcgcggtgccggtatcctggcaggtcggcagcacgcccttggcggcaatttccgagttgcgcaggaactgcagggcgacatatttatcgttatcgctggcttccgggtcgagcaaaatcgaggcgacctgttgctgatgggagacgcgcagcataaaggcggcgtcgtggaaggcctgctgagcgagcagggtcagcgcctgcggctctactttcaggacctgctggccgtcaaattcggcgacggagacgtgctctttgctgagcagatagtattccgtatcgtcgtgcgccagcggaaacggatcctgataaacaaacggtttagtcgacatagtcacttactccataaagataaaaaccgccggggtagtcccggcggttatgaatcagaacatcatggacatccacggatagccaatcagcagcagggcggccaggaagatggcgccaaagatggtgccgaggcgccagtaatctttggtcggcaggtagccgctgccgtagtagattgggcttgggccagtaccgtacggggtgatgatccccatcacgcccagcgaggtgaccatcagcaggacaaacacttccatattcattcccgggatagtcgaggcaatggtcagcatggccggcagcagcgcggtggtgtgcgcggtggtgctggcaaacagatagtgcagcaggtagaacgccagcagcaggacgatggttgccatccccggggagatgccgctcatcagcgcgccgccctctttacccagccaggcgataaagccggtggaggagaggccgtcggccagtgccaccagggtggcgaaccagacaaaggtgttccatgccgctttgttgttggtgatatcgctccaggagagcacgccggtccacagcatcagcacgataaccagcagggcagccagcgccggttcgatccagtcggcggcgaagatccacatcatcagcgcgaagcagacgaagaccagcagcagaatttcattgcgcgacagtttgcccagtttttccagttcacgcgcggcccacagtggcacttcgttattgactttcacttccggcgggtagaaccagtaggccagcagcggcatggccagaatcagcaggatacccagcggcaggaaggcgatgaaccaggtgccccaggagatattgatgccaacaatgcttttgaccagcgccagggccagcaggttcggggccagagccgacaggaacatcgagctggtaatacaggcggcggtgatcgctacccacatcagataggaaccgattttacgtgcgctcggatcgtttggctttgaaccgtacagcggcggcaggttagcgataatcgggtagatagtccccccgctgcgtgcggtattagacggcgtaaacggcgccagcagcagatccgcgaaggtgatggcgtagccgagcgtcaggctgcgacggccaagatatttcaccagaatcagcgccaggcggcggccgaactgcgttttatcgtagccggcggcgaacatgaacgcgccgaagataagccacacggtggagttgccgaagccgctcaccgcccacttaaaggaggcgccagccattttgaagcctggcgcggccatctgatccgggctgaacagcagccactggctgcacagggcaataactaccacgccggtgataccgataacggcgccgggcagcggttcaaaaatcaacccgacgatcaccccgacaaagatagcgaagtagtgccaggcgtacggcggcaggccttcggggaccgggacgaacaataacagcacggcaacgataatcggcagcgccatcatcaggagaggttttttattcgcagtcgttggcttgactgcaccggcaggcggtatggttgtctttttctctttcataatgagtatctgcaagttgttgaaaataacgtttacgccagcgtcttgctcagtggtttctttaattacaaaagttactttagtttttattttgcgtttctgagtatcgacagggcgcttatttaacgcgttttatgaggcgttaaattaaatttgttggttatttatatattgcgctttcaatggccgttgcaattgatcaagatcaataaaagccggtgatttcactatttttttattatcagtataaccctatatgatgaggtgttattttggcgaaaatatcgatagatgttaaaataaaaatgaacaataaatgctgaaattattttatgttttattatctttatgattctattgtattttttgttgtttccttgtcattgtctatgttaacaaaagtatcctaattgttatcacgcatttgtattatgtaaatgctatttattattttaataatacaatagaggtagcgatgttattgctggggttaaatagttttataactaacgtaattggtttagtaattaaaaaacgcgctatattattggcatgacaacaggaattaaaaaaccaaaaccattaatgattccgtcacctcattctgagcttttaatattttaaaatctggagcgtaacttatgaccagtaacgaacgtattttgcagccatttactttaccaaatggtaccgagctgaaaaaccgtttgctcatggcgccaatgaccacctgcaccggttatttcgatggtactgtcaccagcgagctggtggagtactaccgcgcgcgcgccggaagcatcggtaccattattgtcgagtgctgctttattgatgactacggtctggccttcccgggcgcgatcggcattgataatgatgaaaaaattgccggcctggcgaaaatcgctgaggcgatcaaagccgagggttcaaaagcgattctgcagatctaccacggcggccgtatggtcgacccgcagctgatcggggggcgccagccggtggcgccgagcgctattgccgcgccgcgtgagggcgccgccatgccgcgggcgctgagcggagaagaagtggaagggatgatcgccaagtttggcgacggcgttcgtcgcgccattctcgccggtttcgacggggtcgaaattcacggcgccaacacctatctcattcagcagttctattcgccgaactccaaccagcgcgatgacgagtggggcggtagccgcgacaaccgcgcccgtttcccactggcggtgctggatattacccacaaaatggcccgccagtatgctgacgatgcctttatcatcggctatcgcttctcgccggaggagatggaggtcccggggatccgctttgacgacaccatgtatctgctggaaaagctggccgcccgcggtgtcgactatctgcacttctcggtgggtgccaccctgcgtccgtctatcgtcgataccagcgatgcgacgccgctgatcgagaaatactgcgcgatgcgctctgacaccctcgcccaggtgccggtgatgggcgtcggcggggtggtgaacgccgctgatgccgagcagggcctcgatcatggttatgacctgatcgccgtgggccgcgcctgcatcgcctatccggactgggcgtcacgtatcgccgccggcgaagagctggagctgtttatcgacagcacccagcgtgaagcgctgcacattccggaaccgctatggcgtttctcgctggtggaagcgatgatccgcgacatgagcatgggcgacgccaaatttaaaccggggatgtttgttgagaccgtccacgatgacgccaatgagctggtgatcaacgtcagcctcgaaaatgaccatattgccgatatcgaactggcggcgagcccggtccagactgtggaattcaccaccagcttcgaagagatccgcgaacgtattctcaccgccaataccccgcacgtcgatgccatttccggggccaccagccagagcgaggcggtgaaaaaagcggtcgccaaagcgatgctgaaatcgagtaaagcgctggcggcggaagagggcggcaatgacgccgcgccgaaaagctatgatgtggtggtagtcggcagcggcggcgccggtctggcggcagccattcaggcacacgacgaaggggccagcgtgctgatcgttgaaaaaatgccaaccatcggcgggaacaccatcaaggcttccgccgggatgaacgccgcggaaacccgcttccagcgcgtgaagggtatcgaagacagtaaagagctgttctatcaggaaaccctgaagggcggccacaacaaaaacaacccgcagctgctgcgccgtttcgttgaaaacgcgccgcaagccattgagtggctggcggaccggggcattatgctcaacgacattaccaccaccggtgggatgagcattgaccgtacccaccgcccgcgcgacgggtcagcggtcggcggctatctgattagcggcctggtgcgcaacatcaccaaacgcggtattgacgtcctgctggatacctcggtggaagagatcctgatgcgcggggatgaggttagcggtgtacgtctgatcaacgacgaaaaagaggtcattgaagtacagaccaaaagcatcgtagtggccaccggcggcttcagcgctaacagcgcgatggtcgtgaagtatcgtcctgaccttgaaggcttcgtcaccactaaccacaaaggggctaccgggagcggtatcgcgttgctggaacgcatcggcgccggcaccgtggacatgggcgaaattcagattcacccgaccgtcgagcagcagacctcgtatctgatttccgaatcgattcgcggcggcggcgctattctcgttaaccagcaggggaaccgcttcttcaacgagatggagacccgcgataaagtctcggcggcgattatcgctctgccggaacactatgcttacatcgtcttcgacgagcatgtgcgggcgaaaaacaaagctgccgacgagtacatcgccaaaggcttcgtcaccagcgccagctcaccgcgggaactggcggacaaactggggatggattaccataccttcctcgccaccctcgagtgctataacggggcggtggaaaaacagcatgatgaacagtttggccggaccaccgcgctgcgcgcgccgattaacgaaggcccgttccacgctattcgcatcgcccccggggtgcaccacaccatgggcggcgtgaccattaataccgatggcgaagtgctgaatgtggcgcagcagccgattcgcggcgcctacgccgccggtgaagtggtgggcgggatccacggcggcaaccgtatcggcggtaacgcggtggcggatatcattatcttcggtaccctcgcgggccatcaggcggcgaaacgtgccagaggataacctgtaaccttgctcctgccgggttggcgctttcaccgcccggcttgccccttctaaggagagcccgatgtccgataaccgcgtctatagctactccgccgtgttgatgggctcgcccatcctgctcaaactctgttcccacgatgaggcgatggcctcccgcgttttccagcttatcaagcgctacgaagacctgcttaccgttaaccgcgccgagtcgcaggtgatggatatcaaccatgccgccgggcgtcatccggtcaccgtcagccgaccggtctttcagctgatccagtgcgccaaagccgccagcatggtgcgcgacagcgcctttaacctcgccatcggcccgctggtgaagctgtggcgaattggttttcacgggcacagcgtgcctgacgcggctgatatcagagcccgactggcgctgacccgcccacaggaggtgatcctcgatgaggcaacctgcagcgtgtttctccaacagccggggatggagctggatctcggggcgatcgccaaaggttatatcgctgaccgcgtgcgcgattatctccgtcagcagcaggtggagaaggcgctgatcaacctcggcggcaatgtgcataccctcggcgaatgggccattggcctgaaaaaaccatttgccgacgcgcaggcgctgatcggttccctgacggtcaacgggcaatcggtagtcacctccgggacctacgagcgctatttcgaacaggatggcaaacgctggcaccatattctcgacccgcgcagcggttatccgctggacaacgaactcgatagcgtgacggtcatttccgcggattctttagacggcgacatctggaccacgctgctgttcggcctcggcgtggagaagggctgcgcagcgctgcgtcagcggcaggatatcgacgcgattttcgttaccaaaaatcgcgacattattctctcatcgccgcagcggctgcgttttgcgccgctggacagcggctatcgggttattgactgtactgcttaagcaaactgtactgttcggcgaccaggcggtagcgatagaccggccgcccggtagcgccgtagtggatagtggtatagagaatattgatctgcgccagccaaatcagatatttgcggcaggaaacgcgggagatattcaccgccgccgccagctcatcggtagagaattcgacatccggatgggcgtcaatccactggcagagtgtgcgcagcgtttgcgcggttaaccctttaggcagcttgcgcgcgtcgctggcctccggcgcgccgccgtgcagcaggcggtcgacatcggcctgttcgtaatagggctggccggttattagcttacgcttctcccgccaggtggtgagcgcctcttcaaagcgcggaaactggaagggtttgatcaggtaatcgaccaccccgtaatgcatcgcggtctgtaccgtggcggcatccgccgccgaggtaatcatgataacgtcgatggcgcgccccgactcgcggatggtcggcaggagatcgagcccgctgtcctgctgcatgtagacatccagcagcaccagatcgatctcctgctgcggatcgttaatcatctcctgggcctgactgagcgtcgaagcgctcccgctgcaacgaaagccgggaacccttgccacgtacaggcgattcagttcggccaccatggcatcatcgtcaacaattaaaacatttatcacgcaggtttccttttactatcccaggggagatgaacaaaaaattgggtaaatacgccgggttccgattcgacggcgagggtgccgccgagctcgcgcaactgctggttggcaagaaacagcccgacgccgcgattctcgcctttggtggagaagcctttgttaaagatagcgtcgatgttgttctccgggatccccggcccatcgtcgctcacttcaccgcttagccagccgtcctggtagtgcagcagcaggccgatctcaccctccgcctggccgctcatggcgtccagcgcgttctcaataaggttgcccagcaccgtcaccagcaccgtgacctgtttctcgttcggacaatccggcaccaggctctcctccgccagcgtcagggtaaagccgcactctgtggcgcgctgaattttacttatcaggaagccggccaccaccggggatttaatgcgatgttgaatgtcgccgatgtccgcctggtagcggtgggcggtctgcagcacgtattcctcgagtttgccgtagcttttcatattcagcagaccgaggatcacgtgcaatttattcataaactcatgggaggtggtgcgcagggcatccacatagctcatcatgccgtccagtcgctgcagcaattggctgacctcagttttatcgcggaaggtacagatggcgccgacaaccgcaccctggctgcgaatgggcactgtattgccgatcagcagcagaccattgcaccccagttcgcggtcgtacattggctcgccgctttgcagtacggtctgcagatcgtcgagcagggggctgtgaacgagagtcttatccgggccggaaaagaggatctcttccgccgcggggttgatgagatttacctcgccatgggcatcgaccgccaccaccccctccttgagggcgtgaagcatggcctgacgctgctgaaactgggtggatatttcgtgcggctccagccccagcagcacgcgcttcaggccgcgaaccaggctccaggtgcccagcgcgcagaccagcgcgctgaacaggatggtcagcagcacgtcccaacggctgttggcgatctgttcgtccactttactcagtgaaatgccgaccaccaccacgccgatttgctgatgccgttcgttgaacaccggcgtaaacacccgtagcgccggggccagcaccccgtggttgatggcgacattctcttttccctgcagcgtcggctgaatatcgtggccgatgaacggtttgccgatgattgagctgtccggatgcgaatagcgaataccctgcatatcggtaacgatagcgtacaacaggtcgttgcggcgggtaatggcctgcgccagcggctgaatgatctgctgctgcgggggcgcctccagtccgcgcttcacctgcggcatatcggccatggtgcgcgccaccgccagcgcggtctctttcagaccgtcgcgggtggcgttgctgatctgcatataccacaaggcatacaccagcagcagcacggcgccgatgacgctgccgatcatcaaggacacggcggtgctcagctttaacggtaaggcgcgttggcgaacgcgaggcgggtgctctgaagccttcatgacgaccccgggtagattcagtgaaagattattatcgccgatagcgcggcatacataaagccgtgtaatcaaagcaaaaggccgcttttgctacggcagactcctccagcgcgcggtacactgcggcttttcgccacaggcttaagggagacactatggaactggcttctctggtccgggatatcctccggcagcggcacgttgaacgactggcccagcatcgtgaacaggataatgaagcggaagcagagtgggagatcgcccgctggcggcatcgcagcggggtggtgatccagcgccgctatgagctcgagatcgcgcagcaggatagcgcatcctgcccggagtgctggattgactggcaggttatcgacgccgccggccaggaggtcaacccgatgcgcaaacagttttataacctttgccagcaatccttctggctggctatgcaggcgggtggtgaagatgagacctcagacagaattgctcagataaccgtcaatcacccgtaaacgcgcgttggggacggtaaactgtgaccccgacggcggtaaagcgcagaacattccacttatagtggcggcagaggttaaatagtcctgatgaatataaggatatgcatcaggccgctgattttgccgagatgcgctttttctgtcgtaaatggaggttgttatgagcagttcgctaaccgcgtcaatgcaggctcgtcgtcacccggagaccacccacatcgatcgcctcgccaccgccgatatgctggcgatgctgcatcaggatgataagcagatttcggaggcggtcggcgcctgtctgccggatatcgcccggctgattgatatcgccaccgcgacgataagccggggagggcgcctggtcattattggcgccggcgcttcgggccggacggccattgaggcggtcagcgactattcgccggaaggtaaacacgcgctggtggggctgattgccggtgggcagacgacggcgatggccgagcgggagactgcagcgaataattatgacctgggcgcctttgagctgcagtcgctggacttcagcaaccgcgatatgctgctggcgctgaccgtcagcggcaagacgccatgggtgtggggggcgatgcgccacgcctggtcgctgggcgccccgatagcggtcatcacccagcagccgaccagcgaggcggcgcagctggcggatatcattattgctccgcagaccgggccggaggcggtggcggggttagccaatccgaaggctcagttggcccagaggcagatcgtcaatatgctgacaaccggactcgccatccgtgacggtcgggtgtacagcaatttgcgggtggacgtgcaggctgacaattcgcactgggcggagcggcagatagcgattgtgatggcggccaccgattgcacgcgcagtgaagcaaaggccgccctggccagctgtcatcagcactgccgcaccgcgatcctgatgctgctcagcgggcttgacgcctggcacgcgcgggagctgctaaccaaacatcacgatcatctgcgtctcgccctgcgtgaagcccagcgtagcgctgtcactcccgcccagtaatcccttctctgccaggcgcgcgatgagcatgcgcgcctggacttttgtaattaaagaaattcttatcttttattttacccggcaatagatattgaattttcgaccttattttttatccgtcttcgctctatttttaaaattgattttttaagttaaataactgtttggtttaaaatgcgagagtgtaaatgatattttaaaataaagtaaaagtgcgttaatatgctgcctcttatgaccgtgtgctacgtgataattctattatgcctgcaatgaaaaaaacgattatttccttaaccgcattagcgatgttcgtcagcgcggcgacgcatgctgaagcggatacctcgaaaaaaaccgacttcctgctgattggcggcgggatcatgagcgcctcgctcggcacctggctgcaggcgctgcagccggactgggatctgaccatggtggagaaactggacggcgtggcgctggagtcttccaacggctggaataatgccggtactggccactcggcgaatatggagctgaactatacgccggagcgggcggacgggtcgattgacgtcagcaaagcgctcgatattaacgagcagtttatgatttcccgtcagttctggtcggcacaggtgaaacgcggtattttgcacgatccgcactcgtttattaattccacgccgcatatgagcttcgtctggggtgataatgtggattatctgcagaagcgttataacgcgctgcagcagaccactttattccaggggatgaaattctccaccgatcacgcgcaaattaaacagtgggcgccgctggtgatggaaggccgcgatccgcagcagaaagtggcagccacctggacgccggtgggtaccgatgtcaactacggcgaaatcactcgccagctgatcggcagcctgaagaaaaataaccacttcaccctgcagacctcctctgaggtaacggatttcaaacgtaatgccgacaattcctggcacgtaacgattaagaatgtgcagagcggggaagcgcagactattgacgccaaatacgtctttatcggcgccggcggcggcgcgttgaagctgctgcaaaaaaccggtattccggaagcggacaactatgccggcttcccggtgggcggctcgttcctgatgaccgagaacccggcggtcactgcgcagcacctggagaaagtgtatggccaggcttcagtcggcgcgccgccgatgtcggtgccgcaccttgatgcacgttacctcgacggtaagcgcgtggtgctgttcgggccattcgccaccttctcgaccaagttcctgaaaaatggttcgttcttcgatctgctcagcactaccaccaccaataacgtgctgccgatgacccacgtcggtctcgacaacttcgatctggtgaaatacctggttagccaggtgatgctcagcgatgatgaccgtttcgctgcgctgaaagagtactacccggacgcgcgtaaagaagactggaaactgatccaggccggccagcgcgtacagctcatcaagaaagacgcagagaagggcggcgtgctgaagctcggtaccgaagtggtggtcgatcagcagaaaaccatttccgcgctgctcggcgcgtcgccgggggcttccaccgccgcgccgatcaccctgaacgtgctcaagcagatgttcccgcagcagtttaactcgccggagtggcagagccgcattcacgctattgtgccgagctacggccagaagctgaacggtaacgtggcgctgacccagcaggtttgggatgacaccgctgcgaccctgcagctgacgaaaccgccggtgatccagatgccagcggctgcgcctaccgcgaccgccaagccggcagagacgccgcgcgaggcctcgccgcagcacgatatggcgctgtaaaagcaaactcgacagtgaacaaaagggaagaccatggtcttcccttttttgcgttatttaccggctgaggccgcgcgctgcctgcaactttggcgtcataaaagatatactggtttgaattgaaataagaaaattaaaccaggagtgtggaagggccatgcaagaggatattaacaaggagatcaccttccgcaagctgtcggtctttatgatgtttatggcgaaaggtaatatcgccagaaccgccgaagcgatgaaactcagcagcgtcagcgttcaccgcgcgctgcataccctggaagagggggtgggctgcccgctgtttgtccataaagggcgcaacctgctgccgctgcaggcggcgtggacgctgcttgaatactgccaggatgtgataagtctgatgaaccgcgggctcgaggcgacgcgcaaggttgcaggcgtcggtcaggggcggttgcgcatcggtaccctctattctctgaccctggaaaccgttccgcgcatcattatggggatgaagctgcgtcgcccggagctggagctggacctgacgatgggttcaaatcagatgctgctggatatgctggaagacgatgccctcgatgccatcctgatcgccaccaacgaaggggagttcaataataccgctttcgacgtggtgccgctgtttgaggacgatatttttctcgccgccccggcgaccgaacggctggatgcctcacggctcgccgatctgcgcgattacgccgaccgcaagtttgtttcgctggcggaggggttcgccacctatgccggattccgggaagcattccacatcgccggcttcgagccggagatcgtcacccgggtgaatgatattttctcgatgattagcctggtgcaggctggcgtcggttttgccctgctgccggggcggatgaagaaagtgtatgagaaggatgtacagctgctaaagctggcggaaccctaccagatgcgccagctgatctctatcgtctattcgcaccatcgcgaacgcgatgccgacctgctggcgctggcagcggaaggacggatgtacgcccgcagtattaatcgctaagccgctgcgccagatggcgggcgacgtccaggccgctgcgctccagcgcaatggtctccccgcgccagcccgcctggcgggtcaggcaggtgagcacccccccggggggcatctcaatggctaagcgcgcatcgcgctcatcggcggcgaccatcgcctcctgccagtggaccgggcgcgccatgttcatcgccagatcgtcggcgatccgctgcggatcccacagcacgcgcgccgtcgagccgcttaaataggcgcaccgtgggcgccttaagctggcgccggcaaaagctttcgccagctcagcggcgggtttatccagcagcgcgcagtgcgacgggacgctgaccgccagccgctgggctttactggcgccagcccgcagcgccagctgcgccacctcggccattgcctcatcacggcccgcaatcacgaactgcgtttcggcgttcaggttggcgagataaacctcgtggccctgcatcagcgcctcaacccgcgggcgggtcaggcccataatcgccgtcagtccgtaaccttcaggatacgcctgttccattaagtccccgcgcagggccaccagccgcaacgcgctggcgaaatcgagcgcgccggcaatcaccgcggccggaaacgcgccgatagagaggccgctgaccatctgcggatccacggcctgacgctgtagctcgcgcgcccaggcgacaccggcgatcagcagacagagctggaccgcacgggtgtgttgtagcgcatcggcgctatcgagggtatcgacttcatcccccagcacggcgcgcgcctgggtgaggtttgcctcgcgatcggggatcatcgccagcatgccgggacgctggccgccctgaccgggaaaggtaaataaaatcttcattattcctccctgtgccacggcgtcgcggttaagcgcgcgccgcgggacgttttcagcagcgcgcgcccgtcgcgcagccattcattaagggcgaaggcgccgtacggcgtttcgacctgggtatcagcgcggcatgggagttgggccacccgggtctgccattccagcagcgcctcgcggtcaagcggctgtggcgcgcggatcagcagatccagatcgctggccgcatgcagcaccaggatctcggttgccagcgcgtagccggtactgccggtgacgccccagctccagggccagcggtgtaaggtgagggcgatagccccctggaccggcggctgagagacaaaaggcgaatggagtaagacctcacgatcaacaagcatctccggggtgacgctgcgcacgatattgcgcgcctgtacccagccggcggcgcgctgctcgcgcttcatgccccgcaccccaaccgggacgcgggcctggtcgtcaacgtcgcgcctcaccaccaccggcagcgcggctcgccactgctgagccacccacggctcggcaatgtcttccagggcgctggcgcggtttaaccaaactagatcatggggacgcggcgttgctgacatggtttacagtcctgaagtcaaagagataaacagcggtagcgacaggatacacagaaccgagctcaacagcagcacggcttcagcatccggagactggacgccgaagcggttgccgaagaccacgccaaagaagccggcggccagggcaatcatcaggatcgcggtaatggcaatggaaccgtgcagcccaagtaacatcaccagaccccaggcaataaacggctgcaccagcagtttcacgatggttgatgtagcgatcagcgcattgagctgcagtttacgcgccgacaggatcaccccggtgaggaacagcgcggcggcggtggcggccaggcccagcggtttgatcgacgccagcagcaggtccggcattttaatgccgatcgcggaaagcaccaccccaagcagcgggccccagacgatcggttttttcaccgaacgccacatcagcaccggcagcatcgccagcgtagaaccgctgttttctcccgcggcgcgggctttttcacgttccagaatcagcaggcagaacggggtcatcagcaccgagccgcaggcgatagagaccgctaccgacagtgaggttgacgcgccttcacccagcacgctgccgaggatcggcagacctaacgcggcatagtttggcagggcgacggtgagggtcagcaccgcggcatcctgcggcgtgcgtttgaacacgctggtggcgaggaagtagatcgcggcataggtgatccacatcgcgccggtcaacaccagcaccaacggcgactgggcgacgataccggcccacggcgtttgtaccgtcgcgctaaacagcgtggcgggtaaggcaaaatccattacaaaaatattaagcagcgagacgtttttgttatctaccatcccggccttaccggcccagaagcccagcagcataatgacgaaaatcggggcaagagcatgaataatcacataagtcataaatcacctgtaaataagatagagtactggcgcgattgttattttttctaaaagccgtcccttcccggcgcggttattacgcgctccgggggacggcttccggcaggttttcttctactacttacgtacgaacgtcttaccagctggcgcgcatgcgatcgcggaccagctgcgagctgcggcggttttccgcgcccagacggcacttcagtgaggtatcggtacgcgcgtcagcgatggcgtcgcgcagcgtgttgctgaccaacgacagatcgtggtcgtctggggcatccggattattaatatccagcagggcggagagcaggccgagcgtcgcatagttgctgacgtcgtaggccattggcggaatggtagccgccagtttctccagcgcctctacggtacgcagggtaatgcgcgccgccgacgctttacccatcgcgtggaccagcacgccgctatcgttaaaggcgatcaggcggttggcctggtagccgtgggccagaaacgccccggacatcgctttgccgacgatcaggccaattaccgggtggccggccaaacgggctttggcataagcgccagccgccccggccagcgcctggtgaatgccgaaagcttcttcgcggcggccataggcctggcttggcacatcgatcacggcgacgatcggccgtttgactggctggtcggcgtcggcggcaatggtttcattaaccactttcgccagcgtccagccttccagcaggccgacttcgccgccggcggcgcgcgggtagtggttgttagcatccgggaccacggcgataaaacgcacgttttcgccattaatctggccgtctgccacctggacggaagggcacaggccgctcatcagcggcgcgtcgggcgccagtttgttcagccacagcgcggcgcggtttgggaactgactcattatttatcctcccgggcaaaaagctgtttaatctgcgcggtatccgcctgctggcgggtgtcgaactggctcaagcgacgcagataatcgtcatagttgtcgctgcggtgctgtaccggtacgcctttggcgatcgcctcattcattgcggttttaacggcgttaacgccatcgttaaccagcgcgtcgaccagtccgctggcggcgcgaatttcgccgccggtcatgctccagataaacggccggttgcgggagtcgtactcttcaatgccggcttcctgctcgataacctgcgggccgttgagaccgagacgggcttcacgagtgacgataaggtaactgcacagcgcggcggcgatagacataccgccaaagcagccgacggtgccggcgatgatgccgaccactggggtgtagcggcgcaggtcgacaatcgcggcgtgaatatcggcgatggcggccagaccgaggttggcctcctgcagacgtacgccgccggtttcgaggcacagcaccgcctgcgtcgggataccgttgcggttatcttccgccgccagctccagcgcggcggccattttggcgccggacacttcgcccatactgccgccctggaaggtgccctcgatggcaatcaccaccgcaggctggccgttgatcgtgcctttggcgaccaccataccgtcatcggattgcgggacgatgccctgggcgccgagccacggcgacataataccgtcaaacggatccagcagttcgcggtagctgccgtcgtccagcagggcgtgggcgcgttcgcgagcgcgcagttcgataaagctgcgatcgttacgcatgagcggcctcctcaaaaacctgttcaatacgaatacgggcgacgcccggcgtggcgccgaagtcgtggataatcaactgcccggcgggcaggccgttgatcaggttcaacctgtcgaacagcgcctgccagcgcgcctggctgttatccactgaggtggtgatctgtacgttgagcgtggcgctctgtgcggcggtataaagtacttccatatcgcctgaacccacgactcctgccagcgctcggccgctcagggcgcggctggcaggaaatgacaatgtaatctgttccataacatcctctgaatgcgttagccggcaactctgtcgagaaacagggtggcggcaaggagatcggcggcgcctcccggcgaggcgtttagcgccagcatgattgcgtccaggcgggccagggcggcgcgcccggcgaaactggcgcaaccgccagccgccagcacctcacaagcgccttgctgcatggcctgcagcccggccataccggcgcgcgacagcacgcaggtatcgctcagcgaggtcatgatggccatcagcgcatcaagctgcgcctgcggctcactggcgcctcgcgcccggctgtgctgcagttgcggcagcgccaggcgggtgatatgcgggaaaccacactgcgcttcctcgcgggcgcctggcacctgccagcggcggctggcgcgaagccctttactaaagcttttcggcgcgaagccgtcgggcaggcgggcgagggcggcggcggcgtcggcgatcgcctgtgactgaccctctccacccaacatcgccaccgcgctgaccagcaggcctagcgcccagatagcgccgcggtgggtgttaaccccacccgtcgccagcatcatctgcgcttcgccttcgcggccaaggcggccgacggtttcgcgcagggcgatgtccgccgggcgacgccagctttgctcggccagcgcgtgaaaggtcggctgcaggctgcgggcggagcgctccatcagcgccagattcaggtcctgatgcgcgccgttgccgcggctatccaccagacccggtttcgggctcaggcgggcttcgtcaatcagacaggcgctggcggtatgcgccagccagctgacgcggctttctgcgtgcaggggggagagatttttcattaccagctccggaattttgccggtgggttgtacagtccgtcggaccactccaccaggtcggcgacgctgccggcggccagcagggagcgggtggcatcgctgcggcgaatcccgagatcttccgggtagaccactttgccgctctgacgcagcgcggcgacgcgtttggcgtccacaccaaggccgatatcggtgatcccggccaccgcggcgaccatcgcccggcgctcttcaaggctctccgcacggtacaggtaggcgataccctcttcggtcaggacgtgggtgacgtcatcaccataaatcattaccggcgccagcggcatgccggaggttttcgccacctcaactgcatccagcgtctcaacgaaggttggtttcacgccggcctggaaggtttcgaccatctgcaccaccagctttttcccgcgctgcatcgggtccggctcggtgatcatattgagccatgccggggtggcgtggcggcgaccgtgcgggtcgtggcccatgttcggcgcgccgccgaagccggaaagacggccgcgggtgacggtcgaggagttagccagaccatccacctgcagggttgaaccaatgaacatatctaccgcgtactggcccgccagctggcagaaggcgcggttagagcgcatcgagccatccgggccggtaaagaagatatccgggcgggcgcggatgtactcttccatccccagttcgccgccgaagcagtgcacgctctccacccagccgctctcgatggccgggattaaggttggatgcggattcagggtccagtgtttacagattttgcctttcaggccgagctgctcgccataggtcggcaacagcaactcgatggcggcggtattaaagccgataccgtggttaagcgactgcacctgatgttccgcatagatgcccttgatcgccatcatcgccatcagtatgtgttcttgcttaatcaggcgcggatcgcgggtgaagagcggttcgataaagaacggcttgtcggcaaccaccacgtaatcgatccacgagccgggaatatcgacgcgcggcagatcgcattcgtcgtccaccagttcgttgacctgggctatcacaatgccgtcgtggaaggcggcggcttccaccagcgccggggtatcttcggtactcggtccggtatacaggttgcctttgcggtcagctttatagccggcaatcagcgcgacgtttggcgacagatcgacgtacaggcgcgagtagagttcgatataggtgtggatggcgccgatttcgagcaggccatcttccagcagctgcgagatacgcaggctctgggtgccggagaaagagaaatccagcttgcgggcaatacctttttcaaacaggtccagatgctcgctgcgcccgacgctgggcataatcatatgcaggtcgtggattttttgcggattaacttccgccagcatgcgcgagaggaaatcggcctgtttctggttgttgccttccagcacaacccggtcgccgggggcgagcaggttttccagtacgctgaccaactggtcagtcgggatgaccttacctggcatgttcgcctcggccagccgccgctgtttttccgttcggcgacggttccagacccgccccgtcgtttgttcggcattcattaataacctcctgattcgacaaatcgttttgtttgtcctggtggagattagtgtgcgacgcgaggctatgagcatcaattaagcgcggtggccgatcgttagcatcagagtaacgattccgccgcaacgtttgtgatgcggatcaataatacataaggcgtagtggtctacggagagagtgtagggcagggagcaggccggcgaagcgccggcctgcggaaggactactgtttactgacatcgcttaataagaaagcgatactctgcccgccgctggtctgctcgagggcaattttgacgataatcgtcaacggcaccgagagcagcatgccaaccggacccagcaaccatccccagaagattaaggacaggaataccaccagcgtcgagaggcccagcccgcgccccatgatacgaggttcgagaatattgccgaataccaggttgacgatcaggtagccggccagcactaccagcgcctcgtacagaccaccgaacaccagcacctgcaggatcggcggaatggccgccagcacggaaccgatattgggaatatagttaagcgcgaaggccagtagcccccacataaaggcgaagcgcacatccagcagcaccagcatgccccagaccaccaggccggtgatcaggcttatcgcagttttcagcaccagataatgcgatacgctgtcgatggcccgctggatggcgcccatgccttctactggtctggacattaactgctgcagcttagcgggaagctgcggcacctccagcagcataaacaccaccgtcagcagcagcagaaaaatggaggacatggcgttcgacagctgagtgagcaggctggtgaccagggtcattacggcgttagggtcgatgtacttattgagctcgaccaccgaaacggtgaatcccatacgctgcagccagggcgcgatggtttgcatcggctcatagagatagttgcgatactgcggcagggtgcgtgccagctcgttgagcgaggtccccagcgaggccagcagcacaatggctaacataacaatcaggccaatcagtagcgagatcgccagcacgcgcggtacccggcagcggaccaggagctggaccagaggattgatgatcaccgccagaaaaagcgccaggataaacgggacgattatgtccgccgcaaagcgaatgccggtaaggatgatcaccagcatgcccaacatgatgaccatctttaatccgttaagtgtaataatgggtttagccataggatcccgacctcaaacttccttgcctattaacaggttgcgttacattagcataatgacgcttttttgcagaacaaacgcattgaagaaaaaccgcggcgtaaagaattgcaaagtctttgaattaaatgtagcactatgctacaaatctacctgtgtttaactactgaggacaattttcatccgcaccggacgagaagcaacaccgcggataattgtaattttatggacaatcagttcaggatgtatattttaaatcaccccgcagtatccctcactttttcccgttttgccggcgaacagcactggcattcggcgctatagtcaccttctttctgcctgagctggcgccaagcgcacagcgatatctacgtcagaaattttcctgtttacgtctcgcgtaaacggtaatggattatattctcaagcaggagaagggatcatgttttattggattttattagctttagcaattattgctgaaattaccggcaccttgtctatgaaatgggcaagcgtgagcggcgggcacaccggctttattttaatgctggccatgattgccctgtcatatatttttcttgcctttgcggttaaaaagattgccctcggtgtggcctatgcgttgtgggaagggatcggtattttactgattaccctgttcagcgtgctgctgtttgatgagagtctgtccctgctgaaaatggccggcttgaccaccctggtgatagggatcgtcttaattaagtccggcacccagagaaaagcgtcttcaaagcaggaggtggcccatgcagcagtttgagtggatccacgccgcctggctggcaatcgccattgtgctggaaattattgccaacgtctttttgaagttttccgacggtttccgccgcaagatctacggcatcctgtccctggcggcagtattgggcgcgttcagcgccctgtcgcaggcggttaaagggatcgatctctcggtcgcctatgcgctgtggggcggcttcggtatcgcggcgaccatcgccgccggctgggtgctgtttggtcagcgtctgaataacaaaggctgggcgggggttatcctgctggtagccggcatggtgttaattaaactcgcctgacgtctcgccgcctgcaaagccaggcggcaaacggaaacttccttcacgcctggccccgctgtaattgtgtcaggtgacgctgagggctgcgcaggttcactgctttcggctggcggaaaatcatttccgccaggacgatgtcaataatgatattcttcaccagcctcggtccattactcaccggcaagcgcctccagcttatcgcgaaagccagtcaccgcaatggcgcgattgtccgcccgccagcgatcctgcgggccgggggccgaactctgcacggcgatcacctgccagccgtcctccgttttcagcagcagcggcgagccgctgtcgccaggcagggtgtcgcactgatgcgacagtacgctggtttgcgcccaccctgtcacgatgcaatcctggtggctgtaaagattatcgagatgatcttcaggatagccagactgggtaactttacggtccgccgccttcagcgcggcggtgagatcggccttgctgcccggaaagagcgggatcggcgtaatgccagacggagcatagcgcagcacgatcagaccaaaatcggacggcgccgcagcggaagggacaatccagccgtcgccatcggctttcaggcgtctgcctaagctgggatcgactcgcccgtcaatgccgtggatctcatagacccagttgcccttgcgggaaataaagcgcagggcgaccgctttgtccggcttgccgcgcgggggcgttaacagacagtggcccgcggtcagcgccagatgcggagagatgagcgtcgccgtacacagattgccgctggcggtttccaactggccaatcgcgtcccacggactctcctcggggcggttcaccgctttgcggtcatcgtgaccgaaaaacaacgtcttaatatctttggcgctcagtccgctatcatcggcatgtgcgcccagaggtaacagataaaatgaacacagtaataacagaacgtctctacgcatatcactctctggggaggctatgatgtctattgacagtagcaggagatttaagtttttgaaagtaaacaataattctaaacaggccaaaccgtataccacatcagcgcgcggtggggtctggcgctggtaaaacctcctgatttcaagcggttaataccagtgttctgcttgtgctatttccgcagaaagtggcgtcttgcgcaacaaaattcatgtatcagaacgtactgaattcggttaataatgcagcaattcatccgtgggattattcctggtttgtcagcataatgcccaaaaataatacttttacccaccagatcttcaccggaattcgcacttctttacgcctctcgtaattattttcaatgcgaaacattttctcaccgaaaacgttgttaccgtcgccctgccgttgagtaaatagagaggtagtaccggcgatgatagcctgaactctatttcccctgcgttcggagggcttatgtctaaaaaaggtattcgcgcactggtttatgtttccctggtctcagtcgctatctggggcgcgaccggctatctggtgatggaagccgtgcgtgcattgtgatggacgcaccacccggcaagggccaggcgtgcgagatattacgactaacatgtctggcgtcttctggcgccggacatttttttgcgccgcagagagtcacaggataatgggaagcggggagcgggtcagcgatagccgcacggtattcattttaatgaaaagctggtagaagcagcaaaatgcaggcgcgggataaataattaagagaggaaaaaacgggttgcaaccactgcgcatataattagcaggatcaggatgagctcaaaacgatagcgccgcagcatagtgctctccagaaaaaacggcgctgaaacagcgccgattattaagaaggttggttcaccgggaggaattatgctgccggctgtgcagtcggtttagcggcctggtgtttagtggttttgtggtgttttttcgctgcctgcgctttctgggctgccggtttagccgcagctttgtgatgctttttcgccgcctgagctttctgcggagcagctggtttagctgctacttttttgtgttttttagcggcctgggctttctgagcagcggctggtttagcttctgcttttttgtgttttttggcagcctgagctttctgctctgcggccggttttgccgcggctttgtggtgttttttgtgatgggtggtcttggcagccgtgctgtgggtggcagccggtgcctgagtggtgcttactgcgtcagcagcgaaagcggcggaagagagacccatagcagcggcaacgaccagagctaatacttttttcattctgatatcctcgaaaagttttcttaatttcaaccccactgcggggccggtgaaatcactatatgcttgtcttttcgagctttccgtgagtgtttggtatcggcgtgtaaccgaatgtacaaggcaggaacgacaggacgcgccgggtagcccggcgcgtatgattacaggtagcgagtggtcaggtgctcgcggaagtagcggctattaagatcctcaccggtggcctgctgaatcaactgcgaggtggtgaagcggctgccatgctgccagatattctgccgcagccagtcgaacagggcgctgaaatcgccttcctcaatatcgcgatctaatgtcggcagcgcgcggcgggccgcggccatcagctgcgcggcatacatcgcgcccagggtataggaagggaaatagccgaatccgccgtcggtccagtgaatatcctgcatgcaaccatcccgatagttgccggtggtcgacagccccagccagtgctgcattttctcgtcccacagcgacgggatatcatctacctcaatctcgccgtcgatcagcgcacgttcaatttcataacgcaggatgacatgcgccgggtagctcacctcatcggcatcgacgcgaataaagccgggtttcacctgctgattccaggcgacaaaattatcctggctaaaggccggccgatcgccaaaccgctcgcgcaccgccggtaacaggcggttaagaaaccgctcgctgcgtcccagctgcatttcaaagaacaggctctgcgactcgtggatagcggtggagcgggcgagtcctacgggctggtcgacccacgggcgaggcagattctgctcgtagcgggcgtggccggtttcgtggatcacgccgaacagagcgctgagcaggtcgttttcgttgtagcgggtggtgatgcgcacatcctggggtacgccgccgcagaacgggtgggcgctgatgtcgaggcgcccgccgtcgaagtcaaagccaaggatacgcatcgcctgcaggcccagctcccgttgttcagcaatggggaaaggcccctgcggggcgattagcgcctgcttcgcctgcttctccaccgcctggctaagcagggaaggtagccacgatttgagatcggcgaacaggctgtccagccgcgcgctggtcatatccggttcgaaaatatccagcagcgcgtcgtagcgtgagccgcccctggcatcggcgcggatctgcgcttcctgacggctcagtctgaccacctcgcgtaggttgtcggcaaagcccgtccagtcattggcgggacgctggctgcgccaggcatgctcgcagcggctgccggccagcgattttgcttccaccaggctctccggcagcagcgccgcctgatcgtactgacgctgcatttcccgcaggttggcctgttcaacatcattaagatcctgctggcgggcctcctgtaaccattgtcccacttttttatcggtcaggatctgatgctgcagcacgccgagctcggccagcgcttcgccgcgggcgacgctcccgcccgggggcatcatcgcgaacatatcccagccggcgatggcggcgagatgcgaaaagcgcgacaggcgctgaaaggtacgggtaagctgctgataaggcgtattttcagtcatagtggcgttcggtccgtgacaggtgaataaagagattatcgctttgcctctacactatcctgatacgcccggcgggtcgagcgttgcgcacaggggaagggaaagacacatggcgggagaataagctcacctctgtgatcggtgtgacagaaaacggtaacatatcggtactaaactgtgatcgattacacaggtctggaggttcgggggtggtttatgaatccgttcacctggctgtttattgcactactgtccgttgatgccgtcagagagctgatgggcttgtcttccataatgggcatgtggtgaaacgtggcccgcaggccacgtcacacgcgactatttcagtcgctgatgtaagcaggtgccggtcaacagcgcggcaaggagcagcagcgcgataaacccaccgacgccgttccagccgtagtgatgccagaataccccgcctaacgtcccggcaagacttgaacccaaataatagctgaacaaatacagcgatgacgcctgaccgcgggcgcggcgggcgcgtgggccaatccagctgctggcgacggaatgcgcggcgaagaagccagcggaaaacagcagcatgccgatgaaaataagccacagggaagaaaagagcgtcagcagcaggccgcagagcatcaccgctgtaaagccaagcatcaccggcccgcggccaaagcgtacggtcatggcccctgccttcggtgaactccaggtcccggtgagataagctaccgacagcaggcctaccaccgcctggcttaacgaccacggcgacatcatcagccggtagccaatatagttaaacagggtgacaaaagcgcccatcagcagaaaaccttcgacgaacagcagcggcaggccacggtcgcgccagtgcagacggaagttaatcagcagcgttttcggtcgcagcgaggtcgggcggaaatggcgcgactcgggcaggatacgccagaacataatcgccgcggccagcgcaaagccgctgatcgccgccagcgccacgcgccagccgaagaaatcggtaaagaccccggtcagcaagcggccgctcatgccgccgatggagttgccgctgatatataaccccatcgaaaaggcgacgaaactggggtggatctcctcgctcagataggtcatgccgaccgccgctacgccgctcagcgacaggccgatgagagcgcgcataatcaggatgccgtgccagctggtcatcatagtcgacaacagtgaacagcaggcggccagcagcagggcggtgaccatcaccggcttgcggcctatagcgtccgacagcgggccggtaaacagcaagcccaccgccaacatcgccgtggaaattgaaagcgaaatactgctgctggccggcgacacgccaaactcgttcgacagcaccggcaggatcggctgcacacagtagagcagggcaaaggtggccagaccggcggagaacagcgcgagagtgacgcgcataaactgcggggtgccacgtttaataaacggatccggacgggatgcaccagcgacgctgacctcgcccgccggcacggtgtcaacggttgtagtacgactcacagagaattccttgcgtagaagttgctgcttaccaacagagtgttgtgaccattcagctcacatttttagggtatgaaaatgtaaatattctgtctaatatattaataatctcaaataagacgttttaaatataaatatcgagttgcgtcatttgcgctactttgtcgccgtcgccgaggagctacattttggccgcgccgcggcgcgactgaacatctctcaaccaccgctaagtcagcagattcagatccttgagcagcagaccggcgctcgcctgttttcccgtaccaaccgcagcgtcagcctgacggcggccggaaagcagtttctcgccgatagccgacaaatcctcgcccaggtggatgaggcggctgctcgcgccgcccgtctacaccatggcgaaacgggtgagctgcgcatcggctttacctcctcggccccttttattaaggccgtctccgatacgctatcgatgtttcgccaacgccttccggatgtgcatattctcacccgcgagactaacacccgcgaacagatagtgcccctgagcgagggggctctggatttggggctgctgcgcaatactcaattgccggacaccctggcgtgggagcgggttctgcgcgagccgctgttggcgatggtcccggcgaatcacccgctggcccgccagcactcggtcagcctggcggcgctggcgcgcgagcccttcgtctttttcgacccgcacgtcggcactggcctgtatgacgacatcctcggcttgctgcgccgctacggccacacgccgaagattgcccaggaggtgggggaggcaatgacgattattggtctggtggccgccggcctgggggtatcgatcctcccggcctcctttcagcgcgtccagctcagtgaaatgcgctggctgccgatcgacgaacaggatgcggtatcggagatgtggctggtgtggtctaaacaccatgagcaaggggcactggcaaaacgctttcgtgaggcgctgctctcctggaaaagcgagcataattgaggcgaaaaggggctggaaatgtgcggtaaatcacaaggctaagtaaaaatttgacgttcaccgtcgaagtgcttcaccatagccgaaagtttatttcgaagcgcgaaaataagggagtcaatggtggtagcggatagtcaaccaggccatatcgatcaaataaagcagaccaatgcgggcgccgtgtatcgcctgattgatcagctcggcccggtatcgcgtatcgacctttcccgatttgcgcaactggcgccggccagcatcaccaaaatcgtccgcgaaatgctggaagcgcatctggttcaggagaccgagatccaggagcccggcagccgcggccgcccggcggtggggctgatggtggagaccgaggcatggcactatctggcggtgcgcatcagccgcggtgagatccatctttcgctgcgtgatttaagcagtcagctggtggtggaggatcagctggagctggcgctcaccgacagcacgccgtttttgacgcgcgttatcgaccatattgatcgcttctttattcgccatcaaaagaagctggaacgccttacctccatcgccatgacgatgcccggtattatcgataccgaaaatggcattattcatcgcatgccgttttatgaggatgttaaagatgtcccgctcggcgaagcgctggccaatcataccggggtgccagtctatattcagcatgacatcagcgcctggaccatggcggaatctttgtttggcgcctcgcgcggcgcccgggacgtcattcaggtggtcatcgatcataacgtcggcgccggggtgatcaccgatgggcgcctgctgcacgccggcagcagcagcctggtggagattggccatacccaggtcgatccctacggcaaacgctgttactgcggcaaccatggttgcctggagacgattgccagcgtagaaagcgtgctggagctggcgcagatgcgcatggcgcagtcgatgagctcgctgctgcaccagcgtccgctgagcgtggagtggctttgtcaggcggcgctgcagggcgatttgttagcccgggacatcatcagcggcgtgggtaatcacgttgggcgaattctggcgatcatggtcaatctgtttaatccgcagaaaattctgattggatcgccgttcaatctggcggcagaaattctttttccggcaatttccagctgtattcggcaacaatctctcccagcctatagccggcatattaccgttgaaagtactcagttctccaaccgcggaacgatggctggcgctgcgctggtcaaagatgcgctctataacggatccttactcatacgactgttacagggttaacattttttcatagtcacaccaaaaattgcgctatctcaagctgacctcagacggcttcacgtagactttgcccaccgttgattatttctctcccgtatatttcatcgacaaaactgtggggttagtgatgtttaagcgtttctttattacaggtacagacacctctgtcgggaagacagtggtttcccgtgcgctgttgcaggcacttgctgccagaggcaaaagcgtggccgggtataagcctgtggcgaagggcagcaaagagacgccggacggtttacgtaacaaagatgcgctggtgttgcagagcgtctccacgctggcgttaccttatgaggctgtcaaccccatcgccttaagcgaagacgagagcagcgtggcgcatagctgcccgatcaactacggtctgctgtccgatggtttgcagcgtctggccgcgcaggtcgaacacgtggtggttgaaggcaccggcggctggcgcagcctgatgaacgacctgcggccgctctccgagtgggtggttcaggagcagctcccagtgctgatggtggtggggatccaggaggggtgcatcaaccatgcgctactgacagcccaggcgatcgccaatgacggtttaccgctgattggctgggtggccaatcggatcaaccccggtctggcgcactacgccgaaatcatcgatgtcctcagcaaaaagctgccggcgccgctgatcggcgagctgccttatctaccgcgcgccgaacagcgtgagctgagccgctacgtcgacttagacatgctcggcaacgtgatggcgatagatcgaatcccggcgtaacgtccgcgacagcacagacgacacgacgcaggttatcagtagaccgggcagcagcgtatactgcccggtcatctcgcaaatcatcagggttgacatgatcggcgcatgggtcgtggcggccagaaacgccgccatgccggtcagacccatcatgatggccatttcttcacttcccggtagccacagcctgctgaagcaggcaaacagcatgcccatcgccaggccgacaaacagcgtcggggtaaagaccccgccaggcgcgccggagccgctgctggccagcaccgccagcagtttgcagataaatacgcccaccagcagcgcaccggacggcggcagcagcaaatagctttgcactacgctgtagccgttgccccatactgccggggtgatgagcgataagccgccgacaattagcccgcccagcgccagctgccacggcggcgccagcttcagtttaacgaacccgcggtggctgtagtccatcagccagataaacagcggcccgcacagcccggccagcaggccagtcgccagcattaagccatagtgcagggcgctgaggttctgctgtaacacgacgtgatacagcggcgcggcgccgccattaagaaactgcgtcaacagcagggcgatcaccgccgagatcaccaccggcccaagcgaggccagcatcagcgtgccaaagagaatttcagcaataaacaggctgccggccagcggggcatgataggcgctggccatcccggcagccgcgccgcaggcgacccatagcttccattcactctgcggcgtgaagcgacgggcaaacagcgaggccgccagcgcggccagcaggatcatggcgccttcccggccaatcgcgctgccggtcaccacgaccagcaatgacgccagcgatttcaccaggcttgccggcgtatcgaaacagccgtcgccggtctccagggcttccatataatcggtggcggcatgcggacgcgcgacgctgcgtcgttgccagagccagagtaaggttcccgccgtcaggccgcccagcgcgggggtaaccagccgacgccacgccggcagcgactgtgcggcgttgaccaggctcccgctgtcattactgagcaacagcgtttccagcaccaccatagcgtggcgaaacagcgccaccgccagggcggcgagaaggccaatcagggtggcgatcagcaggcggcgaaacatcacctgcacatcaggatagggatgaagacgatgcattagtcacggcgaggttcggaaaacattggcttattgtgatagggaataaccttagatgcaaaagcgataagtgcgggtgaaaggctgggaagcggcaaaataaaaccgcgccggatatcggcgcggcgaagggttaacgatagagcggtttttgcgccacggcgatcggcagattctcctgccactgcgccagagtcgcctgcgccagctgacccagcgcctgatagaaggggtgggcggcatggtcgacaaagacgctcaggaaacgcccggaccacggcagcaggtgccaggccagcagctgagcgaacaacgcatcctgctccgtttcgcacaaccatgccgccaggagtagcacggtgccgaagtgatcttccggttcattgccatcggcctccagcgcgataccgttctcgcgcatccactggcgcagagccagcgtggaatcgccaaacagcacagactctttatccagccagacagagccccagggcggcgccggcagggcccatggcccgataaacaggcgctgccaggcttccggcaacgtttcttcagccgatgcggcaaaccctgacgccagcggggctgcgaccgggaagggccactgctgctgccagctcccgtcctggaaggcggcgaccagcggcgcaatttccgcgctattcggcgcataagagaacagcgcgcccagggtgcgggcgcttaacgcgacggcgtcgcgatttgggatcggcatcatcacttattcctttctgcggcgcgcgcctgcgcgccgtctcattaaccggcaaccgccataccgacggtcatatgcagaccataaaacaggccgcggccaatacattcggcgatcaagaccagcagcaggccgatcagcagccccgtagcgcgcggcggctggcggcggatcagcggacatagccagcagccgaggcccagcgccagcagtaccaggcgtagcgcctggagtttgccgtattctggcagcagggtggccgcctgctgaaccgagctgtgaagggtactgagcccggcgctttgcataatgataactgcggcgctgatgaccagcgcggccacgctcagtccggcaaaaaaccagccgttaaagtcgactttcgccagccgcagcagcagggcggcaaacagcggcccgctgaggagcaccgtcagaaagaacgcgctggtggtgtagccattgtaccatgttggcacggtattgatttggtaaacccgggtcattgcgaggacaaacagcagccctaacagcatggcgatcgccagccagactttacccagcgtcgccggcattttttccagcaccgccagcagccaccagaatccgcccacggcgaagaacagagcgccgctggcgatttcgttgctcagcgccgaggcgccgatgcggttcagcgagttaaacgcgcgcagcggtgaaccgagatgcatcaccgaagcaagaaaaccaatgcccatcagcagccagataaaaaacatattgcgcaccagccgccgcgcttcccgttggtcccccagcgccagccagccaagaccgctgacgatggtcgcgccgaccacgcactgacccagcaccgtaaaaagcaccagcggccattcatgccatccgtttcccatctcacacctccttcgggttcgccaggtaaccggtggtatcgccacacggccgggcattggcgttaggtttgataacgatactcggccgggtaaagtg

SEQ ID NO: 82 - DNA, 36316 bp, Unknown
  source: /note="Description of Unknown: KP2-Mcoc1 Bacteria Sequence"
gcgcgctgcgcgggcgctttgcgctgagcagccatgaacgtctgcgcctgagtcagcaactgattgatgcgaaggtggccgccggctactactttattgccatctatctggagcacggtgcggcagggctggcgcaggacccggagatggcgctgcgttactatcgtaaggcggcagatgaagggaatccccaggcgcaggcttttttaggcgaaaaactatttccggccaaaagagctcctcaggtagccatgcagatgtttcgatgcgctgccctacaaggtgagggaaaagcggctaattcgttaggaattatgctaacaattgaccagaaatatcaggacgctgtagatgtctatcagttaggggtggccgcaggagattcaggctccgccagtttccttgaacatggatttgcaggcccggcaccgaccgacaggctgtactatctggcactggagaaagacccggagcgtgcccgtcgctatgagcagataggtgctgtgctggcgaaatactcatgggcccatcctgtcgtcccggaaattaacgatatcgtgccgctgcccccggcgccgctgccggagtgggacggcaagctgaagtggctggaggaatgggaggccaatatcccgccgccagcgcctgatgcagtgctgatagagaaactggcgaaagcgaaacagctgaacccggcaacgggcagaccgctgccgacgtcaccggactttgagaaggacagcgtggcggctccgtaaaggactgaacgaacgtgccatccgtttcttccgcgagggagacatcataccgttggataaattaaatcttgtccgcctgcgctcctgctcgcttggcgataaatggctgcggggagagaggcaggtgctctggcgactgacgggcgaggcataaatctcctcttacggcgagttatcgctggcattaatacctataaatttaaggacaaatcatatgcgtaaatttttaatcggattttttattttcttctcaggaatagcaacggggcagtctaatttagaagattttaatcattcgccgaagtgggtggattcggctgggcaaataaatcctgacccgggattgatgaagtattttcagaatatgaaatttgtctgtcataacgcgtctggatttacacctaaagaaaataagagtgctgcaaaggcgttcagtgaactggttcagtatacttctgagggagatcaaataaaaggtttctggaacagtcctgaacataagcaaaaacgtgaaggactgcttgtaacagcaataaaagccggaagctggaaggccgcatatgtaaatagtgtctgggcaataaaatatccgagtgcggagactccgatagaggttgcttccaccaaactccacgaactcgtttctcggggcatccctattgctgcctataaatatgcgtcgtatttgtttggtcgcgattatgaaacaatgtactacttgtatgctgaagccatcaagcgtggcagtccacaggccatgtcagcagtaggaggaactattgttgtcagggttcaggaactgcacccattaggtaagcagttgctggaatgtgcggtagggcaaggttatgcagaggcttatgatcatcttggcttgcttgccgatatggaaggcaggagattagatgcctatcatttgtgggaaaaaggcattaatgaaggatgtgaaggctgcatcaaaaaaatgagtaatctggctaaagttcggcatggttattctgcggatgtgccgatgatggaattgatgcccgaactcatgaggattaaagaattcaatgaaaataatttcgtctatcaattgactgaattgccagatttctatcgtcgtctgccggaggaactgattttccatctaaacgattccgaacttttaagtctgcttaagctggagaaattttctcgcatgttgtaactctgaaactcaggaaatggctgcgcaaagaatttcgctaatgattgcagctatttattttccttaaatgctacaaggttaataaagttatgaaaggaattatccgtacaggcgatacgcataccgggggcgggaaagtgctccgtggttccagtaatatgaaatttggtggtatcggcgtggcgcggctgggcgatcccgtcagttgtccgatcaaaggccatggtccgacggtgattgccgaagggcaccccacttttagcgatcatggtataccggttgcgttccatggccaccgttgtgcttgtggctgcatattgctgtcgagcctgccacaagccagggtgcgctaacgatgcctgtcgatttaaaacgtattcccccgcctgctcaacggcctcgagcaccggtgtggtgggtttggttgctgtttttgctgtgttggctggcagcgggcacctgctgggccattatgagcaataaagataaactccaaatacacaccgcggatttttggcaaacggcgttgatattaccggcattattctggcttattctgctggcgttgcgtatcgcctggtataaaggattactgtcaatggctgatggctgggataacgatcgtgaacagcttttgagtcgtgaaatccagagagggcggcgtcacctggcaatcctgggcgtgagcttacacaccgcattacgtctcccggatgatcgggatggtaaggggcagcgagaggcattacgaaacaataccccggctttaaaaacgcagccttcctggtggagtgacgaaggtatacgacatagtcggctgttgcgtatcggcgacgaaacgcccgaacagttggttaggcgcatcatgagcaatacgttgaatgagctgacttctgtactggcatctgttcctgcagagacaccgctgtcattaatcatagagagcgacggcagtctgtccgtcagcgagatacagtcgacctggcgccagtgtttggcgaacagtcacatccggcaaccggtgacgtatctggaaggcaaagggctgcagatgatagaccactggctggatcagccgatgactgagccatccctgatgctgattgtggcgctacaggttgctcccaaacaggttgagggaacggcagaaacggtggttagcctgttgcttgccagtcctcaggtcgcggcggatcttatgccactggcgcttctccaccgaccagagcaggtgaaggggataagccacgaggcgtttcattatgcctttgcgcgcgcgtttgactgggccgcgttacccgcggaggccgtgcctgccggttggttggtgggtatcaagatgaactatcatcagcccatcgcaacgggattgatcgcgttgtcgagcccgatcaatatcggtcgtgatttctacaacctggacagtagcctgggttatccaggcgtcgcagccccctgggtcgcgatcgctggagcaatcgtgcggtacggtgacgataaatctcaactcattgtgagtggcgacggttttgccgaccaaccattatgggccacggtgatcaccccattaccactatcatcagagcttcaccaggccaggcccgttcgcgctgcctgagaggcggcaagcctcgtgactacacactatctcatcagacggtcatatcagcccctggtggtgggtctgaatctttctcgaatcttcttactgcaggaaataaggatgaatgcaacggatagcatattgcgcttaggtagccgttttggggtgctgatgctgatagctggcgcaatattgtgggggatatatcactatggcgacaagattggattgaatacgctgcaagcgaaactctatttctgcctgggcttagggatccttattctgctttttcgttatggcggccgtattgtgcagttcatactcggccgccatctgaaggggcagggggcgccattgacaagtggtcagcatctgaagccggcttcccagagtcaccgcgcagttattgagatgaggcagacattgcgtcgccagtatggtcgctttggggctggcaaaatgaccattctgatgctcacgggaagcgtggcggatgtcgaacgccttgcaccgggcctgagtagccagtactggcaggagaatggagacacattattgctttggggtggggaaccccagagcgcgtcggataatgactggctttttgctttgcgtaaacgcttttgcccccctgtgaatgggctggtgtgggtcacttctgcgtttgatcatctgcccgcagccaatcagcacgtatcccccgctttgttgtccatggaggatatagataacattgcccatgatctggctgaacgtttctcactgctagggtgggctgtaccactgtatgtctggtcgctgcatccccaggcggatgatcaggccgggcgcatcgtgcaatctgtcggcagtctcttcccgccagactgtcagtcgtcgcagatgcgccagttactttcggcgttgccctcaagactgttagagactggagtacaacagctcacgggtaatccgcagcatcattttcttctgggcctggcggaccaactcacgcggcagccggagcggattagtgttcccctgtcgacgtttctggaacctcatcgtgcgttaccgttagccggcgttgtgttcagcccgtcatcgccgcaggcgtcgcacagcctgaagcatcattggcgccacgataaacgctgggacgtgctactggaatctctcaggccatccggcttaaaagcacgaaagatcggctttccctggcgaagagctgtctctgcctccactgccgccctgatgttactctgggccgcctcaatgacagtctcttttatcgccaaccgccacctggtggcgatcgcacaggagcaggtgcagcaggcctcggcgggaaaacagccgctggccgtacgcctgcatgcgctctccgcgttacagaaaacgctttctcaactggaataccgctcgcagcacggagcgccgtggtacctccgcgctggtctcagccagaatgatgacctgctggcggcgctgtttccgcgctacggggagatggcgcaaccgctgctgcgcgatgcggcggcgcatcatctggaagagcagctcaccgccttcgtgcagctgccgccggacagcccactgcgtgagaagatgacgaagaccgcttacggacaactgaaacaatatctgatgttgatccgcccggaaaaaatggacgctacgtggttcgccaccacgctgatgcaggactggccgcagcgctcaggcatcgctgacgccgtctggcagggcagcggcccttcgctgctggcattttatgccgccagcctggcatcgcatccgcagtggcgtctgcctgtcgatgacggtctggtcagccaggtgcgcacacggttaattcgccaactgggccagcgcaacagtgagtccacgctttaccagaagatgctcgcgcaggtggcgaatcagtatgccgatatgcgcctggcggatatgactgccgacaccgatgcttcgcgtctgttcagcactgatgaggtggtgccgggaatgtttacccgtcaggcctgggagcaggccgtgcagccggccattgagaaagtggtcgcggaacgccgcgatgaaatggactgggtgctgagcgatacgaagcagactgccgcgcagtcgacgtcgccggaagctctgcgagccaggctggcggagcgttatttcgctgatttcagcggcgcctggctggatttcctcaacagtctgcgctggcagcgcgcggcgaccctctccgatgctatcgaccagctgaccctgatggccgatgtgcgccagtcgccgctggtggcgctgatgaacaccctgagcgtgcaggggcgaaccggccagaccggggaagccatcgccgattcgctggtcaaatcggccaggcagctgttcaaccgtgataactcgcccgtcatcgatcaacggtccggcgcgcgcggtcctctggatgccaccttcgggcccgtactggcgctgctggacaatcgcgacggcgggacacccaccagccgtcttagcctgcagaccttcctgacccgcgtcacccaggtgcgtctgcgcctgcagcaggtcaccaacgccaccgatccgcaggcgatgacccggttgcttgcgcagacggtattccagggcaaggccgtggatttaaccgaaacgcgcgactacggcagcctggtggcggcggggctgggccaggagtggagtggatttgggcagacgctgtttgttcgcccgatggaacaggcctggcagcaggtgctgaccccggcggcggaaagcctcaacgcccagtggcgcagcgcagtggtggaggactggaatagcgcttttggcggtcgctacccctttaaaaataccagcagtgaagtctctctgccgctgctggcaaaatacctcaacagcgagaccgggcgcatcgcccgctttctgcagacccggctgaacggcgtgctgcataaagaggggagccgctggatggcggacagtatcaatgctcaggggctgacgtttaacccggcctttctgcaggcgatgaataccctgagccatctctccgacgtcgcgttcgccaacggcgaagcgggattgcattttgcgcttcgccccggcacggcggacggcgtgatgcagacggagctggtaatcgacagtcagaaacttgtctatatgaaccagatgccggtctggcggcggttcagctggcccgctgacaccgaagcgccgggcgccagtctgagctggatcagtacccgggcgggcacccgccagtatggcgatttcccgggcgcctgggggtggatccgtctgctggataaggcggtggtcagcgcttatcccggaacgagcagcagctggagcctgagctggaaagcgccggatggtctgttgctgaactacacgctgcgtaccgaggcgggggaaggaccgctggcgctgctggcgctgcgaaactttacgctaccggagacgatattcagcgtgcgcgcgtctgctgaacgtgttccgctgaccgacgatatacccggcgaagagggatactgaaccttctccctcactgattggcgttaacctgcaacgccaggcctccttcgctcatggccgcccgacggccaactaatctgaccgcgcagccatgctgcgtgtctccctgtagacgaataatggaatattcataatggacgatttaaccctgcgatattttgacgctgaaatgcgctacctgcgcgaggcggcaaaagcgttcgcgcaggctcaccccgatcgggcggcgatgctggatctcgataaagccggtacgccggacccttacgttgagcgcctgtttgaaggctttgccttttccgtaggtcgcttgcgcgaaaaaattgatgatgatctgccggagctgaccgaggggctggtcagcatgctgtggccgcactatttgcgcaccattccgtcgttatcgatcgtggcgctgaccccaacgctgccggcgatgaagatagcggaaacggtgcccgccgggtttgagattagctcccgcccactggggccgaaaaataccgtgtgccggtaccgaaccacccgcgatctgacgcttaacccgctggcgatagatgaggcgatgatgacggcggagccggacgggcgttcggccctgcgactacgattcgcctgtagcgagctggctgactggtcgcagaccgatctccgccgcctggcgctgtacctgggggaagacgccgttaccggcagcgccctccatctgtggctgacccgacgccaggccgcgctgtacctgcgtctgccgggtcagacagagcgggtaagcctcgacggctatttttccccggggggattcagcgaggaggatcgtttatggccgaagggggagagcgctttcagcggctatcagctgctgctcgagtatttcacctttcgcgaaaaatttatgttcgtgcagctaaatggcctggaaaacatcaccctgccggcggggatatcgcatttcacgcttgaggtggtgttccgcgaggtctggcaaagtgatttacccgtcagcgcaagcagcctgcgcctgcactgtgtgccggtgattaacctgtttacccttgaggccgatccgttgaccatcagcgggctggagagcgaatacctcctgcgtccgaagcgcctgcaggacgggcataccgaaatctattctgtcgacagcgtgaccggctccgggcgcaccggggaggcgcgctatgtgcctttcacccgctttcgtcaccagggcgggatgatgcgtcgccatgctcctgagcgctactaccacacccgcgtaaaacggggcgtaaccggcatgcacgatacctggcttatcctcggcggacagcaatgggaggctgaccgggagctggcgcgggaaacggtctccttgcgcatcaccggcactaacggccagctgccgcgccgggcgctacagagcacgctgctggatcgctgtgagtcgatatcagccacgccgcttaccgtccgcaatctctgtaggcccacgctgccggcctatcccccggcggaagaccgctaccactggcgggtcatgagccatctgggcacccgttttctcaacatgatgagcagcgccgaggtgctgcgcggcacgctgtcgctctacaactggcgggaggatgagctcaataatcgccgtctggacgccattctggcggtcagccatcaccgaattcagcgtttcgagcagggcttcctgctgcgcgggctggatatcgaagtgacgctcgacggtagcggatttaccggtgcgggcgatgtccacctgtttggcgacatgctcaaccgctttttcgcactgtatgccgatatgaatcagttcaaccagctgacgctcattgttcaacctgaagggaaatgtatccggtggaaagagaatcacagtctgcgcctgcccggctgatggcgcagctccggcctcagttgccgtacatgaatttttaccgcttctgccagttgctggagaagaaccatccgaaggcgccgatcatcggcagcggctggctattaggtgatgaacccatacgctttcgcccgcatccggggatgggctttccggctggcgaaatccgtggaatggacgatcctgaaccgccccgtccgccggcggttcgcgtgacttttatgggactctacggcgtggaatccccgctgccgacccactatagcgatgacattgcgcaacggcgggaaggcgtcgaggccaccgaggatttcctcgatatctttaaccatcggctgatcgcccagtattaccgtatctggcgcaaatattcctacccggcaacctttcgggcgggcggcacggacaacatctcgcagtatctgctcggcctggcggggctgggcataccgggatgtgccgccgttgccgcagcgccgctgtcgcgatttctggcgctgctgccggtgatgatgctgccggggagatccggggaaggcatggaggcgctggtggcgctcctggccccggggacccgggcgacggtgtaccaccacgatccctgccggatccccttgtcgcagccgttaacgatgagcgtccgtcagccggttagcctgcaacataggccagtgatgggaacccacgccacggatgtgaacggtcaggtattgctgcagctggccacggaaaagcctcatgaggttcgcggctggctgcccggcggcgaactgttcagcgacctgatggcgcttctgcacgtctggctcggatctcatcttgacgtgcggctgcagctttgcgtcgcccgccatttactgccggatgcgcaactttgctgccagcaggagcatgccgtccagctcggccgtaccgctgtgctgcgtcctctggatgcgcagaaacaggctgacgacagagtcacgatttatctggggcgctatcagcgcgtccgggaaaatatccaccgcagggagagcgatgaagatggcgattaccgcagttaaaccctccgccaggttgctggcattcctcatggttaccgtcttaaccggctgcggcctgacgcagaccgtgaaagacggcgccgtttccgtgacccagtccattttttacccccaggtgaaaaccctgcatctggatcttcgcgcccgggaaggcgtgaataacaacgccaaaggcgcctccctggcgacggtggtgcgtatttatcagctgaaggaccggcaagcgttcgacaatactgactacccgtcgctgtttgccggcgatggccaggcgctgcaggcggaccgggtggcggaaaaagatgttcgcctgcgtccgggcgaatcggtgaccgtcgatatgcccatggaaaccagcgcgcagtttgtggcggtggcggccatgtttatcgatccagacctgacgcaaaacagctggcggctggtactcacccgggacgaacttgatccggcgaggccgcgcattatcgaagccagccaaaatcaactgacgctgcacccgtttaaggagaagtgaaaatgcctcgtccctccctgtatgacatcctgtacggcaatttcgccggcgggcttgacctgaatactgtcagcgaaacggatcaggtcatcctgtcggtgctcgataacatgcagcgcatcctcaactgtcgggccggaacgctggcgcatctgccggactacggcctgccggatatgaccgctgtcctccaggggatgccagcgtcggcgcatcagctgatgagcacgttgtcggcggtgttgctgaaatacgaaccgcgcctgcagcggatcgcggtggtgatgctcgatcagcatgcgcccggcgaactgcgctatgccattgatgcggagctgaaggatattggcctggtgcgttacggcacggagtttatgcccgagggcagggtgttgatccgccacctcaaacgtcagcagtaccttgacgcccgctccgccctctaatctctcgctgaaagacatcatgatgacaacacaccacgaccgtcactataaagccggtggcgacccgcgcacgctggctgattttatggccctgcgtgcggaaatgaacaagctcagccacccggcgcggccggatattaactggccgtatgccgagcagcttgcccgcgggctgttggagcatcacggcgcggacctgcagactgtcgcctggtataccctggcccgcgcccggctgggcggggtggcagggatcaatgaggggctgacgctgatggagtcgctgctggttcgtcaggggaaaaacctgtggccacaggcgctcccggcccggacagagatcttccgcaccctgagcaagcggctgcggcaggtgatccgtaccctgaatcttaccccagaggatgttgagtcgcttgagcaggctgaacgttcgctgcaaagcttcgacgcagtgctccagcgccttgagatcgctcctgaaaaccagctgagcgacctgcgggcgctactgcacagcacggcaactcgcttcgagagcctcgaccctgcgccagcgcttcccaccgcgccgccggtggcggtgtctgacgcggaacttcccggcactctggtcagcgaagaggatgcggcgaaggttgagccagtgccagacctaaaacgtagaccaaaggctcagccgctggctccgccttcacctgcaaagcggcccgcgccggtggcggcgtctactccggcagccgcgccgcgctggaagccgtttatcgccgggatggttaccatgctggcggtaacgggtatcgccgtcggcggatggctggcgctgcgtcagtccgacttgccgcccatttcggtcacccaaaatgccggaccgataccgggcctgccggcgacaacgcccccggggccggttgatctgccacagacgcagcgccagcttggcgagcttgcccgcctggcgccggactgggcggtcagctacggcgaccagctggtccaccaggccctgatccgctggccggatcaggcgcaaccgctggcgcagcagtggcggcagcagctgagtgctggcgcattgcccgcggaaaaccttaccggctggtcggagggcatgcagcagctgcagcggctcgccgaccagctcaatgccctcgacgagcagaaggggaagtacctgacggtgagcgaactgaaaaccgcagtatttgccatcacgcagtcgtttaaccgcgctgttccgctggaggagcagctgcgccagctggccgcgcttcccgttgatcaaccctggccagccgcgcggggaagcctcgcggagctgcatctgcaacagctgatagtggagtatgccctgctgaagcgaaaacagccggcgtcgccgaccgctgcgctccccgcaaccggtgagccctcggtgagtgaggcggtgaaataaagtgtgcgcatggcaacattttctttacatcaatattgcaagaaccgaacgcccttcgtagtctgaaaatgatttaaatataccgtttgtagttgtattgaaaattttatttcgatttctgagggcatactatgaagcactgtaaaatcatcctgttagtaggccttctggccagttccgcttcggcattagcagagaagatcggcgtctcaatggcctacttcgatcaaaactttctcactattatccgccagtccattgagaaagaagctcaagcccgccacgtcgacgtacagtttgaagacgcccgcggcgacaccggacgccaggccgatcaggtgcagagcttcatcgcctccggcgtggacgcgatcatcgtcgacccggtggactccgccagcaccccgcagctgacgaagatggcgcagcaggccaaaatgccgctggtgtatgtgaaccggacgccgggggataaaacgttaccgcccggcgtggtgtttgtcggttcggacgagcgggagtctggcacattgcagatggaggcgctggcgaagctggcaaactacaaaggcaacgtcgccatcatgatcggcaatctcaccgacgccggcgcgctgcagcgcaccaaagatgtggagcaggtggtggccaagtatccggcaatgaaagtggtgcagaaacagccggccaactattcccgcagcgagggaatggatctgatgcagaactggacgggtaacggagaagcgattgatattgtggcggcgaacaacgatgagatggcgattggcgcggcgatggcgctggagaaaagccagaagaagctgctgatcggcgggatcgacgccaccccggacgggctgaaagccctggccagcgataagattcaggtgacggttttccaggacgccgtcggtcagggcaaaacggccttagcggtagcgctgaagctgattaaaggagaaaaggtcgagtctcatgtctggatcccgtttgagttagtgaccaaagaaaacatgcagacctatgtggaaaagagtcattaacggcaaggcacaggtgcgcgaacctggctgataaaaccgggctgataatgcgacgcccgggcaactaaatcggaggaaaaaggcatggcaacggcaagaagcggctatacgctgcaggtgataaaggcaggacagcaggggcatgttgaaatgagatgggggcatctcgcagacgttgatacgcgcgcggcggcgacggctatcatgcagcatatcgggcgttcttcgtcctcgcggggccagctggagatcagcctgtcgctgaccaatgccgccagcggtatctcggtggagcttcatcacccggcctctggggaaagcgccaccccggcttttattgaggctgagttaaagaaaattgtgcagatcgttgatggctacgaggcggcagaagatacccatattgtggagtagcgtgtcgcctgggtaaaaaaaaatccacgccgctgcgtggattttttttgcgcggtggcggcgaaaacgccagccagcgggattagacgttgaacaggaagttcatcacatcgccatctttcacgatgtagtctttaccttcagcacgcattttaccggcttctttcgcgccctgttcgcctttgtaggcaatgaagtcttcataagcgatggtctgcgcgcggataaagcctttttcgaagtcggtgtggatcttaccggctgcctgcggcgcggtcgctccgaccgggatggtccatgcgcgaacttctttcacgcccgcggtgaagtaggtctgcaggttcagcagagcgtaaccggcgcggatcacgcggttcaggcccggctcttcgaggcccagctcagccatgaactcgtcacgctcttcatcgtccagctcggcgatgtccgcttcaacggcggcgcacaccggcaccaccacagacccttcctgctcggcgatggcgcgaacctgatcgaggtacgggttgttctcgaaaccgtcttcattgacgttcgcgatgtacatggtcggcttcagggtcaggaagctcagatagcggatggcctctttctcttctttggtcagatccagcgcacgcagcataccggcattttccagctgcggcaggcatttttccagcgcggccagctcaaccttcgcgtctttatcgccgcctttggcttttttggagacgcggtgaatcgcgcgttcgcaggtatcaaggtcagacagcgccagttcggtgttgataacgtcgatatcttccgccgggttcactttccccgcgacgtgaataatattatcgttttcaaagcagcgaaccacatggccgatggcttcggtttcacggatgttggtcagaaactggttgccaagaccttcacctttggacgcgcctttcaccaggcccgcgatatccacgaactccatggtggtcggcaggatgcgctgcggtttgacgatttcagccagcttgtccagacgcggatcgggcatcggtacgacaccggtgttcggctcaatggtacagaaggggaagttggccgcttcaatacccgctttggtgagcgcattgaacagggtggatttgccgacgttgggcaaaccgacgataccgcatttgaatcccatgatttaaatcaccttaatctttggataatcaatctgttacaaggaacagattgcagaaaattgaatagctttgcctattatacacggtgcgcggcaaaaatgccgcacgacaacggcttattgcgccttaaaggcgtgcaaacggttggtcgctttggtcagcccgtcctttaaccagatttcggtacagcgcgccgcttcgtcgacagcgtcatcgatcagtttctgctcgctggccggtggtttgccaagcacaaagccgacaaccttgtttttgtcgcccggatggccgattccgacgcgtaaacggtgaaagttcgggttattgccgagcttactgatgatatccttcaggccattgtggccgccatggccaccgccaagcttaaatttcgccacgcccggcggtaaatccagctcgtcatgagcgaccagaatttcatccgggttgatgcgataaaaggtcgccatcgcggccacggctttaccgctgaggttcataaaggtagtggggaccagcaggcggacgtcctcgcccgccaggttgatgcgcgaggtgtagccgaagaatttgctctcttcgcgcagcggcgcacgatggcgatccgccagtaaatccacataccaggcgccagcgttgtgccgggtggcggcatattccgcaccggggttggccaggccgacaatcagtttaatggtcacgttttctatcctgcatggggcattctctgccgcgtagtgtactgtctgcgggcgcgcttgacaaaattctggctattagacaatacccgcattgatgatttactcactaaatcattagaatttgatatggttcatagacttatttgtaaatttttgtctattcgctgttcactaatgtgatcgtggacgcactccgcagaagagaccttgtctatactacacctataagatttggggacattccctggcaacccaaagtccggaggtgacacatgaaacgcaaaaacgcttcgttactcggtaacgtactcatggggttagggttggtggtgatggttgtgggggtaggttactccattctgaaccagcttccgcagcttaacctgccacaattctttgcgcatggcgcaatcctaagcatcttcgttggtgcagtgctctggctggccggtgcccgtattggcggccacgagcaggtcagcgaccgctactggtgggtgcgccactacgataaacgctgccgtcgtaaccagcatcgtcacagctaaccgtagcatgatttcgcgcatcggccgctgaaggccgatgcgcttttctgtgtctcactttatctcttcctctttttcccgccatattacgcccccattccgtcctggccttcgtgctgctatggttgccagcaaaaatgaatagcaagcgcggtttttgcttgaccctgacgttacgtcaggctgcagagtagcggacctggccacagagaggagcagtcatgttaattcaggtgggagagctggcgaagcgtgccggactgacggtacgtacgctgcatcattatgaacagacggggctgttaacgccttcggccagaagcgaggcgggctatcggctctataacctgtccgcggttcagcgcctgcatatgataaaggcgctggcgcaggccgggctaacgctcgccacaatcaaggactatctcgatcggcaaacgctgtcgctgcccgagctgctgacgcagcagatagatatgctcaacgcccagctacgcgatgttggcaggctgcgcgaccgactattggtgctgcgcgaggcgctggcgagcggcaatgaacccgatctggagtcctggctacagacgctggagttaatgaaaatgtacgatcgttggtttagtcaacaggagttagccgcgctgccgtttgcggcacaggatgaacagagggcgcaggcgtggcgcgagctaacggaggaggtgcagacgctgatggcgagcggctgcccgacggacagtccgcaggcgatgcgtctggcgacgcgctggatggagcgcctggagcaggatacggccgggcgtccggagtttctgacccgcctgaacgagatgcatgccgccgagccgcagatggttgaacagaccggcgtcacgccggcaatcatcgcctatatcaccgaggcctttgccgaaagcaaactggccatctgggcgcggtaccttgacgaagaagagatggcgttcacccgccagcactattttgaccggctacaggagtggcctgcgctggtggcgaagctgcatcaggcgtgccgggagggcgtagcgccggactcggcgtcgggtcaggcgctggcccgggtgtggcttgaactgtttcagtcctacgccggtacccggccgcagacgttgcagaagtttcgtcgggcaatggagcaggagccgcatttgatgaagggcacctggatgacgccggcggtgctgagctggctgcagcaggcgaccggatccttgatgcggcaggcgcagggacctgccgccgggtgatcacaggtcagccagcgcggcctgacgatcggggtagaagctcaggcgtccgggcagcggcttgacgccggcgcgcgctagcgtgcgtagcggctgaaactcgaggttagatacgcgcaattcacagccttccggcagcttgttcacaaagcgctggaaggcatccaggccaccggcgtcgagaaccggcaccgcgtcccatttcagcaccacgatgcgcttgccggcgatccgggtctccagatcgttgaacaagccttcggcggcggcaaagaacagcggcccaattacccgcagcaccagcacatcgtctggcacctcgacgttgaccggcgccagatgagtcatgcgtgcgatacggcgcataaacaacagcgaagccagcacgatcccgacgctgatagcgatcaccatgtcaaacagcaccgttagcgacatgcacatcagcatcaccacgatgtcgtccttcggcgcgtggcgcagcagattgatgactttatgcgcctcgctcatattccatgccaccatcagcagcagggcggccatcgccgacagcggcagccaggagagcagtggggcgaggatcagcagcgccaggatcaccagcagggcgtggatcacggcggcaaccggcgatgtggcgccggcgcggacgttcgccgccgagcgggcaatcgccgcggtggcagtgatcccgccgaagaacggcgcgacaatgttgcccagcccctggccaatcagctcgctattggctttgtgcttggtgccggtcatgccatcaagcaccaccgcgcacagcagagattcaatggcgccgagcatcgccattgagaaggcggcaggcagcagagcctgcagcgaggcccagctcagggtaaagtttgagcccggcatatcccagggcaataccagctgcggcagcagctgcggaatgccattgccctgagtgccgtccgccagctgataatggaactgcgagccgatcgtcgcgacatcgccgccgagcaagttgaccaccagcatgaccgcgcagccgcccagcagcgccgggaggtggcccggcaggcggatacccagccgcggccagaggatcagaatgccaagagtaacgacgccgatggcggcatcgccaacgttaatggtcggtagggccatcgccagcgccgccactttctgcagataatgctccggcacatggggcatctgcaggccgaggaaatctttaatctgcatggtgccgatggtgataccgatccccgaggtgaagccgagggtgactgacagcgggatatattcgatcaggcggccaaagcgcgccaggccaaagaggattaaaaagatccccgacatcagggttgccaccagcagtcccgccagaccaaactgctgggaaaccggatagaggatcaccacaaaggcggcggtcggaccggaaacgctaaagcgtgacccgccggtcaaggcgatcacaatccctgccaccgctgaggtatagaggccgtactgcggcggcacaccgctgccaatcgccagcgccatcgccagcggaatcgcaatgatcccgacggtgatcccggcgatcaggtcacgcgtgaagcgggcggtggtgtacttttctttccaacaagcgtcgatgagggcgcggaaaggcatcacatgtgaggaaaataatctgttcacaataatgtttcatccatgagcgcatcatctgtcaactaaatggcaggtgaaggaggcattgatcatacaaataaggtgcggagacaaaaaaacccgccgcagcgggtttttgtgctgggctcgattaatgttcgaacatagcagagatagattcttcattgctgatacggcgaatagcttcagccagcataccggagagcgtcagagtacgcactttatccagcgctttaatttctggtgccagcggaatggtatcgcagacgacaaattcatcaatgacagagtttttgatgttctggatagcgttgccggagaagattgggtgcgtcgcgtaagcgaatacgcgtttcgcgccacgctctttcagcgcttctgccgctttacacagggtgccgccggtgtcgatcatatcgtcgaccatcacgcagtcacgaccggcaacgtcgccgatgatgtgcatcacctgggagacgttggcgcgcggacggcgcttgtcgatgatagccatatcggtatcattcagcagtttagcgatagcgcgggcacgcacgacgccgccgatgtccggagaaaccacaatcgggttgtccaggttcagctgcagcatatcttccagcaggattgggctgccgaacacgttatcgactggcacatcgaagaagccctggatctgttctgcgtgcaggtcaacggtcagcacgcggtcaacgccgacgctggacagaaaatccgccaccacttttgcggtgattggcacacgagcagaacgaacacgacggtcctgacgagcataaccgaagtaagggataacggcggtgatacgacctgccgaagcacgacgcagagcatcaaccataacaaccagttccatcaggttgtcattggtgggagcacaagtggactggatgatgaaaatatcaccaccgcgtacgttttcattgatttgtacgctgacttcgccgtcgctaaaacgacctacagcggcgtcgccaagagaagtgtacaggcggttggcaatacgttgtgctagttccggggtggcgttaccagcaaaaagcttcatatcaggcacgagaagaacctcaggcatgcgtccagtggtggatgaatgggccaataatgtgcgggatggcgccattcgatccagtcggtgtatttaaagagcacgatgcaacgtctggaacagggtgacgttgtcaccgtaactcaatttccccggctgactcattatcaatgtgccatcacggcgcaggattcagagcagggcctgcttgagcggcgaaaggttaactccgcgcgccacaaagccatttagccatgccggggcagtgtccagcacctgacgggcagcggattcggtgttaaattcagcaaacacacaggctcctgtgccggtcaggcgtgacggcgcatattctaacagccaggaaagcgcggcatcaacctcgcgaaaacgttttcttgcgataagctcgcaatcgttgctgaattcacaatttaataacgtattaattgaccggcgcggggtatttcgtggtagctccggatcgcgaaaaatgatcggcgtcggaatactgacccccgggtgggccaccaggtaccatttttcctcgggttctaccggcgtcagtatttcacccaccccctcggcgaaggcggcatggccgcgcacgaaaaccggcacatcggcccccagctgaaggccaagagtcgccagctcatcttccgagagaccgcagccccacagatggttgagcgccaccagcacggtggcagcattggaggagccaccgcccaggccgccgcccatcggcaggcgcttatcgatactgatatcggcgccgctgcccgccggcaggcgatcgctttcgctggcggcatgcatcagcagacgcgcggcgcgaacgatcagattctcctcgtccggcacgccggccaccggcgtcagcaggcgcagttggccgtcagtacgcggttcgatggtcaacgtatcgccgtaatcgagaaactgaaacagcgtttgcagggtatggtaaccatcggcccgctggccggtgatatataaaaacagattcagttttgcaggagagggccagcgggtcatcatttcacgatccagttatccatcttcagcttgatgcgctgagcgccattgttcagctcgacattggacggtagggctggctgggtatcgctggtgtagccgccgtaggtcacgtgccaggttttgccgttttgcgtatagttcagttcacgcagacggtaccgatcgtccagcgaatagtcggtggcgtcgcccggtaggccgatgatccactggcgcaggctgttcaacgggatcggcatcccggtcagacggccaatcatctcttcggcatcagtggcggtataggtctggcctttgttatcgatcagctgcacgctgcccggctgcgcggtcagcgacagctcggtgctgcccagcgggttggtcagcagcaggcgatagcggtcctggccggtttgctgccagaagaagcgggcatagactttttgctcatcggaaagataggcaaacgccccgcgggtctggaactgattgaggctgcggacagcctgctggtgctgacgccactgcggcgaatccgggcttttgccaggcccttgcggcgtatgaagagaacaggcggtgaggacgaggctggccagcggcagcaggcggaacagtcgattcataatgatgacaaatccttgatgtctacagggaaaaacggcgacagggaacagcgggccgatttgtgtagcaggttacatttataacccttaatgctagcgtcgccgggcgatagcgtctacgttcaagttgtctgaaatcaaaaaattaaccttaatggcggtcttgctttaactattactccaaaaggggagcctctcttttattgattacgcgcatcctgtatgatgcactcagactaaccttagcaacgctggtactactccctcacaatgacccttttagctcttggcatcaatcacaaaacagctccggtcgccctgcgagaacgcgtcacgttttcgccggaaacgctcgataaggcgctggagagcttgctggctcagccgatggtgcagggtggggtggtgctgtcgacctgcaaccgcacggaactctatctcagcgtcgaagagcaggataacctgcaggaagcgctgatccgctggctgtgcaactaccacggcctcaacgaagaagacctgcgaaaaagcctttactggcatcaggataatgacgccgtcagccatctgatgcgcgtcgctagcggcctcgattcgctggtgctgggcgagccgcagatcctcggccaggtgaaaaaagccttcgccgactccagccgcggccatcttaacgtcagcgagctggagcggatgttccagaaatccttttcagtggctaagcgcgtgcgtaccgaaaccgatatcggcgccagcgcggtctctgtggctttcgccgcctgtaccctggcgcggcaaatctttgaatcgctctccagcgtcaccgtgttactggtcggcgccggggaaaccattgagctggtagcgcgccatcttcgcgaacatcacgtgcgcaaaatggtgatcgccaaccgcacccgtgaacgcgcccaggcgctggcggaggaagtgggcgccgaggtgatagccctcagcgatatcgacgaacggctgaaagaggccgacatcattatcagctccaccgccagcccgctgccgatcatcggcaaaggcatggtggagcgtgcgcttaaggcgcggcgtaaccagccgatgctgctggtggatatcgccgtcccgcgcgacgttgaaccagaggtcggcaaactggctaacgcctacctctacagcgtcgacgatttgcaaaacattattcagcataacctggcgcagcgtaaggctgccgcggtgcaggcggaatcgatcgtcgagcaggaaaccagcgaatttatggcctggctgcgcgcgcagagcgccagcgagaccattcgcgaataccgttctcagtctgagcaggtccgtgaggagctgacggcgaaagcgctggccgcgctggagcagggcggtgatgcccaggaaattatgcaggatctggcgcgcaagctcactaaccgcctgatccacgcgccaaccaaatctcttcagcaggccgcccgtgacggggacgacgaacgtctgcatattctgcgcaacagcctcgggctggaatagcgcacctttctcttattttcaggacagggtgaattcacgcctatgaagtcttctattgttgccaaactggaagcgttgtacgagcgccatgaagaagtgcaggcgctgctcggcgatgccgcgacgattgccgatcaggataaattccgcgcgctgtcgcgggagtatgctcaactgagcgatgtggcgcgctgctataccgactggcgtcaggtgcaggaggatattgaaaccgcgcagatgatgctcgacgatccggaaatgcgcgaaatggcgcaggaagagctgcgtgacgccaaagaaaaaggcgaccagctggagcaacagctgcaggttctcctcctgccgaaagatcctgatgacgagcgtaacgccttcgtggaagtgcgcgccgggaccggcggcgacgaagcagcgctgtttgccggcgatctattccgcatgtacacccgttacgcagaatcgcgccgctggcaggtagagatcctcagcgccaacgaaggtgagcacggcggctttaaagaggtgatcgccaagatcagcggcgacggcgtttacggtcggctgaaatttgaatccggcggccatcgcgtgcagcgtgtgccggccaccgaatcgcaggggcggatccacacctccgcctgtacggtggcggtgatgccggagctgccggaagccgaaatgccggacattaacccggcggatctgcgcatcgataccttccgctcctccggggcaggcggtcagcacgttaacaccaccgactcggctatccgcattacccacctgcccaccggcatcgtggtggagtgccaggacgagcgttctcagcataaaaacaaagccaaggcgctgtcggtgctgggcgcgcgcatccgcgccgccgaagtggccaaacgtcagcaggcggaagcctccacgcgccgcaacctgctgggcagcggcgaccgcagcgaccgcaatcgcacctataacttcccgcagggccgcgtgaccgaccaccgcatcaacctgacgctctaccgtctggatgaggcgatggagggcaaactcgacatgctgattgagccgattgtccaggaacatcaggccgatcagctggcggcgctgtccgagcaggaatgatgacctttcaggcctggctgcagcaggcgatcgcccgcctggcggagagcgacagcccgcgacgcgacgccgagatcttgctgggacacgttaccggccgggcgcgaacctggattttggccttcggtgaaacgacgctctctgctgacgaggcggcgaggctggaggcgctcctggtgcgacgccagcgcggggaacctattgctcatctggtcgggcagcgcgagttttggtcgctgccgctgttcgtctccccggcgacgctgatcccccgcccggataccgaatgtctggtagagcaggcgctggcgcgtctgccaaccgcgccgtgccgtattctcgacctcggcaccgggaccggcgccattgccctggcgctggccagcgaacgtccggactgtgaggtcaccgcggtggacgtgatgccggacgccgtggcgctggcgttgcgcaatgccgaacatctgggcatcgctaacgtgacgataagtcaaagcgactggtttagcgcgctggacgggcagcgcttcgccacgatcgtcagcaatcccccctatatcgacgccgccgacccgcatctcgccgaaggcgatgtgcgctttgagccgttgacggcgctggtcgcaggcgaccaggggctggccgatctggcgcatatcatccgcgagggacggcagtatctgcagcccggcggttggatgctgctggagcatggctggactcagggcgaggcggttcgcgcgctgttccgcgaagcgggctatctggacgtcgcgacctgtcgcgactatggcgacaatgagcgtctgaccctcggacgtttacccgacatggagaatgttggctgatgaacttattcacggctgtcctctacctgcacattgccacagtggcggtgtcggtaggattgttcgttttacgttactggtggatgtatcaccagagcccgctgctgaaccagcggtgggtgcgaattgcgccgcactgcagcgatacgctgctatttctcagcggcgcagggttaatggcgataacgcactacctgccgttcacagaagacggcgcatggctgactgaaaagctgtttggcgttatcatttacatcgcattaggttttatcgcgttgggccgtcgtcgtccgcgcagccagcagagccgttttatcgcgttcctgctggcgctggtggtgttgtttatcatcattcaactcgccatcacaagaataccgatactggggtaggtcatggggtcattagcggatttcgaatttaacaaagcgccattgtgtgatggcatggtcctcatttctgaacaggtccgcgacgattttccgtcgcgttttgtcgaggaagagctgcagcgattgctgcgcctcgcgcaggaggagattgcgccgtcgtgggaccaggagcgccagatagaacgattgctggagctgttttatgacgagtggggctttggcgcctcgcagggcgtgtatcgtctttccgacgcgctatggctggataaagtgctggttaaccgccaggggagcgcggtgtcgttaggcgcgatcctgctgtggatcgcccagcgcctggcgctgccggtggtgccggtgatcttcccgacccagatgctgctgcgtgcggacccggaaaccagcgaagagatgtggctgattaatccgtttaacggcgagaccctcgacgagcataccctggaggtatggctgaagggcaacatcgggccggtggcggaactgtttaatgaagatctcgacgaagcggataacgccgaggtgatccgcaagctgctggacaccctgaagtcggcgctgatggaagagcggcagatggagctggccctgcgcgccagcgaagcgctgctgcagtttaatccggaagatccgtatgagatccgcgaccgcgggctgatatacgcccagctggactgcgatcacgtggcgctgttggatctgagctatttcgttgagcagtgcccggaggatccgatcagcgagatgatccgcgcgcagatcaacacgatttcgcataaacaaattacattgcattagtctggaaccattccggttacaccctgataaggcgaacttatgaaacaaaaagtggttagcattggtgatatcaacgtagcgaacgacctgccgttcgtgctgttcggcgggatgaacgtgctggagtcgcgcgacctggcgatgcgtatctgcgaacattatgtcaccgttacgcagaagcttggtattccctacgtcttcaaagcctcctttgataaagccaaccgttcctccatccactcctatcgtgggccgggtctggaagaagggatgaagattttccaggagctgaagcagacctttggcgtgaaaatcatcaccgacgttcatgaagccagccaggcgcagccggtagctgacgtggtggacgtgatccagcttccggctttcctcgcgcgccagactgacctggtggaagcgatggcgaagaccggggcggtgatcaacgtcaagaagccgcagttcgtcagcccgggtcagatgggcaacatcgtcgataagtttatcgaagggggtaacgacaaagtaatcctctgcgaccgcggcgctaacttcggttacgacaacctggtcgtggatatgctcggcttcggcgtgatgaagaaagcctccaacaactcgccggtcattttcgacgtcacccacgcgctgcagtgccgcgacccgtttggcgcagcctccggcggtcgtcgtgcgcaggtgagcgagctggcccgcgccggtatggcggtaggtatcgccggtctgtttattgaagcgcatccggatccggaccacgcgaaatgcgacggcccgtccgcgctgccgctggataaactggagccgttcctcaaacagatgaaagcgattgacgatctggtgaaaagcttcgacgagctggataccagcaagtaagcctgactgcatcagtaaaaaagcctgccggcgtcaaaaccggcaggctttttttcgcccggactccgccgggtgggaaaacggggtcaggcgaaaatggtcatcagataggcggcgaacagcgccatgtgggccgcgccgttcagcacattggtgcgtccggtggagaaggagatatggcacagcaccagcgaggcgaccatcaccaccatctccggggcgccaaggccaaagcgcagctcattgccggtcaggaaggcgatgagggtgaccaccgggaccgtcagcgagatggtggccagcacggagccgaaaaacagattcatcgcccgctgtacctgattgttgagcaccgctttcagggcgccaaggccttccggcgacaggatcagcagagccaccaggaagccggtaaatgccaccggggcattcatgctggtcaacagcgtttccagcgggttagcgttcattttggtaaccgcgatcactgccaccaggtgcaccagcagccaggcggtatgccacccgctgctgtgggcggacggtttaccgtggtgcgggtcgtcatcgtcgctgtcgtcttcatgctcataaacaaacaggctctgatgggttttggtctgaataagcaggaaaacgccgtacatggccgccgaaattaccgccaccagcagcgattgcccggtgctgaagttcgcgcccggcagcgccatcggaaagaccagcacgataatcgctagcggaaacagggcgataagatactgcttaatgccgaacagattcatatattgggtggcgaatttacgcccgcccagcagcagagagaaaccgaccagaccgccggtgacgatcataataatggagtagagggtatcccgcatcaaggtcggcgcggcgtcgccggtggccattaaggcagagatcaaactgacctcaaggataaccaccgacaggcttaaaatcagggagccatagggttcgcccaggcggtgggcgaggacgtcggcgtggcggaccacgctgaaggcgctgctcaaaatgccgaccagtgcgaggatattgatcgcgatgaccactggcagtgactggctgctgccccagaaaaacagccccgccagcgccagcaccggaaagacgagggaagactccttatggcgggtttttaccgcctcatgtgcatgggtcatgaaccatctccatttatgcaggtgttataattataaaaacgtagggcggtaaagtaacagatcttgctaaattaccgctggttttttacttaaatttacgggtatcgagggatatcttgattagtttattataatttatgtttacttatatttagttcttattattcagataattactaaaataatttttctactcattttgaccttgatagccagccgactgcgtaccagacttaaacttaatgctcaaacaggaggtcagtatgccctatcgcagtaaacaagaactccccgacagcgttcagcatgtactgcctgcccatgcgcaggaaatttataaagaagcgtttaacagcgcctgggatcaatataaagataaagacgagcggcgcgatgacgccagccgcgaagagacggcgcacaaagtcgcctgggcggcggtgaagaacagctatgagaaaggcgatgatgataagtggcataaaaaaaaataatcgctgacgccgctttttcgcttgccagcgccccgctgattgcttattgaaagataaagctggataatatttcagcaatattgacggatgcatgagacgaacgccgggaagcgggcagtggcggaggtagtaaacagtgttaactcgtgatttcttaatgaatgcggattgtaagacagcgtttggcgctattgaggaatcgctactctggtcggcagaacaacgtgcagcctcgctggcggcgacgctggcctgccgcccggatgatggctcagtatggatctttggctacggttcgcttatctggaacccggcgctcaattatcgcgagtcctgcaccggcacgctgccgggctggcaccgcgcgttttgcctgcggttgaccgccgggcgcggtagtgcctgccagccgggacgcatgctggctctcaaagagggcggccgaaccaccggcgtcgcctatcgtctgcctgacgacacgctggaggaggagctgaccctgctgtggaagcgggagatgatcaccggctgctatctgcccacctggtgcaagctggagctggacgacggacggacggtgaatgccctggtgtttattatggatccgcgccatccactgtttgaaccggataccagtgcccaggttatcgccccgctaatcgcccgggccagcgggccgctcggcaccaacgcccagtatctgttttcgcttgagcaggcgctgcgtaagctgggcatgcacgatgccagtctcgatgacctggtggccagcgtccgcgcgctgttgggcgagagtccgacgccgggcctggcctgagcgcgcgcaaaagaaaacgcccggcatgaccgggcgtccgattgctgaccagtaaggaaaaagcgtggtttttccttactggtggttatcagccgaaaatcaataaattgattttccttgttatttttctggtgcaatctgcaagtacaatgattgcatggggtttgtcatgaatctcacgcccggcatgaccgggcatgtgttctggcagtgacggtcaggccggcacgtagctgatggagtgctccagcgactggctgtgactgtcgataagcacgttccaggtgccgctgtagggcaccgtcagataggcgctgtcccgatcctgcacgctcagaatatccgcatgactgtcgcccgggaccttcgcgctcatcagatgaatatggcagcgctctgagcaccgcaccaccagcgtgtcaccaccaaataacgtcaaacttgctttaaccatcgccattttataccccgtttctgtcccgctacagcatcctgcccacccagtcctcgcgtgatattgttcacactttgctctgtgcatcacaccaaacggcgcgggtcgggatgctgattttgatcaaaaaaagggataaagattaaacaaaaatgacgttgttcctgaaagcattcagctaacgttttttttacctctgcaggcggcgaaacctgatatttcctgccgtttggcgccccagattcagaaggtcagcactttatctgccgccagggtccactgggccagctcaacgagagtgccaacctccacgccgtcaaccagcggcagtgcgctgaccccgcggccgtccgcgcaggttttacacagcttcacgggaacctgctgggcggtgaggatctccagcatctgctgcacattatacccttctgccggcttctgcccccgcagcccggcggtgacggcgtcggacatcagaaacagcttgagatcgaggtcggactgctgctcgcgcagggcaatggccaggcgcaggctgttgaacagggattcgctgccgtaggcggcgccgttggcgatgatcacaatacgttgcatacaaactccttcttaaaggcacggttattgctttaggcagtataaagcgttaacccggaggaggggtatgaataatacgactggtcatgcgcacgatgcgacggcctggctgcagctggcgcgtcgcctgcaaaaacaacagcttcagcagcttagccaactgggggaactggccagccagctcagcgcgctggtgcatatgctgcagtgtgagcgcggggcgtcgaatatctatctttgctcgggcggcttgctgtatacagcggagtgtcgggcgggaggggcgctggttgacgagcggctagccctgttttatgccagcctcgaacgggcgcgcgcggtagccggcagcgcgctgtgctggcgtatcgccagagcggttgacgagctggcgcagctcccggcgctacgcgcgcagatcggccgccggcaaattgccgctgaagccgcgacggagcagttcagccgcgtcatccgccatctgctgaacatcgccccgcagctcaatgacagcattgacgatccgccggtggctggtcggatggtcgccctgtacagctttatgcagggaaaagagctggtgggccaggagcgcgcgctgggagcattgggctttacccgcggcgagttcagcgacagcctgcgccagcagctggtggaccgtattgacggtcagcagccctgcttcgacagctttcaggcgctgggcagcccggcgaccgtccagttgttcagaacccagtgccacgccggtctggatattgaacagctgcggcggatcgcctgtacccgtcagccggctgccgacggcggggaaacggcgctgcgctggtttggtctgcaaacccaacggcttgagcaactgcgcgaagtggaagagcaactgatcgacgatctgctggatgccaccgacgcgctgttagcagacgacgcgcctggctggcaggccggagaggaagacgatagcgtgacgccacggctcgataaacagctactgccgctggtgcgccagcaggcctatgagctgcagcagctctccagccagctggcctcgctgaaagacgcgctcgaagagcgcaagctgatcgaaaaagcgaaaagtctgctgatgacgcaccagggaatgcaggaggagcaggcctggcagacgctgcgcaagatggccatggacaaaaatcagcgtatggttgagatagcccgcgcgctgctgatggtgaaggcgatttggccgctaacaccaaaggagtagatgcacaatcgatgggcattctttgcatgccggcggtgcacttttaggtgaaaaaccggctagcgttgggaaaaagcccgccagcgcgctattgccaaagctggcatcccgtttgcattacttattaagtgaataaaagtccgggcaacgaaccaatggcggttcgggtgtccgtggataaaggcgtcctgcagtgcgtatgcactgtcgggcgctttttttttgcgcatggtggagcggatatgggcgacaaattttcaatttcccggcggcgcttgctgcaggcaggggccgcgctgggcggcgcgatgctgctgccgggcgtgatgcaggccgcctgggccggcggctcggacaaaccggagcaaacccgcgtgcgggtcggatttattccgctgaccgattgcgcgccgctggccatcgccgcggcgaaggggtttgaccaaaaatatggcatcaccctggtggcgagtaaggaagccagctgggcggcggtgcgcgacaagctggtggccggcgagctcgacgcggcgcatattctctatggcctgctgtacggcctcgaactggggatcgccagcaagccgcaggcgatggccaatttgatgaccctcaaccgcaatggccaggcgattaccctctccagcgagctgcaggagaaaggggtgaccgacctcggcgggctgaagcggctgatcgaccgcagcgcgccgggcagttacaccttcgcccatacctttcctaccggcacccatgccatgtggctttactactggctggcgagcgccggcatcgatcccttcaacgatgtgcgcaccgtcgtggtgccgccgccgcagatggtgatgaacatgcgcatcggcaatatgagcggcttttgcgtcggcgagccgtggaacgcccgcgctattaacgaccgtatcggcttcaccgcggccacttcccaggatatctggcccgagcatccggaaaaggtgctgggcacccgtcgcgactgggtggaacgcaacccgaacaccgcccgcgcgctggtggcggccctgatggaggcgcagcgctggatcgccgcctcgccggagaacacccgggagacggcccgcctgctcgccagacgcggctggctcaataccaaggagcaatacctcaccggccggatgcttggagagtatgacaacggccttggccgccgctggcaggatgcccatccgatgcgcttctgggccgggggcgaggtgagtttcccgtggctgtcggacgggatgtggttcctcacccagttccgccgctgggggttgctgaagcaggccccggattacctcgcggtggcgtcgcgcattaaccgcatcgatgtctggcaggctgccgcccaggcggtaggagggatcagcgcgccggcagccaggatgcgcagcagcacactaatggacgggacggtctggaacgggtccgacccggaaggctacgcccgccatttctctattcaacgtaagggggcatgagatgaagcaggcacaacgtaagcaaccggtcgtcagcgtggacaacgcgcctggcgaagtgattatcctgccgccggtgcaggtccggcgcaccacgccgaccgtcacgcgctggctgcgtgagctcacccagcgcctgctgcccccgctgttggggctgggtgtgctgctgctggcctggcagctggcggcgatgcatagcaaaggctttcccacgccgctgagcacgctggactcggcgctgaccctgtttgccgatccgttctatcaggacgggcccaatgacatgggcatcggctggaacgtgctggcctccctgcagcgcgtggcggtgggcttcggcctggcggcgctggcgggcattccgctggggtttttgatcggccgttcgctgttcttcgcccgcatgtttaatccgctgattgctctgctgcgcccggtcagcccgctggcctggctgccgattggcctgctgctgttccagaaggcggagccggcttccagctggaccatttttatctgctccatctggccgatggtgatcaacaccgcggagggtgtgcggcggatcccgcaggactatctcaacgtcgcccgcgtcctccagctctcggagtggacggtgatgcgcaaaatcctctttccggcggtgctgccggcggtgcttaccggcgtgcgcctctccatcggcatcgcctggctggtgatcgtggcggcggaaatgcttaccggcgggctggggatcggcttctggatctggaacgagtggaacaacctcaatgtggaaaacatcatcatcgccatcgtcattatcggcgtcgtcggcctgctgctggagcagggcctgatgctgctcgctcgccgctttagctggcaggaaaaataaggagccaacatgaaaccattaattcaggtgcaggccgtcagccaacgcttcaacaccgccagcggtgagttcctggcgctgcagaatgtctccttcgatatcgtcgaaggggagaccattagcctgatcggccactcgggttgcggaaaatcgaccctgctgaacctgatcgccgggatcaccacccctaccgagggcggactactgtgtgataaccgggaaatcgccggtcccgggccggagcgggcggtggttttccagaaccactcgctgctgccgtggctgagctgtgtcgacaatgtggcgctggcggtggatcaggtgttccgtcgcaccatgagcaagagtgagcgccgggagtggatcgaacacaacctggcgcgcgtacagatgggtcatgcgctgcacaaacgtcccggggagatctccggcggcatgaagcagcgggtgggtatcgcccgggcgctggcgatgaagccgaaagtgctgctgcttgatgagcccttcggcgccctggacgcgctgacccgcgcccacctccaggacacggtgatgcatatccagcaggagctcaataccaccatcgtcatgatcacccacgacgttgatgaagcggtgctgctctcggatcgggtgctgatgatgaccaacggtccggtggcgacggtcggcgagatcctctcggtcgatctgccgcgtccgcgccaccgcgttcagctggcggacgacagccggtatcaccatctgcgccagcagatcctccatttcctgtatgaaaaacagccgaaagcggcgtaaggaggcggtcatgacgcggcgactggtggtgatcggtaacggcatggcggccacccggctggtgcagcggctggttgagcgcgaccccgcgcggtttgccattaccgtcgtcggcgacgagccgcacccggcctataaccgcattcagctctcgccgctgctggcaggtgaaaaaacggcggcgcagatcccgttgctgccggcggagtggtacacccggcacggggtgtgcctgcggtctggcgaggcggtcgatgaagtcgatattcagcaacggcggctgcgcatcgcggaaacctggctgccgtgggatgagctggtgttcgccaccggttcgcggccctttatcccgccgctgccgggcattgatcgtccgcaggttatgcccttccgcaccctggcggacgtggaacgtattctggcgatacccggcccggcggtggtgattggcggtggggtgctgggggtggaagcggcggcggcgctgcgtcgtcacggcggagaggtcactcttctgcatcgcggcagcggattaatggcgccgctgaccgacgcttttgccgccgatgagctcaggcagcagcttgaagcgcgcggcattcgctgcgtgctggcgtgccgcatcgccgccatcgacgccgatggcgtgcggctggcggacgggcgcgtattccgcgccgccagagtggtgctggctaccggcgtgcagcccgacagccgtctggcggcgcagtccggcgtgctgtgccagcgggggatcgtggtcgaccgtcaga

SEQ ID NO: 83 - DNA, 34967 bp, Unknown
  source: /note="Description of Unknown: KP2-Mcoc1 Bacteria Sequence"
cggcgagggtgtgcggcggcagcgcgttgcggttcagtttgccggtggcggtcagcggcggttcagcgagctgcatcagcaccaccggcaccatatgcggcggcagctgttccgccagccgcgctttcagcgccgcggtatccagcggcaggccggagtcagagaccagatagcccaccagctgtcgcgcatcaccgccggtcgccgccgcctggttgaagacgcaggcgtgactcaccgcctgccccacgtccggcagggccaacatcacccgatcaatctcgccaagctcgatgcgctgcccgcggatcttcagctgatcgtcgctgcggccaaggtactccaccgcgccgttcgtcagccagcgcgctacgtcgccggtgcgatacatccgctcgccgggggcaaacgggtcggcgataaagcggctggcggtgagatccgggcgccccagatagccctgcgccagctggatgccggtgagataaagatcccccgccacccccggcggcaccgggcgcatcgcggcatcgagaatgcgcagcccggtgttccacaccggccagccaatcggcacgctgctgccggtcaccgccgccagctcagatccgcaggccgggtaccagctgacgtccaccgccgcctccgtcgggccgtacagattatgcagcggcgcgccggttaagcgctcccactcgcggcacaattccgtcggcagcgcttcgccgctgcagaatacccgccgcagcgtgcggcaggcggccacgctgtcggcatccagcgaggcgacaaacgccgccagcatcgacggcacaaagtgggtggtggtcacaccgtagcgggcgaagaactgctgcatcgcctgcgggtcgcggtgcgcctccggctcggccatcaccagctgcgcgccggcgataaacggccaccagaactcccacaccgacacgtcgaaactgcacggcgttttctgcgccaccacgtcgtcggcagataacggatagcgatcctgcatccacagcaggcggttgacgatggcggtctggccgaccatcacccctttcggccgcccggtggagccggaggtaaagatgatgtaggcggtatggtctggttttgacagcgccagcggcgcctcatccccggcggccagcggctgctggtagcagaggctttccagcccggggatatcgctgaagcgggccagttgatcctccgtggcgatcagcagcgacggccgggcgtcttccagcatcatccgcaggcggtcgtccgggtagccggtgtccagcggcagccaggcggcccccgcttcgacaatgccgtgcagcgccagggtcaggaacaccgagcgcggcagggccaccgccacgctgtccccaggcttcacgccgcgctgacgcagcagctgcgcgagcgccaccacctgctgacgcatctcgcgatagctgaactgccagcgggcgtccgccagcgccggcgcatccggggtcttccgcgcctggtcggccaccagcgcgctgagggtggtggcaggcagcggcacaacggtatcgttgaccgccgccagccgggccagctcgtcggcggagagcatctctgcttcgccgcagcgcagcgccggatcggcggcgaactgcgccagcagcgcggtcagtcgcgccatgtggcgacggagctcggcttcgtcgtaccgggccttgttggcgaggatctccagcgacagcccgccggtctcatccgggaacagcgccagctcgagatcgttgaccgggccggtggcgagggtgtgggtcactgcctgcacaccatcgatatccagctggtaatcaaagactttgacgttcagcaccgggccgaacagcggttcgtcccctgccgctttgccgctgtcgcggacgatctgctcggcgtcatagcgctgatggcggcgcatctttttcagctgaccggcgaggcgcatcgccaggtccgccagcgtctcccgggcgtcaatatgcaccgccagaggcaggacattgagcaccggccccgtcgaggtcagcgcggctgaacccatccggcgcataaagataaagcccgccgcgtagtccatccggttgcacaggcggcccagccacagcgtggtgagcgccagcgccaggtcagcgggctgacactgcggcgcatggctggccaggcggcggaagccgtcggcgttcatctctagcttcatccgccagatatcgctcccggcggcgcgcccgcccagcggcgcggcagagagtgaggcaggcgccggtaacgcctggcgctgggcctgccagaaagctttatcccgctgccaggcctcgctgccggcgtagcgctggtactcgtccaccacctcggcgaagggggtgaaaggcgactcaggagtagcttccccccgctgccaggcgcgataaatggcggcgatctgccgggttatcgccgggaagctgaagccatccaccagcaagtggtgataacgctgataccagtaccagcagtcgtcgccgacgcgcagcagttgatggcacaccagcgggttgccgccgtcgacgcgcagatcctgcgccagatccgcctgcatccgctccgtggcggcgcgatgcggatccggcgccgtccgcaggtcaatgatcgacggttcgccaaaggtgcggtcggccgccagccactgccagacttccccctcctcttcctcaaagcgcaggctgagggtgtccgcctgctgcagaccggcgacaatcgcttttcccagcagcgtcgggtcgagggcgccgcgtagttcaacatagtgggccacgctccaggcgcctggcagagtggagaggcgctcggccatccagatccccggctgcgcggcaaccagcggtaaacgagtggtcattgtcagctccttatgacgcatgatgggcgggggtcagtgtcgaccagttggccgccagccaggcgttgcaggcctcggccgactgcggggggcacaccaccgtccagccggcaggcaggtcgcagtgcgccggccacaggctgtactgctgttgatcattgcgcagaatgtaaaactgcccttgcggattgtcgaaggggttactgaattgcatatcaaactcctgtcgtaaaacgcgatgctaagggtgcgacagcagaggctgccagagctggataagccctgccgtcagcccgccgcgccagcaaagcgcatcatgcccgccgtcaacctgacgccagaaaatcgtctgctgtgttgtggtgagttgcgccagtagcgcctggttcgcgcgaaaaatgatcggttcgcgttggcccgcttccagccagacgcgcagcccggccgcggacacctcaccctggcgaagctgttcgccgataaagcccatcccgcggccatcgcggtgcggccaccagtaggagcctgactggctgagcacgcagccaaagcgctgcggccagttgagagcggcgaacatcgccgccagaccgccgaagctttgcccggccaccaccgtccgatccgggcggtcgctgaacggggcatagccgtggaccagcggcaggagctcctcctgcaccgccagccagaaatcgcggtgacagggcagctcaaccccgcggcgctggttgtcgatcgcgtcgatcagcaggtagaccgccggtggcagtcttccctcgcgggtcagggcggccagcggcgaccacaccggcatgctctcggcccagaactggccgtcgagcaggatcgccagcggccgcgtttgcgggtcgacggcctcgccggtggtgtagatccagacccggcgatggttgcccagacgcgcgctgcgccactcaaggcaacgggcggcaggatgcgcctcattaagcgggtcccagccgggctgcgcgggggcctgcggcatctccagggcggacacgccatggccgcgtccgccccgccagctgtgcgggttcagcggatcggctatcgcccgcggcagcagtttgcgccagccttcgcgtagcagcgcgcggtcgggcgcatcagcgctgaacacctcaggggaaaaatcatcgtcacggtcggagggaataaaacagtagctgccgcgccaggtcggcgacagcgtagtgcgccagaaccaggcgtcggtcccggggagacgttgcagcgattgcggacgcgcattctgatggtggtcggtcacgccggtgatatagagccatacccgacgatggggagagcaggtttcatcccccgccgggtcccgccaccagaacgttacctcgatggtgtcatccactgcgcggcactgcggcccccgcagggttcgccaccactcctcgcttcctgtccttaacattctgtaattaaccctatgtatagcgtgacttttttaattaattgtcattatttattgataatattattgataactatttgcatttgcaatagcgtattagcgcgccgtgggaagcgcgtctttcatcagaacatgtcaaatcgggcctattcagccagcgacggagtgcctttgcccgcttttggcaacatttatgccgcctcccctcccggtgggaaggggcgtttggggaacgtggcgacaaaaagcaggaataacaatgaataacaggatcaaatccctggccttgctggtcaatctgggaatttacggggttgcttttccgttaagcgcagcggaaaccgccaccgacgataaaaacagcgccgctgaagagaccatggtggtcaccgccgccgagcagaacctgcaggcgccgggcgtctccaccatcaccgccgatgagatccgcaaacgccccccggcgcgcgacgtctcggagatcattcgcaccatgccgggagtcaacctgaccggcaactccaccagcggccagcgcggcaacaaccgccagattgatatccgcggcatgggcccggaaaataccctgatcctgatcgacggcaagccggtcaccagccgcaactccgtgcgccttggctggcgcggcgagcgcgacacccgcggcgataccagctgggtgccgccggagataatcgaacgtatcgaagtgattcgcggcccggccgccgcccgctacggcaacggcgccgccggcggcgtggtgaatatcatcaccaaaaaaaccggcgatgagtggcgcggctcatggaacacctatatgaacgccccggagcacaaggatgaaggctccaccaaacgcactaacttcagcctcagcggcccgctgggcggcgattttagcttccgcctgttcggtaacctcgacaaaacgcaggccgacgcctgggatatcaaccagggccatcagtccgagcgtaccgggatctatgccgatactctgccggccgggcgcgaaggggtgaaaaacaaaaacatcgatggtctggtgcgctgggaattcgctccgatgcagtcgctggagtttgaggccggctacagccgccagggcaacctctacgccggcgatacccagaacaccaactccaacgacctggtaaaagagaactacggcaaagagaccaaccgtctgtatcgcaacacctactcggttacctggaacggcgcctgggacaacggggtgaccaccagcaactgggcgcagtacgaacgcacccgcaactcgcgcaaaggcgaaggcctggccggcggcaccgaggggatctttaacagcaaccagttcacggatatcgatctggcggatgtgatgctgcacagcgaagtcagcattcccttcgactatctggttaatcagaacctgacgctgggcagcgagtggaatcaacagcggatgaaggataacgcgtccaacacccaggcgctgtcgggaggcgaaattccgggctacgacagcaccggccgcagcccgtactcgcaggcggaaatcttctcgctgttcgccgagaacaacatggagctgaccgacaccaccatgctgactccggcgctgcgtttcgatcatcacagcattgtcggcaataactggagcccgtccctcaacctgtcgcagggcctgtgggatgacttcacgctgaagatgggcatcgcccgcgcctataaagcgccgagcctgtatcagaccaacccgaactacattctctacagtaaaggccagggctgctacgccagtaaagacggctgctatctgcagggtaatgacgacttaaaagccgagaccagcatcaacaaagagattggcctcgagtttaaacgcgacggctggctggcgggcgtcacctggttccgcaacgactaccgcaacaagattgaagcgggctatgccccggtctatcaaaacaataaaggtaccgatctctaccagtgggaaaacgtgccgaaagcggtggtggaaggtctggaggggacgttgaacgttccggtgagcgagaccgtcaactggaccaacaacatcacctatatgctgcagagtaagaacaaagagaccggcgatcgtctgtcgattatcccggaatacacgctgaactccaccctgagctggcaggttcgcgatgacgtttcgctgcagtcgaccttcacctggtacggcaagcaggagccgaagaagtacaactacaagggtcaaccggtcaccggcagcgagaagaacgaggttagcccctacagcatcctcggcctgagcgcgacctgggacgtcaccaaatacgtcagtctgaccggcggcgtggataacgtcttcgataagcgccactggcgcgcgggcaacgcccagaccaccgggggcgccaccggcacgatgtacggcgccggcgccgagacctacaatgaatcgggccgcacctggtacctgagcgtcaacacccacttctgatagcgggttctccctcccccgcccttgctggacaaagggcgggggcaaccgcggtaaccttatcctatgcgccaccatcgcaccgttttgcctctggccggctataccatccagcagatcgacttcgacccggcgactttccagcctgaagatctgttctggctgccctatcacgccagcctgaccgggtggagccgcaagcggcaggcggagcacctggccggacgcatcgccgcggcatacgccctgcgcgaggtgggggagaaacggcttcccgccatcggcgatcggcgccagccgctgtggcccacgccctggttcggcagcataagtcattgcggccagcgcgcgctggcggtgatcgccgatcggccggtgggcgtcgatatcgagcgccggtttaccccacagctggccgcggagctggagagcagcattatcagcccggcggaaaaaacggcgctgctgcgcagcggcctgcccttcccgctggcgctgacgctggcgttttcggcaaaagagagtgggtttaaggcctggtcctcacacgcttccggcctgcccggcttccacagcgcccggattgtggcactcactacgcagcagatccatttacgttttaccgccagcttctccctgcaacttgctgatttcccccttaaaatcaatcatctgataaaagacgatctcgttattacctgtacctgcccgactcgcgaagcgtgatccttttcgctttttaagaaattacctgtgcaaaccgtagacagttctgactggccgctttatggttacattgaataataaatcattattgaatatatattcaatgcggagataataatgaaaactaccctgataaagtctgttctgtttgcctccatgatggccgcatctggctcacttttcgccgccgataatggcctgatcgcaatcattaccccttcacatgataatcctttctttaaagccgaggctgacggcgcagcggcgaaagcaaaagaactgggttacagcaccctggtcgcctctcacgacgacgacgtcaacaaacaaaaccaactaattgaaacggctattgcgcggaaagccaaagccatcatccttgataatgctggcgcggatgctaccgtcggcccgctggaaaaagcaaaagcggcaggtgtgccggcatttttaatcgacagggagatcaataaaaccggcgtcgccgtggcgcagatcgtctctaacaactatcagggcgcccagcttggcgcagaaaagtttgccagtctcctcaacggtaaaggcaagtatgtcgaactattaggtcgtcagtcagacactaacgccagcgtccgctcgcagggttatcacgatgtgctggacgactatccggaaatgaaaatggtcgcccagcagacggcgaactggagccagacggaggcctttacccgtatggaagccattctgcagacgaatccggatatcgtcggcgtgatttccggcaacgataccatggcgctgggggcggaagcggcgctgaaagccgcgggtaaaaacgacgtgattgttgtcggcttcgacggcagcgactacacgcgcgactcgatactcaagcagggcaacattaaggccacggttctccagcccggctggaagcaggcgcaaatggccgtggaacaggcggactttttcctgaagaacgggaaagcccagaaagaagagaagcagttgatggactgcatcctcatcgatagtggcaatgcgaaaaaactcaacatgttcaacctcagcgagtaaggcggaaatgatgcggttaaaacaatggggcgccgtgctgatgggctgcgccgccctgttgctgacggcctgcacggtggtggacttagatgagaatggcaagccagtgctgcctgccgacccgaacgcgaaacccagcttcgaccatctcaccccgcagcagatcgcgcaacaaacctggcaatctcgagtgattgacgcagcgaaccaacatgcgctggacgcgactgcgctggaaaaagtgcgccaggcgtctggcgctacgccacagagcgtctttgtccgcctgaacagcgaggtgaccgggactgacgtcagcaacccacgcgagcaaaagctcactcttacgctactgggccagccgttggtcgtgcagttgggtcctgtcatgagaggcaacgccattcgcgatgccagcggttttaaatttgaagactttaccaaccaggtgcagtttgcgcagctttcacgcgcctacaaccgggaggcaataaaatcgttgccgacagtggacgcgagctgggcaggcaaacctgtcgatattctctttgcggccacggtggttaacggcagcctgcaggatgcggccgctcttgcgctaaaacaggaggcgcgctgatggccagttcacccacagaggagatcattttacgcacccgtggtatttccatgctgttccccggcacggtggccctggataacgtcgactacaacgtctggcgtggcaaagttaacgtgatcatcggcgaaaatggcgcgggtaaatcaacgctcatgaaaattctcgccggtgtgcaacagccgagcctgggcgaaatggagctcaacggtaagcttgtccatttctccagcacccgcgaggccgccgcccacggcattggtatggtccatcaggagctgaacctgtttgaaaatcttagcgtcgcggaaaatatctttcttggtcgcgagctacagcgcgggcttacgccaattaacgaagcagagcaggaacgacaagccgcggagctgttgcagcgactcgatcagccgatctcgccgcgggagctggtgggtaacctgaaggtcggtcagcagcagttggttgagatagccaaagcgctggcggaaaatgcggacattctgatccttgatgagcctacatccgccttaagcaaaaccgaggtggatatcctgtttcgggtcatccgcgagctgacgcgtcagggggtgtccatcatctacatctcacaccgtctggaagagctgatggccatcggcgacgtcattaccattctgcgtgacggcaaattccaggcggaggccagggtgagtgaaattgatgtgccatggatcgtccgtgaaatgctgggaagcgatccggtaagtcattttcttcccccgaatcgccgcttcggtgccccactgctggaagtggagaacctgacctgcgtgaatgccgcgggcaatacggtggtggataacgtcagttttaaagcacatgccggtgaaattattgggatctacggtctaatgggcgccggacgaaccgagctgtttgaatgtctgctggggacagcgcgccactactttggcaagatctggctggacagcaaaccggttccccagcggttaaccacggccgaacgcatccgcatgggcatgagtctggtgccggaagatcgtaagcggaccgggatttttccgatctcttcagtcgccagcaatctgaccattgccagcctgtggcgtcgtcttcagcgcggggtaaccattgccaataaagaggaagaggccgtcgtcgccagcacaattggcaatctatccatcaaggtctcatcaccaggagtcgagatccaggcgctcagcggcggcaatcagcaaaaggtggttattggccgttcgctgttaaccaatccgaaggtgctgtttcttgacgagcctacgcgcggaatcgacatcggcgccaagggggatgtgtttcgcatgatggtgcaattgtcgcagcagggaatggcggtggtgttctccacctccgatttaaaagaaatcatggcggtctctgaccgtatcctggtgatgtcaggcggcaaactgaccgccgatatcgttcgtgaccaggccgaagagtcggcgctggtttcagcaagcgctcaggggttctaagatgaaaatgacacaatcggtcgcactggcgccgcgcggcggagcctctctctcccgtgaaaatatcctgctgttgttattaaaactgcgcacctttatcgcgctgttcctgattgtcggcttcttcacgatgaccgtgcccggttttttatccgctggcagcatggtgattatgattaaacacattgcgattaacgcctttctggcgttggggatcacctttgtcattatcactgccggtatcgacctttcgattggcgctacgctcggtctctgcggaatgatagccggctggcttatcaccaaagggatcgtcttgccgatgttcggcatcgccatttttccaagcgtgtgggtcattgtgcccctggtgctgctgataggcgcgctgattggcgccgttaatggctggatcattacccgctacaatgttgcgccgtttatctgcaccctcggtactatgtatgtgctccgcggagccgcgatgctgacctctgatggccaaaccttccccgggctcgcgggcaatccgcagctgggcaacacgggtttcgatgaaattggcgcaggtgcgctctttggcatcccgtgggccatctggctgatgatcctcctggcgctgatcatcgcctatatcgcccggcgtttgccttttggccgccatgtttatgcgatcggtgacaatgagcgtgccgccgagctatccggcgtgaaagtgaagcaaattaaagtgctggtctacacgctgtccggcttttgcgccgccatagccgggatcgtggtctccgcacagctgctggccagccatccggctaacggtaccgcttttgagatgaatgctatcgccgccgtcgtactgggcggaacatcgctggccggcggccggggaaccattctgggtacgctgattggtgcgtttgtcatcggttttctcgccgacgggctggtgatgatgggggtaagcgagttctggcagatggtcatcaaagggatcgtgattattgtggcggtcattatcgatcagatgcaaaaccggatgcagcagaaggcggcggtggtcgcccagaaagcggtcatggagaataagtaaccgcaagacctcctgtggctcaggccacagggggagcgggcctgactcacgatgcgcctttctccgaggcgcttcgcaaaatctcatcgaaaaatcctgcccgacggcaagcagtggtagcatcccgccattctgctctgccaggcaaggaagccatgaaaaaacgtcctcactcgaccccgcacgacagtctgtttaagcgctttctgcgcgacagcgaaaccgcacgcgattttctggatattcatctgccgcccgcgctgcggcaactgtgcgacttaagcactctgcacctggaatccgggagctttgttgaggacaacctgcgcgccagctattccgatattctctactctctgcataccagcaagggagagggctatatctatgtcgtcattgagcatcagagcaccccggacagccatatggcgttcagactcctgcgctatgccctcgcggccatgcaacagcatcttgatcgcggccataaagcgctgccgctggtaattcccatgctgttttatcatggcagcatttctccctatcccttttcactgtgctggctggacgagttcccacctgactcaccggcaaaacagctttatctcggggcctttccgctcgtcgatgtgaccgatattcccgacgacgccatattacagcatcggcggatcgcgcttctggaactggtccagaaacacatccgtcaacgcgatctcagccatatcctccagcagttggtggaggtggtgctgatgggatacactgaccaccagcagttcaaaacgttatttacctatatgtcgctgcatggcaatagcgccgacccggaaaactttatcgaccagctggtcgaacgtctgccgcaatatgaggataccctgatgacgattgccgagtacctgaagcagaaaggtcgcgaagagggaaaacaacgctggttacaggaaggcttgaacgaaggtttacaagcgggtgaacatcgcgaagcctgccgcatcgcgctgatgatgttagagaacggtatggacactgaaaccgtgttgcggatgactcgcctcagcgcggacgaactggcgacgctggcgcgccaggcacgccagtcttcacccccgcttaacccttaattaacgcgcgcgcggtcgggaagtcggtgatcaggacatcaatatagtcgccctgcaacgcgccgcggatggcgttctctttgtccacgccgccagccagcgcaatcacctgcggacaacgacgaatttgctcaagctccataccgatcaccggatcctcatcctggctcagtaccggtttgcccgccgcattatagtaatgcaggcagatatcccccaccgcgccgcgcgccgccagcagctggagcatggtttcattataatagttaccggaatttttcagcagctgcgaaggctccagttcacctataccgacgatggccacatccacttcggcaaatttcgccaccaccgccgcgacgtccggactgtttaccagacggctgcgctcctccacggagtgctcaatactctgcgacggcaacagccaagccgggcagcctaaatgagccgccagctgctgggttaaaatggtagcctgcacgttgccgttgggaccgacgccgcccaacagctgaatcaccccggcggcgcgaatgttctgcggatgcatctcatccaccatgcagcggatcgtactgctccaggacgagatccccacgaggtcttccggccgcagccgcgtttcgacatagtgcgccgctgcgctgccgatggcatgctttacctgactgtaactggcgttctcgcccacatccacgactatcgcctgtcgaatgccaaaacgctcctcaatcgccttttccagatcgacaaaaatgtttgtcggctggaccacggtaattttcaccagcccctctttctgacagcgggtaagcgcccgtgaaacaaaagactgggacagatgcagcagcgaggcgatctcggactgctttttattctcgctgtagtaaagcgtggcgatcttcaccagcaaccgctgttcatcctgcttcgacatggcattcccctctgttttctgctcgttatttttatgcatcattgaatagataacaagcgcagcgcccttttcccgacgatccaaatgtgatcgttttctccttttttagaaaataggccgtacaaatcgtggacaaaccccgtcgcagggcatatcttaccaatgtgaataataaatcagtagtgaatatatattcaatcacttattaataccttgttttgtcgacgataaaaggtagtcaggatgggaagtgtttctttaccctgctggaatatttattcacacaagaatttactttcaagaggtgttttatgaatccgttttcactctccgttaaggagttagaacaaaaagcacgcgccatccgccgccgcatcatcgtcttaaatgcggaaagcccggctggcggccacaccggtgccgatctgtcacaagtcgaacttctgaccgccctctattttcgtatccttaactgctcccctgcgcgaaaagagagtgacgaccgcgatatctatattcagtcgaaggggcacgctgtcggtggttactactgcgtgctggccgaagcaggctttattcccgttgactggctggcaacctatcaacacgccgactcggctctgccaggacacccggtaaagcacaaaacgccaggtattgagctcaataccggtgcgctgggccatggtctgcccgtggcggtaggcattgcgctggcagcgaaacgcgataacaacccgcgtcgcgtatttgtcgtcaccggcgatggcgaactggcggagggcagcaactgggaggccgcgctggtcgccgcccactaccaactggataaccttattattatcaacgacaaaaataatctgcagctggccggtgcgaccaaagagatcatgaataccgatccgctggatgaaaaatggcgcgctttcggcatggaggtcacacagtgcaacggcaacgatatggcggaggtggtcgccacgcttgagcgcttgcagccgaacgggaaaccacacgtcgtgattgctaacaccaccaaaggcgcgggtatttcctttattcagggacgccccgagtggcatcaccgggtaccgaaaggagaagaaattgaactggcgctggaggaactgaaagatgagtaatagcgaacatctcgccacggtgatggtgaatgcctttattgatgccgtagaccgcggcgtggatctggtgccggtggtggccgactccacctcaacggcgaaaattgctccgtttatcaaaagattccctggccggctggtcaacgtcggcatcgccgagcagacgctggttggcgctgccgccggtctggcgctgggggggaaagtggccgtgacctgcaacgccgcgccattcctcatctcacgagccaatgagcagattaaggtcgacgtttgctacaacaacaccaacgtcaaactgttcgggctgaacgcgggcgccagctacggtccactggccagcacccaccacagtattgacgatatcgccattctgcgcggttttggcaatattgaaatttacgcgccgtccagtcccggcgagtgccggcagattattgattatgcccttgcccacgtcgggccagtgtatatccgcctcgacggtaaagcgctgccggaactgcatgatgaacgttaccggtttgttccgggcaacattgatgtgctgcgtctggggcgcgatattgcgctggttgccatgggctcaacggtacatgaaattgtggaagccgccgcacaactcgctgcagaaggtattgacgccaccgttatcagtgtcccatctattcgtccttgtgatacccaggcgctactggcggcaatccagtcctgtccggccgcgatcacggtggaagaacacaacgtcaacggcggcgtcgggagcctggtggcggaagtgctggccgaggccgggtgcgcgatcccgttgcggcgcttaggtattcctgacgggcaatacgccattgccgccgatcgcgccgccacgcgcgcgcgccatgaaatcgatgccgccggggtggtgaagcacgcccgcaagctgcacataaaaaaagcatcctgaaaaataacaagaacatcttactggagagaacgcaatgtcccgaattcctcaacaactcaccatgggcgtcattattggcaaccggggatttttccccagctatctggtcgccgaagcgcgcgaacaggcggtagccctgtttagccgtcttgggattaacaccattatgcttgatccatcccagacggaactgggtggcgtggaaacccggcaggatgccaaaatttgcgccgagctgttccgcagccaccgcgacaatattcacggtgtcgtggtgctgttacccaactttggcgatgagaaagccatcgccgaaacgctgcgcctctccggtctcaacgtcccggtgcttattcaggccgaagaggataatctggataaaatggggttgtcgacgcgccgcgatagcttctgcggcaaaatttccctttgcaacaacctgcgccagtacggtatcccgtttacgctgaccacccagcacgtctgcgcgctcagtggcgaagtgtttgagcaggatctgcggcgcttcacgcagatatgtcgcgtggtgaacagtatgcgcggcgtgcgcgttggcgcgatcggcgcccgtccagcgggctttaacaccgtgcgctacagcgaaaagctgctcgaacgtttaggcatcgcagtggaaacgttagatctatcagaggtgtttacccggattaaagccctgcgtgatgacgatattcgtgtggatgagaagcgccgcctgctgatcgataatgccgacgccagcggtattccggcagataaactggtcaccatggcaaaactgtttgtggtcctgagcgagtggattgttgccaacgacatcgacaccaccgcaattcagtgctggacctcgctgcaggaaaatctggggattaacgtctgctccatcatgagcgtgatgtccggacaactgatgccaagcgcctgtgaggtcgatgtcatgggcgcgctctccatgtatgcgctcgccagcagcaacctgagccccgcctcgatcgcggactggaacaataacttcggcgacgatcgcgataaatgtgtgctgtttcattgcgggaactttgcctcggccagccttgagtcgccgcacatgggaacggccgatattatcggcaccaccgtcggcaaagaaaacacctgcggtgccgtgcatggtcgcatgaaaagcggcgcgctgacctattttcgcctcagcaccgacgacctgactggcgaaatcaaagcctacgtcggcgaaggtcggtcggttgacgatcccctcgatacggtaggctgtcgggcggtcattcaggttccccacctggaaaatctgctgtcgtggatctgccgcaatggctttgagcaccatgtcgcgatgaaccattccgccagtgccgcaattttgcacgaggcatttacgcgctacctgggcgtgtcgacctatctccaccagtgaggccggaggccgctatgtcggtaaacaaggatattattattgccctcgatgagggcacaaccaatgccaaagccgttgccttcgacagccacgggcgggtaattacgcaattttcccgcgcgcttgagatcgctacgccgcaggaaggatgggtagaacagtcagcggagcttctgcttgccgcgtcgctggaggtgatttctcgcgcagtggccgccgttggcgcggagcgtgtagccgccctggcgatcagcaaccagcgcgaaaccgtcgtgggctggtatcgggaaacgggcgaggctatagcgcccgccctgagctggcaatgtgcacgtactgccgcattttgccacatgctgcgtgaacaaggtcatgagccgcagatcaaggcggtaaccggcctgccagtcgccccgctcttttccgcctcgaaaatgcgctggctgctggaccacactccggatggtctgaaccgagcgaaaaatggcgagatttgcctcggtacggtggatagctggctgctctggcacctgacgcaaggccagcatttttgttgtgattatgccaacgcgtctcgtacgcagctcatgaatttgcacacagcggactgggataccgatatgctcgccctgtttggcattccgcgtgcagcactcccggtgattaaaccttcgagcggcctgtttggttacaccgcgggtttagccaccctccctgatggcattccggtaatggcgatgattggcgattcgcatgccgcccttttcgcccacggtctgggcgccgccggttgcgttaaagccacttacggtacagggacctcggtgatggcgcccgttgattcggtggcgtgtcacgtcagtaatctcgccaccacggtggcctggcacgacggagaaaaactggtctatgcactcgaggggaatattccccataccggcgatgcggtggcgtggatggccgacagtaccggattgagcgaacgcgctcccggcgaactggcccaggcgctgaatgatctgccgcgctcggtcgactccaccttaggcgtcttttttgtcccggcgctcaccggcatgggcgccccctggtgggacgataaggcccgcggtttgatccatggattaagccggggcgtgaagcgggcccatctcattcgtgccgcgctagagtcaattacctaccagattgccgatgtaatcactgcgatgcgtgcccatcatggctttacgctcaacacgctgctggtggatgggggccccaccaaaaacgactggttaatgcagtatcaggccgacctgctggggtgtccggtgatgcgcagcgatgtggccgagctgtcggcgaccggtgcggcactgctggcgcgtaaagcgttgcacaagctgacggtggcagagcttcagccctttttaccagaacacatcacttatgcgccagacctgatccggcatcatcggcttgtgcagcgatggcagtcctggcaacacgcggtgacgctggcaagacgctgagcgcaacccagccgggcgataacgtcttcgtccggctgcaatccaacgccccctgccgttaacccagcggatactgttgaaacgccggcagcgcctcccccttctccgccagcgcgcgaatatgcggaaacgccgcggccgacaccaccgccgggatcatcaactggataaaggaccagaccaccgtgctggtgaccagcacctgatccggctgcgcggcggcggcgcggtctgccagccgggcgtcccactcccgacaggcggccagcagctggccggtcacccgggctatccacggctgatgctgcttctcttccggccgcagacggtgctcataaacatgctggaccgctttttcacaggcggcgaggatcacccccagcaggtgcagatcgcgggccagcgcctcgggatgcgcgggaagcagccggcgcccggccggattggtcgtttcgaaatagtggaggatcagcgtggagtccatcagctgcgtcccgttatcgagcaccaccgtcggcgccttgaccaccggattaatgcgggaaaattcgtcaaagccgctaaagaccgatagcggcaggctctcgaattccacgccatagagcgccagagaaaccgccacgcgtcttacataaggtgaatccatcataccaatgagtttcatcgtcactcctgcctgcgataaagaggttgcggctttaccttactggaaaaccgatgccgcgaatatcaccagatacttaccgcaatggttagtaaaactaacagataggcgactcgctgtagccctccagttccccttgtgctataccgactgaggcagcatttagcccctttttcagcctgttcgcggcggctataaaacccgctaacccggtagtaacgttaacgtatcgactcactgactaagagatcaccatggcagattttccccctgtcgccagcctgcgcagctttgaggcggtggcgcgcctcggcagcgtaacgcaggccgcccacgagatgagcgtgacccattcggcggtcagccagcacatcaaacagctggaagccctggtcggcgtcacgctctttatccgccacggccgcggagtgcgcatcacggaagaaggacggctctatgccctgcaaatccgcgaggcgttacagcacatcgccgacgccacgcgcatggtgcagatcaaaccccgcaccctggaagtgaccctggcgacgctcccctcctttggctgccactggctgctgccgcggctggcgcgctttcaggcgcggcatccgcagatcgcggtgcgcctgctgaccagcctggcggtggttaacctgcaacaggagggtatcgatctggccattcgcatggggcaaggcgactgggaggggatggaaagccggcatctgtttgccgatgaacagctggtggtcgccgcccccggctatcgcggcggtaacctgccgaccaccccgcaggcgatcgccgccagcgatattattttttccatggagtcctggaacgcctggtgcagccaggcggggctggaaaagccgatcgtccccgcgggcctgcgcctgaacgactctaatctggtgctggaggcggtccgcctgggggccggcgtggcgctggagcggcgctccctggtggcgggggcgatagcccgcggcgagctggtgcagctcaccgccgtcaccgtcccctacccctggcactactggctaaccgtctccccgcaggtggagaaccggccggaagtcgcccggttcatcgcctggctggaggaggagatcgccctctggcgccagcagatcagcgcttagccttcggccgacggcggcaggcccgtccgggcggcgtgctcctgggagagacgccaaaaatcgtgcccggcgggatactgatagaggcgcagggaaaactgtccggccaccgcggtaatgtactcaaatatcgccgactgggtgttttcgtagtctttccacagcgttgaggtggtgaagcagtaaatctccagcgggatgcccgacggcgacggtttcagcgttctcgccacaatgtacatctccttaataatatccggccgctcggcgagatagtgcatcagatagtggcgaaacagggtcaggttggtcagcccgttatcgataaaccagcggtcggccacgccgccgggatcccggccgtcaagcagcgtcgccagaggctcactcaccccgcggatggtcagcatcgaggagagcatctcctggtcgagaaaacgcaccgagtgctgatcgatggcgatactgcgcatgatccgccgcgccccggaggagaacatcgcctgccagttggtataggtctcggtgaggaaattcttggtcgggatacgggagatggtattgtcccagttgcggatggtaatggtgtgcagcgcgatatccgtcacctcaccgctgaggttcttgtcaggcatttcaatccagtcccccagctggagcacgtcgttggacgacagctgaacgttcgccaccagcgacagcagagtatgctggaacacgatcatcagtaccgccgccacggcccccagactggagatgataatgatcggcgatttgttcgacatcacggcgaggatcatgatcgccgccaggatgtggactaagattttgcctatctggatatagcccttaatggaatgatttttacgtttggtctttcgcagataggagctgttgacaatatccagcatctcgttgaaaaacaccgacataaaaataaaaaacaagatcccgcagatagtattaatcgccgtcaccagcgatgccggcatcgccggcataaactgcagaacgtaatagacgataataaccggaatgaaattggacagcttttcggcgatgcgtcgatccttctccagcggcacatcctgtttgtggctactaaagaagaccttacgcaccactttaatcagcaagaacttgcataaaagatgggcaaatatgccggagagcagcagcagaataagattaaaccccaccgccagcgccggattactctcaataaacgtcagtagatgattcacatacgccatgctttatcgcctgaataactatgccacttcgctaactgctttatcccaagggcatatatttggaaaataaatcaatccgcatcatggcatatcgcttagcgtaacgtccatgcgcgcaccgcttctaatcattcacagaaaatatgtcagagtttgcattaatcattctctacgctcactataaagaggcttgttatgaggacggaataagtccaggaggaaacatgtttaaagctcttaccgctatcgtcgccttagccgcctccgccagcgttatggcgcaaggcgatgtcacgctgaacagtctggctcacgatgccgccacccgggcgtcgtttaaccagatggtcaaaggccatcagctgcccgcctgggtgaccaccggcggcaccggttcgcccgcgcagacggtgaaactgggtagcgaatcctggcaggtgttaagcgcctgcaaaccccacgactgcggccatgaacgtatcgcggtgatctggtcggaaaaaagcaaacagatgtccggcgtttactcggtggtcgatgaaaaaaccgaccaggagaagctgacctggcttaacgtcagcgatgccctgtccatcgatggcaaaaccgtgctgtttgccgccctcagcggcagcctcgacaaccacccggacgcctttaactaccagtaacgaccatcgcccccgtcagcctttccccgacgggggcttccctgattagccatccgggaacatcacgctgttccccggcgcttcccgatgcagatggataaagttcaggtgccgctcgtactggtcgagaatatcggtgatcacctgctctttgctgtagtccatcaggtcgttaccctgactgccctccagcaggaaggtctccagccggtaataggtggatttcccgctgcgcgcccgataggtaaagcccggcaccgagtactgctgcggccagatcttgtagataaagttctgctcgtcgcccatgtgcaccagcagatcgaggtggccaaggttctcaccctcttccggcggcaggctcttcagttccactgccgcgccgcgcagccgcagctcctgggccacctcctccatcgccgggtagcacaccgtctccatcatcagtttggtatagcgcgtgccggggtaattcatcagccgcgacaggcgcttcttccagctcagacgatcctggaggcccatcgggcgcggggcggtgtcgcggctggcgctgacccggcggtaatcttccactttcagagatttatacagtccggccatcacgaagaaaatcacaaagctgaacggcagccccatgatcaccgtggtgttctgcagcgccgagatgccgttggtcatcagcatcccgagggtcaacagaccgatggccaccgaccagaagatgcgcagccagttcggggcgtcgctgttgatgtccttcagcttcgaggtgaagttccccagcaccagcgcgccggagtcggcggaggtaacgtaaaacagcagaccggtgatggtcgccaccgacgcgctaaaggtaaacgccggatactgcgccagcaggctgtagaagccgcgctccgggtgggccatcgcctcctgggcaaaggccgcgtcgccgtggatgatctcatacagcgcgctgttgccgaacaccgacagccacagcagggtaaaggtgaagggaataatcagggtgcccatcacaaactggcggatggtgcgcccgcgcgaaatgcgcgccaggaacaggcccacaaacggcgaccaggccacccaccacgcccagaaaaagagcgtccagttgttcatccattctaccggccggtcgaaggcgaagctgttcagcgtcatgcccataaagcgattgacgtagtcgccgacgttgagcactaacgcattgagcaggaaggaggtatcgcccatgaacagcacgaacaggatcagccccagcgcgagggcgacgttcagttcggagagcacgcggatgcccttgtccaccccggaggtgaccgagatggtggcgatgatcaccgacagcgcaatcagggccgctttcgccgccagcgagtccggaatatcgaacagcacgctcagaccgtagttgagctgcacgacgccgataccgagggtggtggcgatgccgaagatggtgccgatcaccgccgcaatatcgacgctgtggccgatgggcccattgatccgtttgccaaaaatcgggtacagcgccgagcggatggtgagcggcaaattataacgatagctaaagtatcccagcgccatgcccatcagggcatacattgaccatccggttaagccatagtgaaacagggtccagaccatcgcctggcgcgccgcctcgatggtctgccccgccccttccggcggctgcatatattgcgtcaccggctcggcgaccgagaagaacatcaggtcgatgccgatgccggcggcgaacagcatcgccgcccagctcagcaggctgaactcgggctttgactgctccggcccgagcttcaccgagccgaagcgcgagcaggcaatgcagacgacgaagacgatatacagcgtcgccgccagcagatagtaccagccgaaggttttcgacacccagtccagggtgcgcccaatccactcggcagaaaaatcgcgaaaaaagatcgtcatcagggaaaacaacaaaatcagtccggccgaggtataaaaaaccaccggattgattttgtccttttctctgctttgcgaaagatctgtcatccagtatccccactgtttttgtaactattaaaatccaaatccgcaacaattaagacacattttatattgaacgtccaatcaaaaaccgctttaatagttaaccaacgctgatgaatggagtggcaaaaatgcccaaactggggatgcagccgatccggcgcaggcagctgatcgacgccacgctggacgcaataaatgaagtcggaatgcacgacgcgaccatcgcgcaaattgcccggcgggcgggcgtatcgacggggatcatcagtcactatttcaaagacaaaaatggtctgctggaggcgaccatgcgcgacatcaccagccagctgcgcgacgcggtgctcaaccgtctgcacgctctgccggacggcagcgccagccagcgcctgcaggcgattgtcggcggcaactttgatgagacgcagatcagcagcgcggcgatgaaggcctggctggccttttgggccagcagcatgcaccagccgatgctttatcggttacagcaggtcagcagccgtcgcctgctgtcgaacctggtgtacgaattccgccgcgagctgccgcgcgagcaggcgcaggaggccggctacgggctggcggcgctgatagacggcctgtggctgcgggcggcgctcagcggcaaaccgctggataaaacgctggcgcagtcgctgaccagccactttattcgtcagcatttaccgaacccataaccgaggaggcgttatgtcccgaatggcagaacagcagctttatattaatggtggttatacatcggccaccagcggtcgcaccttcgagaccatcaaccctgccactggcgaggtgctggcgaccgttcaggctgccggacgcgaggatgtcgaccgcgccgtcgagagcgcgcagcgtgggcaaaaaatctgggcggcgatgaccgccatggaacgctcgcgcatcctgcgtcgcgccgtcgaccttctgcgccagcgcaacgacgagctggcgcgactggagacgctggataccgggaaacccctcagcgaaaccgccgccgttgatatcgtcaccggcgccgacgtgctggagtattacgccggattgatcccggcgctggaaggcagccagatcccgctgcgcgacagttccttcgtctacacccgtcgcgaaccgctgggggtggtagccgggatcggcgcgtggaactacccgatccagatcgccctgtggaaatcggcgccagcgctggccgctggcaatgcgatgattttcaaaccgagcgaagtcaccccgctgaccgccctcaagctggcggaaatttacagcgaagcgggcctgccggacggggtgtttaacgtcctgccagggatcggcgcggaaaccggccagtatctgaccgagcatccggacatcgccaaaatatccttcaccggcggcgtcgccagcggcaaaaaagtgatggccaactcggccgcttcatcactgaaagaggtcaccatggagctgggcggcaaatcgccgctgattatcgccgacgatgccgacctcgacctcgccgccgatattgccatgatggccaacttttacagctccggccaggtgtgcaccaacggcacccgggtgtttgtcccggcgaaacggaaggcggaattcgagcacaagatcctcgagcgggtggcccgcatccgcgccggcgatctgtttgccgatgacaccaacttcggcccgctggtcagcttcccccatcgcgacaacgttctgcgctatatcgagagcggcaaacgcgaaggcgcgcgcctgctgtgcggcggcgaggcgctgaaaggcgacggtttcgataacggcgcgtgggtcgccccgacggtgtttaccgattgcagcgacgagatgaccatcgtgcgcgaagagatcttcggcccggtgatgtcgatcctcagctatgccgacgaagcggaggtcattcgccgcgccaacgccaccgaatacggcctcgccgccggcgtggtgacgcccaacctcaaccgcgctcaccgaattatccaccagctggaagccggcatctgctggatcaacagctggggggaatccccggcggaaatgccggttggcggctacaaacactccggcattggccgcgagaacggcgtcatgacgctgcagagttacacccaggtgaagtccatccaggttgagatgggtaaattccagtccatattttaaccgggaggtttttttgcaatttgactacatcattattggtgccggctccgccggcaacgttctggcaacacgactgactgaagatccaaacaccaccgtcctgctgctggaagccggcggccctgactaccggttcgatttccgcacccagatgcccgccgcgctggcttatccgctgcagggcaagcgctacaactgggcctacgagaccgaacctgagccgtacatgaacaatcgccgcatggagtgcggacgcggcaaagggctcggcggatcctcgctgatcaacggcatgtgctacattcgcggtaacgccatggatctggataactgggccaaagagccgggtctggaacactggagctatctcgactgcctgccctactaccggaaagcggaaacccgcgatatcgggcctaacgactaccacggcggcgatggcccggtgagcgtgacgacgccgaagccgggcaataatccgctcttcgaggcgatggttgaagccggggtgcaggcgggctatccgcgtaccgacgatctcaacggctaccagcaggaaggctttggcccgatggaccgcaccgtgacgccgcagggccgtcgcgccagcaccgcccgcggctatctcgaccaggcgcgcggtcgcccgaacctgaccatccgcacccatgcgctgaccgatcacattatttttgccggcaagcgcgcggtgggcgtcgagtggctggagggagagagcacgatcccgtcaaaagcgacggccaacaaagaggtgctgctgtgcgccggggcgattgcctcgccgcagatcctgcagcgctccggcgtgggtaacccggagctgctcaggcagttcgatatcccggtggtgcacgatctccccggcgtgggtgagaacctgcaggaccatctggagatgtatctgcagtacgagtgcaaagagccggtatcgctctacccggcgctacagtggtggaaccagcctaagatcggcgccgagtggctgttcggcggcaccggcatcggcgccagcaaccagttcgaagcgggcggttttatccgcagccgcgcagagttcgcctggccgaacattcagtaccacttcctgccggtggcgattaactacaatggctccaacgcggtgaaagagcacggcttccagtgccacgtcggctcgatgcgttcgcccagccgcggccacgtgcgcctgaagtcgcgcgacccgcacgcccatccggcgatcctgtttaactatatgtcccatgagcaggactggcaggagttccgcgacgccatccgcattacccgggagatcaggaaccagccggcgctggataagtatcgcggccgcgaaatcagtccgggaatagaatgccagagcgatgccgaactggatgagtttgtgcgcaaccacgccgagaccgcgttccacccgtgcgggacctgtaagatgggttacgacgagatggcggtggtcgatggcgagggccgcgtccacggtctggaaggattgcgggtggtcgacgcctcgatcatgccgcagatcatcaccggcaacctcaacgccaccaccattatgatcggcgagaagatggccgacgccattcgcggccgccagccgctgccgcgcagcaccgcgacgtattatgtcgctggcgacgcgccggttcgccgctaacaggtcaatgccgggcggcgactacgccttgcccggcctaccctgaggcgatgtaacgtagccccggtaagcgcagcgcgatcggggtgccgttccgggttttggccccataggttgatgttagcgaaacgcctccaggcgcttaatctgctgaccgtcggcagtaaagttctccgccgccagccacgcccgcagcgccgcatcgcgcgcaggccactcgccgtcgatgatggacagcatatcgctgtcgcgcgtccgccctttacgcaccagcctctgccgcagacgtccttcccagctaaagcccagccgctcggcggcgcggcgcgaggcgacattcatcgaatcgcatttccactccagccgacgatagccatggtcaaagccgtttttgagcagcagccagaccgcttcggtacccagcggggtgtttttcatccgtcgcgaccaggtgacatggccgatctcaaccgtgcccatttcccgttcgatcgccatatagctaacgatgcccaccgcctgctcgctacgcaggtcaaccaccgcatacggcaccagggcatcatcattcaccttgcccgcgatccagtgggcggtcgccgccacgctctccggccgcgtagacgccagccacgtccagtcgctgttgtcgccgagcgcataggcggcaaacagatccgccgcatgacggtcaacgtccagcggctccaggcggcaaaaacggccatttaacgccgtccggcgcaggacttgcgccccctgccagccagggaccaggtcgttcacctgctggccatactcattgatttccggcacacccacctcctcgcaatagacaatgcgttatagcaagaaccccgcagcggagaaaggcgcttctgcgcgaccggcaataacctgtcgttcttgaatatgcatttttagcataaggatatccttattttgactttacgccttatggcaagcggcctaacgtagcgaggcataaaacaataaaataaccattcttcagggattgcacatgaccaaaaaactgttgcctttactgctactgtcggcgctctccgccgccgcgcatgccgccacgccgcccaacacgctggtggtcgcccagggtctcgacgatatcgtcagcctcgacccggcggaagcgaacgaactctccagcattcagacggtccccagcctctatcagcgtctggtgcagcccgaccgcaacaaccctgaaaaaatcgtaccgatcctcgccgaaagctggcaggccgatccggcggcgaaaaccctgaccattaaactgaagccggatgccaaattcgcctccggtaatccgctgcgcccggaagatgtgattttctcttacacccgcgcggtgacgctgaataaatcgccggcgtttattctcaacgtgctcggctggcagccggacaacatcgccagccagctgaaaaagattgatgaccataccctgacgctgcactggaccgccgacgtcagcccggcggtggcgctgaatattctctccacccccatcgcctctatcgttgatgaaaaacaggtggcgccgaacgcgaaaaataacgacttcggcaacgactggctgaaaatgcactcggcgggcagcggggcctataaaatgcgcgtctaccagccgcatcaggccatcgtgctggaggccaacgccagctcccccaccggcgcgccgaagatcaagagcatcattattaaaaacgtccccgacccggcttcccgccgcctgctgatccagcagggggatgccgacgtggcgcgcgatctcggcgctgaccagattgccgccctgcaggataaacccggcgtgaaggtgctgagcatcccgtccgccgagcagaactacctggtgtttaataccgccaacagcgccaacccgctgctcaataacccggccttctgggaggcggcgcgctggctggtcgattatgaaggcatcaccaaaaatctgctgaaaggccagtactttattcaccaaagcttcctgccggccggcctgccgggggcgctggagactaatccgttcacctttgatccgcaaaaagctaaggctatcctcgataaagcgggcattaaggatgcccacttcaccctcgatgtggagaacaaaccgccgtttatcaccatcgcccaatcgctgcaggccagctttgcccagggcggggtgaaggtggatctgctacccgccgccggcagccaggtctatgcccgggtgcgcgcgaagcagcatcaggcggcgatccgcctgtggatcccggactactttgatgcccactctaatgccagcgcctttgcctggaacgatggtaaatccagcaccgtggccgggctcaacggctggcagatccctgagctgaataaagccaccctcgccgcggtggcggagccggacccggcgaaacgcctcggcctgtacaaaacgatgcaggaaaccctgctccagcattcgccgtacgtcttcattgaccagggaaaaacccagatcgtggtgcgtgacaacgtgaagggctatcagcagggactgaacgccgacatggtctggtacgataacgtgaccaagtaagcgggttttgtcaccgggtacggcggccttgtctgcccggatgaccgactcctcacccaggcccggtcggcatcgcgccgccgggtacaatgctgatataccaggaatttccattttccatgccatcgtttcccactcaccttacccgcctgctgcaggggctgtttacgctgctgctcacgctgttcgggctgttgctggtcaccttctcgctctccgcgctgtcgcccgtcgaccgcgtactgcagatcgtcggcgaccatgccagccagtcgacctatgaccaggttcgccatcagctgggtctcgaccagccgctgccggtgcagttctggcactacctggtcaacctggcccatggcgatcttggcatcgccagcgctaccggccagccggtgctccacgacctgctggcggtctttccggcgacccttgagctggcgaccctggcgctgatcgtcggcgcggtactgggcatcgtcgccggggtgctgtgcgcccgttacgccggttcgccgtgggatctggcggttcgcacctttaccctgttgggcaactcggtgcccattttctggctcggcctgctgatgctggccctgttttacgcccggctgcagtgggcgccgggcccgggtcgcctcgacgatatttatcagtacaccgtcgagccacgcagcggttttgcgctgatcgacacctggctctccggcgataccgcggcgtttaaaaatgcgatcggccatctggcgctgccggtgctggtgctggcctattactcgctggcgagcatcacccgcctgacccgctccgcctgtctgagcgagatgaacaaagagtacattctgctggcgcgggccaaaggggccggagagatgacgattctgctgcgccatgtcctgcccaatatccgcggcactctgctgacggtaaccgctctagcctggacctccatgctcgaaggggcggtgctcaccgaaaccgtcttctcgtggccggggatcggccgctacctcaccacggcgctgttcgccggggataccacggcgatcatgggcggcacgctgctgatcggcgtgagttttgtgctgatcaataacctgaccgacctgctggtacggttaaccgatccgagggtgcgctgatgccgacttatctgtttttacgccgtctgcgccgctcacccgccgccttcagcggcctgaccctggtgatcctgctggtgctgaccgcgctgttcgccccgtggctggcgccgcacgatcccaactggcaggatgccgccgctcgtctgcaggggcccggggcgggacactggctcggcaccgacagctacggccgcgacctgctgtcgcgcttgctctacggcgcccgcccggcgctgggtctggtggcgctggtgaccgccattaccctgcccgtcgggctgctggtaggtatcctctccggttactatggcgggtggctggagcggatactgatgcgctttaccgacgtggtgatgtcgatgccgcgcctgatcctcgccttcgcgttcgtggcgatgcttggcccggggctggtcaacggcgcgctggcgttagccctgaccacctggccggcctacgcccgtcaggcgcgcagcgaaattcagcgcctgcgccatagcgactacctcgccgcggcggagatgctgggcattcgcggcgggcggctgctggtcggccatattctgccgctgtgtctgccgtcggcgattgtccggctggcgctcgatctggcgggcattatcctcgccgccgccgggctcggctttctcggcctgggcgcccgcccgccgatggcggagtggggagcgatgattgccgacgggatgcaggtgattttcgaccagtggtggatcgccgccatccccggcgcggcgatcctgctcgccagcctggcgtttaacctgctgggcgatggcctgcgcgatattctggagccgcaacatgactgacatccgactgaccgtccagggactcgccgtcgactatcccaccgcccgggtggtggacaacgtcagcttcaccctcggcaacgagcggctggcgctggtgggcgaatccggctccggcaaatcgatgaccgcccgggcgctgatgggcctggtgcgcaagcccggggtggtgagcgctgaacggctggaggtgctggggcgcgatgtgctgaccctcagcgcccgcggctggcgcgcgctgcgcggcaacgatatcgccatggtgctgcaggacccgcgctatgcgctgaatccggtgcagaccattcagacgcagctggaggaggcgttaaccctccatcagcgtctcagccgccgcgcgcgcgccgaggcggtcaaagacgccatcgccgccgtcggtctggatctgccggtcctcagccgctatcccggcgaactctccggcgggatgggacagcgggtgatgatcgccctcgcgctgctcaataacccgaaggtgctgatagccgacgagccgacctcggccctcgacgcccgcctgcgcaaccagatcctcgagctgctggtggagcagagcgcgcagcggcagatgaccatgttactgatcagccacgatctaccgctggtagccgcgcattgcgatcgcgtgctggtgatgtaccaggggagacaggtcgacgagatgccggcgcgggcgctgccgagcgcgacgcacccttacacccgcaccctgtggacctgccggccaaatgcgcacacctacggccagatgctgccgaccctcgacagaacccaggactttacggagacagcccatggcgatcgttaatcttcaggatttacaggttacattcggcgcgaagacggcggtctccgccgccagtttccgtgtcgccgccggggaaaccttcagcctgatcggcgcctcgggctgcggcaaatcgacgattttgcgcgtgctggccggattgcagcgtgaatggcgcggcagcgtggatctgctcggccaggccattatgccgggcgcccgctttcagggcgatctgcggcgcaacgtgcagatggtgtttcaggatccgtacgcctcgctgcatcccaaccataccctgtggcgcaccctggcggagccactgcagatccacggcatccgcgacgttgccccgcgagtaaccaccgcccttgagcaggtgggtctggccgccgacgccgtgcgccgctatccgcatcagctctccggcggccaacggcagcgcgtggccattgcccgcgccctgctgctgcgcccgcagatcctgctgctggatgagccgacctcggcgctggatatgtcggtacaggcggaaatccttaatctacttaatcgtctgaaacaggagcacggcatgacctatctgctggtcagccacgatgccgacgtcatcgcccatatgtccgatcgggcggcgtttatggcggagggcgtgatccagcgctttttcgatcgcgaagcgttggtcaacggagagcaccggatgaggtgaggtcagcggatgtgcggttgttttgtcgggtggcgcttcgcttacccgacctaggattcgcgcaacctgtcgttaatttattcaccagtcttgctgaaactgccggtgttgcggcctcaacatcgctgagacgttcccggaaggccggggcagcccgcatggatgcgggctgagggccgtgttttgcacggacgctgcctcggcccgccccgaagcctgc

SEQ ID NO: 84 - DNA, 34652 bp, Unknown
  source: /note="Description of Unknown: KP2-Mcoc1 Bacteria Sequence"
taggcctgccgccagcgttcaatctgagccatgatcaaactcttcaatttaagtttgatgctcaaagaattaaacttcgtaatgaattacgtgttcactcttgagacttggtattcatttttcgtccgaggacgttaagaatccatgtcactttgagtgcccacacagattgtctgataaattgttaaagagcagttgcgacgcgctttagcgctctgtcgcgaggtggcgtatattacgctttcctctttcagagtcaacccgtttttcaggatttttctctgcaaccgaaccggctgtttgtgtgaagtgattcacatccgccgtgtcgatggaggcgcattatagggagttctcgagcgtccgcaatagaaaaatggcagaaaaatgactgactgctgcattccccagcaaaaccccgctttatacctcgttacacacagaattatccacaggagagcgtaaaaacatgaccgctagccccgtggatcgccagctatatagaaggagaatcaccggcctggagagaaacataaaaattcgcgagcgttgcgcaaacgttttcgttacaatgccgcgctatgacacggatgcccggttgggtgcgttaggtgagtttttaggcaaaaactcacctaacgctctctgtaatgttcaaatcctggggatttaataccatgcaacaacgtcgtccagtccgccgcgctctgctcagtgtttctgacaaggccggtatcgtcgaattcgcgcaggcgctttccgctcgtggtgtcgagctgctgtccaccggcggcaccgctcgcctgctggcagataaaggcctgccggttaccgaagtctctgactacaccggtttcccggaaatgatggatggacgcgtgaagaccctgcatccgaaagtacacggcggcatcctcggtcgtcgcggtcaggatgacggtatcatgcagcaacacggtatcgcgcctatcgatatggttgtcgtgaacctttacccgttcgcccagaccgtcgctcgtgaagggtgctcgctggaagacgcggtggaaaacatcgatatcggcggcccgactatggtgcgctctgcggcgaagaaccataaagatgtcgccatcgtagtaaagagcagcgactacgacgccatcattaatgagatggacgccaacgaaggttccctcacgctggccacccgcttcgacctcgccattaaagccttcgaacacaccgccgcttacgacagcatgatcgccaactacttcggcagcatggttccggcctatcacggcgaaagcaaagaagccgctggccgcttcccgcgtaccctgaatctgaacttcattaagaagcaggatatgcgctacggcgaaaacagccaccagcaggcggctttctatatagaagagaatgtaaaagaggcctccgtggcgaccgccactcagctgcagggcaaagcgctctcctataacaacattgccgataccgatgcggcgctggagtgtgtaaaagagttcaacgagccggcctgcgttatcgttaagcacgccaacccgtgcggcgttgccgtcagcaactcgattcttgacgcctacgatcgcgcttacaaaaccgacccgacctccgcgttcggcggcatcattgcctttaaccgcgagctggatgctgaaaccgcgcaggcgatcatctctcgccagttcgtcgaagtgatcatcgcgccgtccgccagcgaagaagcgctgaaaatcaccgccgcgaagcagaacgtccgcgtactgacctgcggccagtgggatactcgcgttgccggcctcgatttcaaacgcgttaacggtggtctgctggttcaggaccgcgatctcggcatggtcaccgcaggtgaactgcgcgtggtcagcaaacgtcagccaaccgagcaggaactgcgcgatgcgctgttctgctggaaagtggcgaaattcgtcaaatccaacgccattgtgtatgccaaagataatatgaccatcggcataggcgccggtcagatgagccgcgtctactcggcgaaaatcgccggaattaaagccggtgatgaaggtctggaagtgaaaggttccgccatggcctctgacgctttcttcccattccgcgacggcatcgatgccgcagccgcggtaggcatcacctgcgttattcagccgggcggctctatccgtgacgacgaagtgattgccgccgctgacgaacacggcatcgccatgatcttcaccgacatgcgccacttccgccattaattcatggagcagcagatgaaagtattagtaatcggcaacggcgggcgcgagcacgcgctggcctggaaagcggctcagtcgccgctggttgataccgtctacgtcgcgccgggcaacgccggtaccgctctggagccgtcgctgcaaaacgtcgccatcggcgtcaccgatattccggcgctgcttcgcttcgcgcaggatgagaacatcgatctgaccatcgttggcccggaagcgccgttggtcattggcgtggtcgacgcgttccgtgccgccgggctgaacatcttcgggccaaccgaaggcgccgcgcagctggaaggctcaaaagccttcaccaaagattttctcgcccgtcatcatattccgacggcggaataccagaacttcaccgaagtggagcctgcgctggcttatctgcgcgagaaaggcgcgccgatcgtcatcaaagccgacggtctggcggcgggtaaaggcgttatcgtggcgatgaccctcgaggaagccgaagcggcggtcaaagatatgttggccggcaacgcctttggcgacgcaggccaccgcatcgtgattgaagagttcctcgatggcgaagaggctagctttattgtgatggtcgacggcgagcacgtcctgccgatggccaccagccaggatcacaagcgcgtcggcaacggcgataccggcccgaacaccggcgggatgggggcgtactccccggcgccggtggttactgaggaagtccaccagcgcaccatggagcggattatctggccaaccgtgaaaggcatggccgctgaaggcaacacctataccggtttcctctacgccggtctgatgatcgacaagcagggcaacccgaaggtgattgagttcaactgccgctttggcgacccggaaacccaaccgatcatgctgcgcatgaagtccgacctggtcgagctgtgcctcgccgcctgcgcgggcaagctggacgagaaaacctccgagtgggatgaccgcgcgtcgctgggcgtggtggttgccgccggcggctatccgggcagctacaatacgggcgatgagatctacggcctgccgcagcaggaagtcgcagacggtaaggtcttccacgccggcaccaaactgtctgacgaccagcgcgtggtcaccaacggcgggcgcgtgctgtgcgtcaccgcgctgggtgactccgtagcgcaggcgcagcagcgcgcctatcagctgctgaccgacattcgctgggacggtagctttagccgtagcgatatcggctggcgcgccatcgaacgtgaaaaggctaacggctaagtttcgccagcagcgttttgcgcgtaatgcctaactgacgggcggcttcagttttgttgccgcccgttttttccagcgccgccagaatcacctctttctccacttccactaacggctgaattcccccctcctcgctcccgcctgatggcagcggcgtaccggcgatcgccaggggcagttctcgctcagagatatagtttccggtcagtagcaccaccgcccgctccaccgcgttttccagctcgcgaatattgcccggccaggggtagtggatcagcaggtccatcgcctgtggcgtgaacccctttaccgtcttacgattgcgttcggtatagcgtttgagaaaatgctgcgccagctgcggaatatcttcccgtcgccggcgcagcggcggcatatcaatagttacgacattcaggcggtaatagagatcctggcgaaaacgcccggcgctcacctcctccgccagattacgatgggtggcggcgattagccgcacatcgacagaaagcgtctgattactgcccacgcgctgcacttcgcgttcctgaatcgcccgcagcagacgcacctgcatcagcggcgagatatcgccaatttcatcaaggaacagcgtgccgccatccgcctcgacaaagcgtccttcccgtcgccgatccgccccggtaaacgcccctttttcatggccgaagagttccgactccagcagtgactcattcagcgccgcgcagttgagcgtgaccaacggcttgtcacgacgctcgctgcaggcgtggatggcgtgcgccaccagctccttaccggttcccgactccccataaatcagcaccgtcgcgtccgaaggggccaccagcgtaatatcgttaagaagcgcctgcatcgccgggctgtcgccaatcatgccccaccgtgaatccgtcgcaacgctggggtcgctctcgctctgccgggtgtgcgccaatgcctgaaccagcgtctgctgcagggtgtcaaaatccagcggtttaaccagataatccagcgccccggacttaatagcttctaccgccgtaccgacgctggaaaacgccgtcatgatcagcaccggtatcgccgggttataggccttaatctcttttaacgttgcgataccgtccatctccgccatacggatatcgcacagcaccaggtcgaagacctgctgatggatctgctccagcgcctgcaggccgttgtgagccaaccccacctgatagccccagccgcgcagcagcgcctgcaggatcgtgcagtggctgatgtcatcatcaacgaccagaatctgtactttatcgctgctcatcttccctccgttgagcatccaccggtaaccaaagcgtaaatatcgctccagctcccggctgactttcggcgcggatcgtcccgccatgttgttcgataatattctgcactacggccagccccagcccggtgccgtccgccttggtggtgaaatacggcgtgaagatagcctgtaactcttcatcgctcatccccttaccgctatccgtgacgacgattttcacccgctgacgatcggcttcgcttgctgttacgcgaatgacgccgtcacggccaatcgcctgcattgcattcagatacagattcaacagcacctgattcaggcgatcggggtcggcgctgatcgtggttaactcaggtcgcggagtaaattgcagcgcgatcccgcggctctgcgcatcctggcttaccaactgcaatgagtggcggataagcgcgttgatatcgactgtctggtagtttagatgggcgggccggaccagctccagcagctcgctgaccacccggttcaggcgatcagcctctttggccatcacctgggctaactgatgcgactcgccgccaggcgacgtgcgctcggcaaaatatttcgccagccctttaatcgacgagagcgggttgcggatctcgtgcgcgacccccgccgccagatggccaagcgccaccagcttttccttgcgggccatcgcctccagcagctgtttccgcgagcgacgatagcggcggaaccagaactgagcgaggatcgtcgccgctatcaccagcgcggcggcacccagcatgatggccatatttcgctgcccgcgggcctgcgcggcatccagctcgcggctatcaaaggcgataaaaatcacctgcgggacgatggcctgagccagggcgctattgccgcggttcatcattcccatatggtggccgcgggccggattaagcgggcgaaaatggcgatagatctccagcgccggctgcggttcgctaagccggcgccagcgggcctgttcgccaaccgctaacgcacgcatctgcgccgggctatacagcgttttacccacctgctgcggatcgctatgggcgatatttttaccgttttcatcggtcaccgcgaaccacaggacgcccggttgccaggccatctcttccagcagggcctgcagctgcgcatgatgcatacgcatccccatcccgacgcgcgtgccggactccagcgcgcggatcagcacgctccctttctcttcaatggtttgtcgggcagcggtcgtctcgcgaccgtagtcgcggacgatcatcgcggagaacagcatgaccagcagcacaaccgtgccggtcagcagccagctcagcgcgccagcggcggcgtcccgggagagagatttgatcttcatcggcgagtccttgtcatctctttttcactatctgcaggctccttcagcagaaatcatgccatgtttccgcgcggccaatcctgctctcaaacatatcgcctgcgcttaagcgagtaaaaatgactcgcctgaccctggcggaacgggtcatttttactcgctctcctcggcaaaggcttcggcaggcccacacagacgggctttttcagactggcatggaagatgcaataccgagggaaaccacacaggagaaaatgccatgaaacggaaccgtaccttacctctcgccctcgttacctttgccgcgctgaccttcgccagcaacgcggcctgggccaaccaccactggggcaacaataacgggatgggcaaccagggctacagtcagctgacccaggagcagcaggctaccgtgcaaaagctgcataacgattactatgcgcaaaccagcgccctgcgccagcagctgcagtccaaacgctatgagtacaaggcgctgctcacggcgcaaaagccggacagcgggaagattgaagctgtcgctcaggagatggaaggcttacgccagaagctggatcagcagcgggtgaagtttgatatcgccctggctgaggcaggcgttccccgcggcgcaggaatgggatatggcggctgtcgcggtagcgccggcggtcatatgggcatgaaccactggtaaaggttagaagcttttttccgtcggctgccaggtgcagaagttttcattggcgaccagcagcagttgagagccttccggcgcctccagccaggcaatgctcactgcggcggaagcgtggctctggcggcgttcaatgtgcgccagggcccggctatcgaggtcgggcgtaaccgtctgcccttcgcaggtcagcacggtatgcgcggcagcgttccagcgcccctgccgcaggacgacccgcccctggcggagggcgtcgctggtctggcggatctgttcggcgcgataacgatatagcgcgacctggtcgctggagagctgctgcttctgcccgtccacttcccgttgcataaagctcagatcgccctgcgcgtcgaaacgggcgcgaatatgttccggcggtttgccatagacattgagttcgataagcgccagttgatcgccctgccagcgatattcgctggtcgaagtgtccccgtgacgccacgggctgaaggcggcgagaagatggacttcatcgccagaatctttacgccagatgcgcatcgctccctgattgtccgcatatccgctggcggtaaacggcggtagcgacgtgtcgtggctgcaggcagtcagcaacaggatgcccgccagcgccagaggccggcgccagacagacaaaaggggcttaatagccccttcgataaaactgttcactgccacgcggtcttacttaactgcgtctttcagtgctttgccagaaacaaatgccggcacgttagctgcagcgattttgatctctttaccggtctgcgggttgcggccagtacgctcagcgcggtggttcactttgaaggtaccgaaaccaaccagttgaacagcatcaccttctttcagagactcagtaattgcagccagggtagattccagggcagctttagcctgtgctttggacaggtcagctttgtccgcaattacatcaatcagttgagtcttgttcataagttatccttacaatgtgtttatcgcttgctaagcatcgagtgcgacggaaatgccaaaaaagcaccctcctgcatacacgcaccgatagccactttttttcgccctccaaatgtagaccagacggggggcggaatggaagccttcagacgctacaattcaggcggtaaatcacgttttctggtctcactgctgaaaatttataccaatattgctctcgccagcctcgcgcaggtccgcgcgcaggccttttatcagctcaagatcacgctcttcacagtcggccagcaggcggaaaatttcccactgaatatcccattcctgctctaccgccggattcgctttcaactcttcgtcggtcatttcgcgaccttcctgggtcatttccagcatcgccacggtggtgatggaggtcttgctcacctcgatcgcgtgctcgagcgtttcgccgctcagacgagaatgaatcagttcactcaacgccacgcaagcgtctatggccggatagacaccgtacatgtcgaaatcatctgccgccgggatcgcctcttccagcttctccagctggctgtcgaaattcaccttcgcatctttaaccgtcagcgtttcccagatcaggtccaggatacgacgataaagcaggccgtcgccaaactcggtttgcttgcagaacatcgcgtagttgggatacatacgttcgcacaggcaggccataaaagtgacatgctgccagctttccagcttctccaggcgcaggtgaatcgggttttgtaacatgatgaattctcgaagtcagaaattaggcgcagtgtacctgaatcagctgtgatttgcttgccaacgcacaaacgacggacgacgggacgccaccgcatcggcccagcgcgtcggctcgggcagacggtagcctcgcatgcaacgctcaacccacattaaagcgctgtccatgcctaccctgtggccggtgctaataaacagcgggttgcagcgcactttgctgcgccagacccaggccagttgctcatttttatccatcagcggggccagcgcgccaggctcatcacccaggtcgccgattttgccgcacaggcgttttttcgccactccgatagtcggcacatcaatcatcaggccaaaatggctggcgacgcccaatctccggggatgagaaatgccgtgtccgtcaacgaagagcaggtccggtttttgcgaaagctgctcccacgccgccagcagcgcaggcgtttcgcgaaacgagagaaagccgggaatatagggcatagaggtggcgacccgcgccacctggtactccaccagctcaagctcaggccaggtcagcagcaccatcgcagcccgggtgatctccccttcctgctcaaacccgacgtccgcgccgccgatcaacgccggcgggtcgcgatccagtcgatccgcacgctctaccgacgcggctaactgttgctgttgggtacgtagtgcggctaaatccatagggcttatctcctactggtgatagggtgcggacagacggtgcacagcctcaacaaagacgcccgcatgctcggggtcaacgtcctgatgaataccgtgtccaaggttaaagacgtggccttccccctggccaaagccggcaagaatggtcgccacttcttcttcaatacgcggggcggacgcatagagcatcgacggatccatattgccctgcagcgctactttgttacccacgcgacggcgagcatcggcaatatcggtggtccagtcgagacccaacgcatcgcagccggtctccgccatcgcttccagccactgaccaccgcctttggtgaacagggtcaccggcacgcggcggccttcgttttcccgcagcaggccatcgacgatcttatgcatgtagtagagggagaactgctgatagtcgcggccggtcagcaccccgccccaggtgtcaaaaatcatcaccgactgcgcgccggctttgatctgcgcgttgagatacagggtgacgctcttcgccagcttatccagcagcgcatgcagcgcctgcggctcggcgtacatcatctttttaatcacggtgaaagccttgctgctgccgccctccaccatgtacgtagccagcgtccatggactaccggaaaaaccgatcagcggcacttcgcctttcagttcgcggcgaatggtgcgcacggcgttcattacatagcccagctcctgctccggatccgggatcggcagcttgtcgacgtcggctttactttttaccggcgaggtgaagcgcggaccttcgccagcttcaaagtacagccccagccccatggcgtccgggatggtcaggatgtccgaaaagaggatcgccgcgtccagcgggtaacggcgcagcggctggagcgtcacttcgcaggccagctcggcatttttacacagcgacataaagtcgcccgcttgcgcacgggtggctttgtactccggtaaatagcggcccgcctggcgcatcatccacaccggggtgacatcaaccggctgacgcagcagcgcgcgcaggtaacgatcgttcttcagttcggtcatttttacattcctttagcgttgatacgcccagtgtaacatgtcactcgaactctgcccgacacatcgcgacggtatcttcgataagccgccgcgccactgtccccggcggcggcagaagcggcaggtcgtcatagcgataccagtccgcggtcagtaactcttttttgtcgaccacgatctcgccatctgcgtaatccgccataaaggcggtcatcagcgactgcgggaacggccatggctgagaggtcacgtaacgcagattttttacccgaataccgctctcctccatcacctcgcgagccaccgcctgctcaagggtttcgccgacctcgacaaagccggccagcacggtgtgcacgccgttgcgatggcgcgtatgttgcgccagcaggatcgcatcgtcgcgacggattgccacgataatgcagggggcaatttgcgggtagtaacgttcgcggcagtggctgcacagcatcgcccattcgcttttgctggcatgcatcgggtggccgcagtaaccgcaaaatttatgcgagcgataaaattcggcgagctggatcccccgcccagccagctggaagagtcccggatcctgatccagcacctggcgcaacgatcccatgtcatggcgacgatcctggcgcaccatccacacggactcgccctgccactcgccaatatgcagcgcatgctggccgacaagatcgaaattaaccgcttcgccatgtggtaattctccaccaggcaaccataatttttgttcgtgactgacaacccaccagccgcgatctaatttttcaataatacgatccatatctattgcactacctttgcttcactggcatgttgttaacattatatttacattttggtgagcagatttaaatcaaaactagcggagtcaatcatgctaaaccagctggaaaatctgacggagcgcgttggcggtagtaatgaactggtcgatcgctggctacaagtgcgtaagcatctgctcgtggcttactacaacctggttggcctgaaaccgggcaaagagtcgtttatgcggctaaacgaaaaggcgctggatgacttttgccaaagtctggtggattacctctcatccggtcattttagtatttatgaacgcattattggcgaaatggaaggcgatacccctcttttagccgccacccggctttacccgcagctggaagccaatacccagcagatgatggactactacgatacctgcctcgaaaacgccatcgatcacgataactatcttgaatttcagcaggcgctgtcggatatcggcgagtcgctggaggcgcgtttcgcgctggaagataaactgatcgccctggctgtcgcccataacctgagcaatgacgtgcgcgataatattgcgccgaccgcttgagttgtgaaccgttaacgcgtaatttacgtacattatccctctgcggagggatttcatcttgtcggagtgcctattttccatgcgcaggctaacgtggaaaaggctgagaccgttaattcgggatccgcggaacctgatcaggctaatacctgcgaagggaacaagagtaaactgctgttcgcgtcagtccgtcagggccgatcgcatctgttactccatccgtcgtctgacaagccatgtccttttttaactggaatgcgctatgtctactaccaaactaacccgtcgggaacaacgcgagcacgcgcagcgattcattgatacgctggcgggtaccgcttttcctaattcacgccgcatctatgttcacggctcacaagcggatatccgcgtcccgatgcgtgaaattcagctcagcccaactctcgtcggcggcgataaagataacccccggtacgaaaccaacgaaccgatcccggtgtatgacacctccgggccgtatggcgacccggatattagcattgatgtccgccaggggctggcaaagctgcgccagccgtggatcgacgcgcgtaacgactgcgcgccgctcagcgaacgcagctcggcctataccagagcgcggctggccgacgacggtctcgatgagctgcgcttcagcggcctgctgacgcccaaacgcgccgtcgctggcaaatgcgttacccagctgcactacgcccgccaggggatagtcaccccggagatggagttcatcgccattcgcgaaaacatgggtcgcgaacgtatccgcagcgaggttctgcgccagcagcacgcaggtgaaggcttcggcgcccaccttccggaaaacatcacccccgagtttgttcgcgatgaagtggccgccggacgcgccatcatccccgccaacatcaaccacccggagtctgaaccgatgattatcggccgcaacttcctggtgaaagtgaatgccaatatcggcaactcggcggtgacctcttccatcgaagaagaggtcgagaaactggtctggtcaacccgctggggcgccgacacggtgatggacctctccaccggccgctatatccacgaaacccgcgagtggatcctgcgcaacagcccggtgccgattggtaccgtgccgatttaccaggcgctggagaaggtcaacggcatcgccgagaatctcacctggcaagtcttccgcgataccctgctggaacaggccgagcaaggcgtcgactacttcacgattcacgccggcgtactgttgcgctacgtcccgatgacggcgaagcgcctgaccggtatcgtctcgcgcggcggctcaatcatggctaagtggtgcctgtcgcatcatcaggaaaacttcctctaccagcatttccgcgaaatctgcgaaatctgcgccgcctatgacgtgtcgctgtcgctgggcgatggcctgcgccccggctccattcaggatgccaacgacgaggcgcagttttccgagctgcgcaccctcggcgaactgacgaaaatcgcctgggaatatgacgtgcaggtgatgattgaaggccctggccacgtgccgatgcagatgatccgccgcaatatgaccgaacagctggagcactgccacgaagcgccattctacaccctggggccgctcaccactgatatcgcgccgggctacgaccatttcacctccggtatcggcgcggcaatgatcggctggttcggctgcgccatgctgtgctatgtcacgccgaaagagcatctcggcctgcccaacaaagaggatgtcaaacaggggctgattacctacaaaatcgccgcccacgccgccgacctcgcgaaaggccatcccggggcgcagatccgcgacaacgcaatgtcaaaagcgcgttttgaattccgctgggaagaccagttcaacctcgcgctcgacccgttcaccgcgcgggcctatcacgatgaaaccctgccgcaggagtccggcaaagtcgcccacttctgctccatgtgcgggccgaaattctgttcgatgaaaatcactcaggaggtccgcgactacgccgcgaagcaaagtatagaagccggcatggccgatatgtcgaataacttccgcgcccgcggcggcgaaatctacctgaaacaggaggaagcctgatgtatcaacctgattttccacccgtcccgtttcgtctcggactctacccggtggtggacagcgtggcgtggattgagcgcctgctcgaagctggggtacgtacccttcagttacgcatcaaagaccggcgcgacagcgaagttgaggatgacgtgatcgccgccatcgcccttggtcgccgctatcacgcccgactgttcattaacgattactggcaactggcgattaagcaccaggcctatggcgtgcatctcggacaagaagatctggaaaccaccgatctgagcgctatccgccaggccgggctgcgtcttggcgtctctactcacgatgatatggaaattgatgtcgcccttgcggcacgcccctcttacatcgcgctaggtcacgtcttcccgacgcaaaccaaacagatgccttccgcgccgcagggcctcgagcagcttgccagacatattcaacgcctggcggattaccccaccgtggcgatcggcggaataagcctggaaaaggcgccgggggtactggcgaccggcgtcggcagcatcgcggtggtcagcgccatcacccaggcggcggactggcgggcagcgaccgaccaactgctggcgctggcgggagcgggcgatgaatgatcacgactttatgcgctatagccgccagctgctgctggaggatattgccatcgaagggcagcagaagctgttagccagtcgagtgctgattatcggccttggcgggctgggctccccggcggcgctctatctggccggggctggcgtcgggacgctgaccctggccgatgacgacgcggtgcatctcagcaacctgcaacggcagatcttgttcaccagcgcggatatcgatcggccaaaagccgcagcggcacagacccggctcagccagctaaacccgcagatcaaactggtagcgctccagcagcgcttaagcggcgaggcgctccgcgccgaagtggcgaaagcggacgtggtgctggactgtaccgataatatggtcacccgccaggcgatcaatgccgcctgtgtggccctcgataccccgttagtgaccgccagcgccgtgggcttcggcggtcagctgatggtgctcaccccgccctggacgcagggctgctatcgctgcctgtggccggaaagcgatgaaccgcagcgcaactgccgcaccgcggggatcgtcggcccggtggtcggcatgatgggcaccctgcaggcgctggagacgattaagctgctcagcggcatggcgacgccgcgcaacaccctgcggctgttcgacgcccgcaccagcaactggcgcgcccttgcgctacagcgttcccggagctgcccggtgtgcggagggcggcatgcagatctggtttaacgacgagccgctggcgtgcgccgacaatctcagcgtcagcgccctgctgacccagctcgaacaacagcagccgggcgttgcgctggcgctcaatcaacacatcctgccgcgcgaccggtgggaagatcatctcttgcaggaaggcgatcgggtcctgctttttcaggttatcgctggaggctgacatgttacgtattgcagacaaaacgtttgaatcccatcttttcaccggtaccggcaaattcgccgccccggaggtgatggtcgaggcgattcgcgcctcgggcagccagctggtaaccctggcgatgaagcgcgtcgatttacgccagcgcaatgacgccatcctcgccccgctgctggcggcgggagtcagcctgctgccgaatacctcgggcgccaagacggcggaagaggcggtgtttgccgcccgtctggcgcgggaagccctgggtacacactggctgaagctggagatccacccggacgcccgctggctgctgcccgacccgattgaaaccctgaaagcggcggagctgctggtccgcgaagggttcgtggtgctgccctactgcggcgccgatccggtgctgtgtaaacgactggaagaggtgggctgcgcggcggtgatgccgctgggtgcgccgatcggctccaatcaggggctggaaaccaaagccatgctggagattattatcgagcaggcgacggtcccggtggtggtcgacgccgggatcggcgtcccgagccatgcggcgcaggcgctggagatgggcgcggacgcggtgctggtcaataccgccattgccgtcgccgacgaccccgtggccatggcccgcgccttccgtatggcgatcgatgccggattactggcgcgtcaggccggaccgggggcacgcagtacgcaggcgcaggccaccagcccgctcaccggattcctggaggcgctggcatgaaaacctttagcgatcgctggcggcagctggagtgggacgatatccgcctgcgcatcaacagcaaaaccgccgccgacgtcgaacgggcgctggcggccaaacagctcacccgcgatgatatgatggccctgctctcgcctgccgcggccaattaccttgaaccgctggcccagcgcgcgcagcgcctcacccggcagcgcttcggcaataccgtcagcttctacgtgccgctgtatctctccaacctgtgcgctaacgactgcacctactgcggcttctcgatgagcaaccgcattaagcgcaagacgctggatgccgccgagattgtccgcgagtgcgccgcaatccgcaacctgggctttgagcatctgctactggtgaccggcgaacatcagggtaaggtgggaatggattatttccgtcagcacctaccggctatccgcagccagtttgcctcgctgcatatggaggtgcagccgctggcgactgaagagtatgccgagctgaaaaccctggggctcgacggggtgatggtctatcaggagacctatcatgaaagcatgtacgccaaacaccatctgaaaggaaaaaagcaggatttcttctggcggctggatacgccggatcgcttaggcgcggcggggatcgataagatcggccttggcgcgctcatcggcctttccgacagctggcgagtggactgctttatagtcgctgagcacctgctgtggctgcagcagcgctactggcgcagccgctattcggtctccttcccgcgcctgcgtccctgcgccggcggtattgaaccggcttcgctgatggatgagcgccagctagtgcaaactatctgcgccttccgcctgctggcgccagaggttgagctgtcgctatccacccgcgaatcaccctggttccgcgaccgggtgatcccgctggcgatcaataacgtcagcgccttctctaaaacccagcccggcggctacgccgacgatcatccggagctcgagcaatttgccccgcacgacgatcgccgccctgaagagatcgccagcgcgctggccgcccgcggcctgcagccggtatggaaagactgggatagctggctgggacgcgcttcgcaaacctcatgatgtacagtgtaaacgcctgataattttgcgcgcctgcacgagagatgaaaaacggaggctggcccgcccgacgccgtttttctattctgcccgggtcagcagcggacgctgaccagggcgaaccttttcttcctcattttcgccctgcctctccgcgctgagcagaggcctgcacattatcgccgaatataaatcacgatacatgaaggcctcagagttataattgagcaatagtgaactgattcgatcggcaggcgtcccagacgcaacctgcgttcggacccatggtttatacatccgggacgattaacgattcatggctctacacaacagaaagctctcttttacgacgccgatcgtcgtggggtttgccggtattttgctcagctttatgctgatcgctatttttgtgactctggcgcaacagaaagattttctcgaagattatcacgatattaaccgcaattttacccataacctggcgatcaactatacggaaaccctgctgcgggaaaatgattttatcctcgggcgcgcagccgccttctttgcccgcaatgacgaactgaatcgcgcagtcaatgtggagccggagaaagggttaaccacgctgatgcagttacagaacatgatgccaagcgtctcatccatctcgctggcggataccgagggccactatctgcgcgccccggaggtgctggaaaacgaagacagccgggctttcgatcccagaacgcggccctggtttatcaaacaggcggaagccagcaccttcagccactacaccagtccgtatatggattatttcacccaccatccgacgattaccattttcaaacccatcattaccccggaagggaaactcaagggcagcctggcctttcatctcgatctcacctccatggggttcgcgctgcgccagatggtggcgcccgtacagggggaattttttgtggtgcaacgggatggcaaagtggtcctgcactccgacccgggcgcgctgtttaaacccttcgtcagggacgagctgatggataaaatgaccagcggagaggggcagctttacgatcccgggagcgacacctggtattactattactcctttaccaatcccgactggtttgtgattttccgtgtcgataacgccaccctggtcaatctgacacgtcatgagaccaatttagtgatcggcggtttcactctcgcagcgatcattattatcctgttcggtctttatctgcgtcatgcttcccgtaccgtgctgatgaatatcatcaatgcgattaaaaccggtgacgtcaaacgcgccccgcgccttgaggcgatgctgagtaaagcgattgaaaccaataaacagcgcgaactgtcctacgtccgccaggcgaccatcgacgctctcaccggctgcaaaaaccgccgcgccttcgacagcgatattgccgccctgatgaacgatcaccagccattcgccctcgcgctggtcgatatcgataactttaaatcgatcaacgacacctggggccacctcaatggcgatatcgtcctgcgtaacgtcgctcgcgaagggctacaggtcctccagccgctggagatatccctctatcgctacggcggtgaagagttcgcggtggtctttcctgccgaacatatcgataacgcccgcacgctgttggaaacatggcggataaacgtcgaacgacgcacctggcgcgaagatggcctgacggtcaccttcagcgccggacttggggaatggaatatggagccactggataagctggtggtgagcgtcgatgaagcgctgtacaaagccaaacagcagggtaaaaaccgtatcctgcgcgcgtaagacttcagcgccgccaccgcccacttcggtgggcttttttattttttccggaaaaaatgaaaccggtttcaattattgtgtgatgccttacacacaatcacggtaaagcggttgtcgcatcgacagggccgcgataaagataagacatcacggaacacaagggccactgactatgaagaatatcgttttgtgctgtgccgccggtatgtctaccagcatgctggttcagcgtatgcaagatgccgcgcagaagaagggtgttgaggtctctatcaaggccgtaccggtcgctgagtttaaagataatctggccgccgccgacattattttgctcggccctcaggtgaaatatgagcaggcaaagctgcaggcgctggccgacccgttcggcaagaaggtcgccgtgatcgatatgatggactacggcatgatgaaaggtgatgccgttctggataaagcccttaagatgctggagtaatcgatggaagatttagaaacgatcatcatggagctgctggttaacgcgggttccgcacgtagcgcggcgctgacggcgctacagctggcgcgaaaaggcgattttgccgccgcggagcaggccatggctgaatcccatgagttcgtcaaacatgcgcataaaattcagacccagcttatcggcatggatgaaggcagcggtaaattgccggtcaacctgatcaccgtgcattcccaggaccatctgatgaacgctatggtcattcaggatctggcgaccgacatgattgaactctatcgtcgtctgcccctcgcgcaataatctcacggatttaacgggcgtcgctgccggcgcccgtccttcttacagaaagccgtacatcgccgcgaatacccagccaaacacgcaggagacgccgacgccgatgagcccgggcaggataaagctgtggttaatcacaaagcggccgatatgggtggtccctgagcgatcaaactggatcgccgccagatcgcttgggtaggtcggcagaatatagtagccatagcaggccggcgctgaagccacgatataggccgggtcgacgccgatggccagggctactggcacaatcgccgccagcgctgccgcctgggagttcacaaatttcgaaaccagtagcagcacgatggcataagcccacggatactcttttaccatttcaccaagcacgcctttaatctcggtcatgtgcgcgccaaacatggtctccgccatccacgcgataccgtacaccgcgacgatagcgatcattcccgaacgaaagacctcatttttggaaatcgatgccgggttagtttttgtaatgatgatgatcagcgctccggagagcagcataaacatctggataaccagcaccatcgacagtggtttaccgtcaaaggccgggcgcagttcagaaaaagcgccaagcagcgccaccacggcgatagaggccagaaaaatccacattgctatccagttgctggtcggcagctttttgtccagcagcgtcgccgtatcgccatagacgtaatggcggttctccgggagcgcaataaacgcctggaaggcttcgtcctgatccaggtctttgccgcggaaccagctgaagataccgatggctaaaatacccagcagcgtggacggaatggttatcgccagcagatcgagaaactccaggtgtttcccgttaaaggtaaaatttcccagcatcgccaccagcgataccaccgccaccgagaccgggctggcgatgatccccatctgagcgccaatggagctggcggccatcggacgctccggacgaatgttattcttaatcgccacatcgtagataatcggcaggatggtatacaccacgtggccggtaccgcagaggatggtcagcgtgcaggtgacgaaaggcgccacgatagaaacatatttcgggttacgccgcagcagcttctcggcaatctgcagcatcacgtctaacccgccggacgcctgcagggtcgccgaggcggctaccactgcaatgatcaccagcatcacatcaaccggcggtttgcccggctggagatgaaaaacaaagacgaggatcaccaaaccgatgccgcccagcagccccagcgcaatccccccttttcgggcaccataaaacagacaaattaatataataatgagttgtatcgcgaattccatgcagcccccagagcctgtccactcagatctaaaaatgatccctacctgcctctcgggattatttctgcgccagaccgggagaagcatgagatgcggctatccctctccagcgccgtcgcgccgaagatacagcaacagaagtaatcccatgattcatcaggtattttgaatatataccctttgaattgattattttttgatatgagtagaagttttacccatacataaagaaaggttttagaaaaaggcttctaatagatattttgcatgaattaattgctaagaaaatgaagatttaatatgtcgtaaatgtaattaagggccgggaaagcggcggaaaatagacaataaaaaaagccggtcaggaaacctgaccggctttttagcagtgcatcaacgattaatcgttgtcagaaccgcccagacctgcgttcagcagctctgccaggttggcagacgcttcttccacgctcacctgcggtgccgccggcagctcgccagcagcgcgacggcgcatacgatcctggtgatacgcataaccggtaccggccgggatcagacgacccacgatgacgttctctttcagaccgcgcagttcgtcgcgtttgcccgcaacggctgcttcggtcagcacgcgagtggtctcctggaacgatgccgcggagatgaaggactcggtggccagagacgctttggtgatacccagcagatcgcgggagaacgttgcgcccactttgccgttcgcttccagttcgcggttcgcgatcttgacgcgggagtattccacctgctcgccttcgaggaagtcggagctgcctgcgctttcgatggtggctttacgcagcatctgacgaacgataacttcgatgtgcttatcgttaatcttaacgccctgcagacggtatacgtcctggacttcgttaacaatgtaacgggtcacagcatgtacgccacgcagacgcagaatgtcgtgcggtgcttccggaccgtcggaaacaacatcaccacgttccacacgttcaccttcgaacacgttgagctgacgccatttcgggatcatctcttcgtacggctcgctaccgtctaccggggtgataaccaggcgacgtttccctttggtttctttaccgaaggaaatgataccgctgatttcagccaggatagccggctctttcggacgacgtgcttcgaacaggtccgcaacgcgcggcagaccaccggtgatatccttggtaccgccggattcctgcggaatacgcgccagggtgtcaccagagctgatctgtacgccatcttccagctgaacaatcgctttacccggcaggaagtactgagcaggcatatcagtgcctgggatcagaacgtcgttgccctgagcatcaacgattttcagtgctggacgcagatctttaccacctgcggtacgttctgcagagtccagaaccaccagcgaagacagaccggtcagctcgtcagtctgacgagtaatggtctggccgtcgatcatgtcagtgaaacggatgaaaccgctaacttcggtgataaccggcatggtgtgcggatcccagtttgcgacggtttcaccgccggcaacctgctcaccgtcgcctttcgccataaccgcaccgtaaggtactttatagctctctttggtacgaccgaattcgtcgatcagcttcagctcggtattacgggaagtgataaccagcttaccactggagttcacaaccgacttcgcgttgctgagcttgatgctacctttgtttttcacctggatgctggattcagcagccgcacgagatgccgcaccaccgatgtggaacgtacgcatcgtcagctgtgtacccggctcaccgatggactgtgccgcgataacgccgatagcctcacctttgttgatgaggtggccacgcgccaggtcacgaccatagcagtgcgcgcagacgccaaagtcggtgtcacaggatacaacggaacgcactttgacggagtcaacggagttcgcttccagcaggtcacaccagtgctcatgcagcagcgtgttgcgtggaaccagaatatccgcggtacccggcttcagaacatcttccgcagtcacacgacccagtacgcgatcgcgcagcggctctttaacgtcgccaccttcgataaccggcgtcatggtgatgccttccagggtgccgcagtcgtcttcagtgacgaccaggtcctgcgcaacgtcaaccagacgacgagtcaggtaaccggagttcgctgttttcagtgcggtatccgccagacctttacgagcaccgtgggtggagatgaagtactggagtacgttcagaccttcacggaagttcgcggtgatcggcgtttcgatgatggagccatccggcttcgccatcagaccacgcataccagccagctgacgaatctgtgccgcagaaccacgcgcaccggagtcggccatcatgtagatgctgttgaaggaaacctgctgctcttcctgaccgtcacggttaatcacggtttcggtttgcaggttatccatcatcgctttggatacacgatcgttcgccgcagcccagatatcgataactttgttgtagcgttcgcccgcggtcaccagaccggactggaactgttcctgaatctcagcaacttccgcttccgcttcgctgatgatttcgtattttttctccgggatgaccatgtcatcgataccaacggatgcacctgaacgcgctgcgtaagcaaagccggtgtacatcgtctggtccgcaaaaataacggtcggtttcagacccagaatacggtaacaggtgttcagcatcttggagatcgctttcttaccaagcgcctggttcacgatagagaacggcagacctttcggtacgatcatccacagaatggcacggccaacggtcgtgtctttcaggctggttttcgcgacaaactcaccattgtcgtctttttcgtattcagtgatacgcactttaacgcgcgcatgcagagaggccaggccggcgcgataaatacgctcagcttctttcgggccagtcagcaccatgccttcgcctttggcgttaacactgtcacgggtcatgtagtacagacccagtacaacgtcctgagacggaacgatgattggttcgccgttcgccggggacaggatgttgttggtagacatcatcagcgcacgcgcttccagctgggcttccagcgtcagcggtacgtgaacagccatctggtcaccatcgaagtcggcgttgtatgccgcacaaaccagcgggtgcagctggatggctttaccttcgatcagaaccggttcgaatgcctgaatacccagacggtgcagggttggcgcacggttcagcaggaccgggtgttcgcggataacttcgtccaggatatcccaaacgacagcttcttcgcgctcaaccatcttcttagcggctttgatggtggtggccaggccacgcagttccagcttgccgtagatgaacggtttgaacagctccagcgccattttcttcggcagaccgcactgatgcagacgcaggtatggacctacggtgataacagaacgaccggagtagtcaacgcgtttaccgagcaggttctggcggaaacgaccctgtttacctttgatcatatcggccaaagatttcagaggacgtttgttagaaccggtgatcgcacgaccgcgacgaccgttatccagcagggcgtcaaccgcttcctgcagcatacgtttttcgttgcgtacgatgatatccggcgcagccagatccagcagacgtttcagacggttgttacggttgatcacgcgacgatacagatcgttgaggtcagacgtcgcgaaacgaccaccgtccagcggaaccagcggacgcagatctggcggcagtaccggcagaacggtcaggatcatccactccggcttgttgccagactgaacgaaagcttccagcagcttaatgcgcttggtcagctttttacgcttggtttcggagttggtttcgttcagctcttcacgcagctgctcgcattcctgctccagatccatattgcgcagcagcgcctggatcgcttccgcgcccattttcgcgtcgaattcgtcaccgaactcttccagcgcgtccaggtactgttcttccgtcagaatctggttgcgttcgaggttggtcatgccaccttcgataaccacataggattcaaagtacagtacacgttcgatatcgcgcagcggcatatccagcagcagaccgatacgggacggcagggatttcaggaaccagatgtgcgcagtcggacatgccagctcgatgtggcccatgcgctcacgacgcactttagtctgggtcacttcaacgccgcacttctcacagatcacaccgcggtgtttcaggcgcttgtacttaccgcacaggcactcataatcttttaccggcccaaagatacgggcgcagaaaaggccgtcacgctcaggcttgaacgtacggtagttaatggtttccggctttttaacttcaccgaaagaccatgaacggatcatgtctggcgaagccagagcaattttgatcgcatcaaactcttcggttttagtttgcgctttcagaaactttaataagtctttcacggatttgctcccgtcggagttagcacattccgctgccgggcgttaacccggcagcagtgacctgtttgagcgagaattactcgtcttccagttcgatgttgatgcccagcgagcgaatttctttcaacagtacgttgaaggattccggcatgcccggttccatctggtgattgccgtccacgatgtttttatacatcttggtacgaccgttcacgtcatcagacttaacggtgagcatttcctgcagggtgtaggccgcgccgtatgcttccagcgcccacacttccatctcaccgaagcgctgaccaccgaactgtgccttaccacccagcggctgctgagtaaccaggctgtaagaaccggtggaacgagcgtgcattttgtcgtcgaccaggtggttcagtttcagcatgtacatgtaacccacggttaccggacgttcgaactgttcaccggtgcggccatcaaacagggtgatctgaccggaagtcggcaggtcgcccagctgcagcagctctttgatttcagcttctttcgcaccgtcgaataccggcgttgcgatcggcatgcctttacgcaggttttcagccagacgcagaacttcttcatcgctgaaggtattcaggtcaactttctggcgaacgtcagcgcccagatcgtaagcacgctggatgaattcgcgcagtttcgcgacttcctgctgctgtttcagcatggcgttgatcttatcgccgatgccttttgcagccatacccaggtgagtttcaaggatctgaccgatgttcatacgagacggtacgcccagcgggttcagtacgatatctaccggcgtaccgttagcatcgtgcggcatatcttcgatcgggttgatcttagagataacacccttgttaccgtgacgacccgccatcttatcaccaggctggatacggcgtttaacggccagatataccttaacaatcttcagcacgcccggtgccagatcgtcgccttgggtgattttacggcgtttcgcttcgagttttttctcgaactcgtgtttcagttcgtcatactgctcagccagctgttccagctgattttgtttctcttcgtcggtcaggcccagttccagccagcgatcgcgaggcagcttgtcgagcttctcagcttcaacgccaccggagaccagcaccgcgtagatacgactgaacagaccggcttcaaggatctgcagttcttcagacaggtcttttttggcctgcttcagctgcatctcttcgatttccagagcacgtttgtctttttctacgccgtcacgggtaaagacctgaacgtcgataacggtaccagagacaccgttcggtacgcgcagagaagagtctttaacgtcagacgctttctcaccgaagatcgcgcgcagcagtttctcttccggcgtcagctgggtttcacctttcggcgttaccttaccaaccagaatgtcgccgccggtcacttccgcaccgatataaacgataccggattcatccagtttggagagcgcagcttcacccacgttcgggatgtcagcggtgatctcttccggccccagcttggtgtcacgggacacgcacgccagttcctgaatgtggatagtggtgaaacggtcttcctggacaacacgctcggaaacgaggatggagtcttcgaagttgtaaccgttccacggcatgaacgctacacgcatgttctgacccagcgccagctcaccgaggtcggtggacgggccgtctgccagcacgtcgccgcgctcaataggttcgcccagggacacgcaaggcatctggttgatgcaggtgttctggttagaacgggtgtacttggtcaggttatagatgtcgatacctgcttcgcccgggtacatctcgtcttcgttaactttgataacgatacgggaagcatccacgtactgaacggtaccgccacgtttagccacggcagtaacaccggagtcaacggcaacagcacgttccataccggtaccaaccagcggcttatcagcgcgcagagtcggaaccgcctgacgttgcatgttcgcacccatcaatgcacggttggcgtcatcgtgttccaggaacgggatcagggacgcaccgacggataccacctgctgggtggatacgtccatgtagtcaacctggtcgcggctgaacaagctggattcgcctttgctacggcaggtaaccagatcttctacgaagtggccgttttcatccaggttggagttcgcctgagcgataacgtagttgccttcttcgatagcagacaggtagtgaatttcgtcagtaaccacaccgttggtcactttacgatacggcgtctcaaggaagccatattcgttggtctgcgcgtacacggacagggagttaatcagaccgatgttcggaccttcaggcgtttcgatcggacatacgcgaccgtagtgggtcgggtgtacgtctcgaacttcgaagcctgcgcgctcacgggtcagaccgcctgggccgagtgcggagatacgacgtttgtgcgtaatctcagacagcgggttgttctggtccataaactgagacagctggctggaaccaaagaactctttcactgctgcggaaatcggcttggcgttgatcatatcctgaggcatcagggtatccagatcgccaagagacagacgctctttcaccgcacgctctacacgtaccaggccaacgcggaactggttttccgccatttcgccaacggaacggatacgacggttgccgaggtggtcgatatcgtccacttcgcctttaccgttacggatatcgatgagcttcttcatcacttcgatgatgtcgtctttgctcaggataccggaaccttcgatttcgtcgcgcagcagagaacggttgaacttcatacgaccaaccgcggacagatcgtagcggtcttctgagaagaacaggttctcaaacagactttcagcggcttcacgagtcggcggctcgccagggcgcatcatgcggtagatttctaccagcgcgctcagacgatcgttagtcgggtcgacgcgtaccgtttcagagatgtacgggccgtggtccagatcgttggtgaacagcgtttcgatacgcttgtggccagactggctcagcttagccagcagatccaggctcaactccatgttcgccgggcagatcagttcgccagtcgcttcatcgatatagtctttagccgccactttgcccgcgatatattcaaccggcacttcgatatgcttgatatcgtctttttccagctgacggatatgacgagccgtgatgcgacggcctttctcaacgtacactttgccgttggcttcgatatcgaaggaggcagtttcaccgcgcagacgctccggaatcagctccatctgcagcttgttgtcgcgaatttcaaagaccactttttcgaagaacaggtcaaggatctgctcagtggtgtaattcagcgcgcgcaggatgatggtagccggcagcttacgacgacggtcgatacgaacgaacaggttgtctttcgggtcgaattcgaagtccagccaggaaccgcggtaagggatgatacgtgcgttatacagaaccttaccggaggagtgggtcttacctttgtcactgtcaaagaagacgcccgggctacggtgcagctgagaaacgataacacgctcggtaccgttgataacaaaggtaccgttgtcggtcatgagcggaatttcgcccatgtagacttcttgttctttaatgtctttgacggtgccttctggcgcttcgcgctcgtagatcaccagacgcagttttacgcgcagcggtgcagaataagtcacgccacggatctgacattctttaacgtcaaaaaccggttcgcccagacggtagctgacgtattgcagctcggaattaccgctgtagctctgaatcgggaatacggaacggaaagcagcttccagaccatactgcccttcaggatcttgctcgataaacttctggaacgagtcaagctggatagaaaggagatatggcacatccagaacttgtggacgtttaccaaaatccttacgaatacgttttttctcggtataggagtaaaccatagggttcctcagctcgctgacaagtcgacccatctgcccgcagagggcagttttttatgcaacactattttgttgaccggaaaatggaacactttccgcaatgcctgttgctatcacgcttaaaccatttcattgcgatttacacagcccaggaaccctaacctgtcgcagtatattaagtcgtcgatagaaacaagcattgagaggcaaaccagtagtcaaacagcgtgaaacgctactggcgccttacagcgcaaaaaggctggtgaccaaaaagtcaccagcctcagcctgatttctcaggctgcaaccggaagggttggcttatttaacttcaacttcagcgccagcttcttccagagattttttcagagcttcagcgtcgtctttgctgatgccttctttcagtgcagccggagcagattctaccaggtctttagcttctttcagacccaggccagttgcgccacgtactgctttgataacagcaactttgttagcgccagcagctttcagaattacgtcgaattcagttttttcttcagcagcttcaaccgggccagcagctacagctacagcagcagcagcggaaacaccgaatttttcttccattgcagagatcagctcaacaacgtccattacggacatagcggatactgcttcaatgatttgatctttagtgatagacatttaaattgttcctgaatatcagaataagtttatacgtaagcgaatgctttacaaagataactgcgattaagcagcttctttcgcatcgcgtacagcagccagagtacgaaccagtttgccagccgaagcttctttcatggttgccatcaggcgtgcaattgcttcttcgtaggtcggcagagttgccaggcggtcgatctgcgacgccgggatcagctcaccttcaaaggcagcggctttgacctcaaattttgcattcgctttcgcgaactctttgaacagacgagcagcagcgcccgggtgttccatagagtatgcaatcagggtcggaccaacaaacgtgtctttcaggcactcgaactgagtaccttcaacgacgcggcgcagcagggtgttacgaacaacacgcatgtatacgccagcttcacgacctgctttacgcagttcagtcattttatctacagttacgccacgggaatccgcaactactgcagacagcgcgcctttggctacttcgctgacttcagcaacaatcgcttgtttgtcttgaagatttaaagccattagctttgctcctggatgtttgccagagcctatgctctggaactcacttcactcaattcaacgaaaagagcgtctaaatacggtgagcagaaacaagccagaatatccaaaaataatcttagcgttctgtcaccgtctacgcaggggattaagtttcttgcgaaacacctgcggtcttcgacggaggcctggataggccaggctccaacgaacaaattcttcctatgacttcgtccttcgaaccgcagcggcgttagctgcaattcaaatgactcgcatagcgtctgtcttattgacagaatcgtgggggtaagattgtagacaaaatcaccgcccacgtaaaggcattagtttgcagaagcgttcaggccagcctgatctactgcaacacctgcacccatagtggtggagatgctaactttcttgatgtacacgcctttcgcctgagtcggttttgcttttttcagcgcaaccagcagagcttccaggttttctttcagtttgtcagcgtcaaagtccactttaccgatggtggtgtggatgatgccgtttttgtcgttacggtaacgaacctggcctgctttcgcgtttttaaccgcttcagcaacgttcggagttacggtacctactttcgggttcggcatcaggccacgcggacccagaacctggcccagctggccaacaacgcgcattgcatccggggaagcaataacaacgtcaaagttcatttcgccttttttgatctgctcagccagatcttccatacctaccagctcagcgcctgcagctttagcagcttcagcgtttgcgccctgggtaaatacggctacgcgaacggaacggccagtaccgtgcggcagtacagttgcgccacggacgttctggtcagatttacgagcgtcgatgccgaggttaacggcaacgtctacgctttcggtaaatttagcggtggccagctctttcagcagagcaatggcttcgttgatgtcgtactgtttagttgcatcaactttctcacggatcacgcgcatgcgcttggtcagtttagccatttcttagtcctccactaccaggcccatggaacgtgcagtaccttcgatggagcgagtcatcgcttcaatgtcggcaccagtcatgtcggcagctttggtctgcgcgatttcctgcagctgagcgcgggagattttacccactttatctttgttcggcttaccggaaccagacttgatgcctgcagctttcttcagcagaacagcagccggcggagtcttggtaacaaaggtaaaggaacggtcagcgtaaacggtgataacaaccgggatcggcagacctttctccagggaatcagttttggcgttgaacgctttgcagaattccatgatgttcacgccctgctgacccagtgctgggccgaccggcgggctcgggttcgccataccagctgcaacctgcagcttgacgtaggcttggactttcttagccattcttaaatcctcaaaatgggtattaacgcttcagagaagctccccgtgattaaacatcgttttacgggccgggcccataaaaacaaaaggcgcgaaattgtatgccaatttcgcgccctatgcaacgattaaatcgctgcttttttgatcgccggcttacgccttctcaacctggctgaagtccagttctaccggggtcgcacgaccgaagatagaaacggaaactttcaggcgggacttctcatagtccacttcttccaccacgccgttaaagtcagcgaacggaccgtcgttaacgcgaaccatttcacccggttcaaacagcgttttcggacgcggcttatcgccaacctgctgcagacgattcatgatggcgtcgacttctttgtcgctgatcggcgccggacggtcagaggtgccgccgatgaagcccatcacgcgcggtacgctgcgcaccaggtgccagcttgcgtcgttcatgaccatctgaaccaggacatagcccgggaagaatttacgttcgcttttgcgacgctggccgccacggatctcaaccacttcttcggtcgggaccatgacttcgccaaataactcttccatgttgtgtaatttgatatgttcacgcagcgacgtggctacgcgaccttcaaaaccggaaaacgcctgaacgacgtaccagcgctttttaggagcttcagacatctcagaacctcaggccagtgataaaggagaccaggcgaaccagaataccatccagtccccacaggatcagtgacattactgcagtcacggcagcaacaatcagcgtagtatgcagcgtttcctggcgagtcggccaaatcactttacgaacttcggttctcgcttcgcgagcaaaagcaacggtcgccttacctttcgtcgtcaacagcgcgacgccaccggcagcagcaataagaataaccacggccagcgcacgcaccgccagcataatgtcacgataaaggaagttgcccacgatcgccacgatcagcagcacggcaacgataatccacttcatcgcttccaggccgcgcccgctcccttgagcttcggtattcgcactcataaaccaacctgtcagaagtattctacaaacaatttcaccccgcgggggcgaggcgatccaaaccgaaattaagtttcggattatacacttaactattcaaattgcttcaatgttgacggtggtgtcacccctgccctgctgttgcaaagaaggagttgattagccgtcgccctgaggctcgaatggtttggtgtataaacgccctcttcagagcctgtctcagcaatgattatgacaaataaaatcactgatgagccaggttctggtgtgaaagcgtgcaaaaagggcatcaaatgatgcccttttattgcgcattgcgtcaaatgttatcagcgattagccgagaactttagcaaccacgcccgcgccaacggtacgaccgccttcacggattgcgaaacgcagaccgtcgtccatcgcgatcgggtggatcagggtaacaaccattttgatgttgtcgcccggcattaccatctctacgccttccggcagttcgatggtgccag

SEQ ID NO: 85 - DNA, 33317 bp, Unknown
  source: /note="Description of Unknown: KP2-Mcoc1 Bacteria Sequence"
acaattcccgccagcgtatggctgagcgcgcacttaacttacagtaaaggagtctccctatgggcacagcaattatggccgctggcactgatgcatcagcgtacgcaaataattatcttccgccggtatctggtcctctggcatgggcaaatctggagagtaacgccctcacagaggcgcgtagactcaagaattggggcaagaacggcggttcctttgcactgtcaggcgtcgcacagcttgtcgctaaaggtattgaggcagcggcagggaccgaaagccgtttgacgctgggtaattttacaccggatgcttacaccctgatcgcactcgttgatgtaggcgcaagcgcaggggttattcggcatcgaaatatccgcatcatgacggatgcaaataaaaaaatttggcgagtgatggatgcagggacaagtttatcgaatatcacggctccagcgaccggagctttcgtcgtatttctaaaaggcgacttaaccggccattctttcggcatggcgacgtcaaccggtgtacagaaggttgactccacagcggtgaacacaaccacaaccgatactttcatcggcggaaactgggaaaacggtactgctgctgcctggaaggcttatggcgctgctttctacgacagaaagctgagcgatagcgagctaatccaagtcgcagaacgcctgatcaagcgcgccaagtatctcggagtgacggtcaatggctaatttcacgtcatcattgatctcagactctgcgtctgagagcaaccaggctgggtggtggcacccgctggatagctttcagggggcggagtattacgggatttgtaaagaatatggggtcgccggtaagcaccaggtagaactggtaaaacgtgccgctgacggcacgttgacccgtagcctctgcaaaaacacggatggaactaccgccgaattcgacaatgatatcgggcataacaacccatctgtgatcgttgacggcgacgggtacatccacgtgttcacttcaatgcacatgaaccttctgcgctattttaaaagtgcagcgccaaatgatgttacgaatatggtggacgcgtcgtggaacttccccgacgtagactggacctatacttaccccacggtagccaggggaccggaaggtgacgtatacgtcatgatgcgccggtctaaccgtaccccggtaaacgataccaagcgtccgggggttgtttatcgctaccgtctggcctcgaaaacgtgggagcgctatgcccccgtagccgaagcagataaccgttccatctacccggacgatatgatggcgttcgccgatggcctacaccttctgttccagtgggcacattacccatcctctgccgttcgtcatgttggggaatatggcgtcattggtaccgatggactgatgagaacgataaataacacgcccctgccaatgccggtaacgcagggacagctggcgtataagccattgcagccgggtgaaaacccggcgataagtgacgggctgaaaatggggattcagtctgcgaaatttgcgtttgatggcgagggattgtcgcatatcacttaccgtttcagaaccgtggatgatccttccgggacctggttcagtaagttcggggtctacgttgcgacatgggcggggtctgcatggagcgagcagcagatcgcatatgtcccgccggagcggggaaacacatccgcagcactggcggcaactgttcagggtggaaagcggagggtgtatttttcggtggaatacacgtcttccgggaatacagtcgctgtcattgtcctggcggaaaatgcaggttctggatgggtctactcggtactcggcaacagcgcccccacacttctgcgcatggggtctgcaccaggaaacggcggtgatgtgctttacgtctcagcaccatttgaggctaaggtgtatcgctattttgtgccggaagattattccccggctcagcaattcacgagttttgaagctcttctttcaacgttactttgaaagtgtaaataaatgcggctgccaatgttatgactgccgcatcctacagaatttacagaacgctgatccccctcgccgcacagcgctcttttgccgcggcatagatattatccagatctgcggcagatactgcgctggtagagtacaggaactcataacagcgcagttctttagagtagcctgccgcgcctgtataggatgtgttaccagggccaatttttaaggcagcattggcgttttttgccgctgtcagtgtcagttttgtagccgcacctccaacgaaaactatcaggttgctgccgctgcgcgtgactgcgataaaaatattcgctcccgcgctcagcccgggcggtaccggtatggcctgcgatttggttgtgcccgtgccgctctctttataggcaaaaacaatttccccggcagaggaaatctgcaccgcttcacctgtcgagttatctgtagccccaccaagcacctgagaagcagctcctgaatactgaatgacgttacaccaggtatagatgctggtatctccccattcagtctggaggccatttttcagtgcgcccgcactggcaggtaactgtacgtaattgtcaccgtacattatggtcaacgttggatcggcttgcgtcatggcatgagcgccgtcgtaagagattagactggcagatgagccgccaaacaaccagttgaagaagccaggctgcggagtcaccgctgagatcacccggctgacgtcagactcattcagatattccgcatcggaaaacgggacttcaaaattaaggcgagtgaatagatacggcatcagatggcttccttataaaagcagcagcaatagttcttcagctggtacgcattgccagctgcatcatgcagatcagtggttgagttgtctgagtcacagaggtttccacagataccgctgttgactccggcgttccatgacggatagcggcctgccccgtcagatgcgccacggttgagcggcgtccagccataaccgagatagacttttccggtgaatggggtggcgctggtgactttcaccttgtcgcctccattcaattgaacggaggcgatctcaagacgttccaacacattgggatcggacgtctcttgccacagctcaaaaccctttgctccggacgggtgttcggggacaatgtcagtcctgaactgaaggttgccgaccgggacatgaaacgccgccaccacggtatttgagccaactttataaatgtcgatcggatacagaggcttccacggttttccgttttccatccagtatcggatcgccttggcgcggaaaaggccaagccagcggtagccgtggttcgtcagatgcacgccgtctgtataagggaaaatatacatcggggtacacaactgaatcagcgggttactgattgcctcatcgagctgagctcgcggaatatcagagctcgggttgactaatccctgatatcgtccctgagacgccatctgataaataatcatcggcatatcagaggttgcgcgcgaaacactcttggctttgtcgttgattgaggactgcatcaaaaccattttgctacggtagtaagagtaagaactaccgagatacgcatccgcctccccctggaagaatgtcagaactggtaacccgtactgatagccagccgatgctgcaagctgtgccgctttatctatgctggacatgagctgggtgtaaggttcagtccctggttcgagctgagccatggaataaccactcacgccagacgccgcagccatatactttctgtctggtgctggcgaatcatattccagctgatgaatcaggctcgtatcgtgatattgctgcgttgttgtgtcgggtacggtgaccagtgaggtgagtgttttgttatacgttacgatccccgtatcaaacataaatgcgttggttaccggggtgagtattccggcgccagcgttcaggctgatggaaagactttgtccgaatgcgcgacagtccacaaactcaggccagtattgcgggggggtgtaactggcgtcaccgccggtgccgacctttttaccgaacaggtattccgcctgctcagataatcgcaactcccgaacaatacggccggcactgtccgccagaagaattatcctgcctgcatcacttccgttgtaggaccatgtttcagatcctgcctccctggcctcatccacttcgccctgtcgcggtacctcattcccgaacacaaccagtttctgcttttcgatatttagtttgacaagtttccttagcgcattatccgccaccagaactacctctgttttgtcatcacggtcgtcccgccatgtgtcgctcagcgaatctgataacgtaatccgcatctgattgagcgagtcgatatctccctgcataccatcaacgtaggcctgtgacggcatcctgcgcccggtggcagtcagcgtcccggctacattcatgtactcgtcagccagcgcactgccgtccgggctacgcacgtaggttgtggagttcaccggaatattcgctatatccgcctgggccgctgccagcgtcgcatactgcttgctgagcggaatgatgttctgccgtatctcatcatttttcgccatcatctgacgccatgaataaagaggctcaccaccacggtcggggacatctgcggcgggcccattgaccagcttatccaggcgctcggcgttatcgagcaacacagcgggagacgtgctccccagctccgggttaaaggccatgttttttgctccaaaaagaggcttcgcccaaacgagggtttgagcgaatggccgcagctttttacaatcagctatttcaacgggttacaacatgctgattggctatgcacgggtctctacaggggatcaaaacctcgatttacagaaaaacgcgctgatccgcgcagaatgtgaactggtttttgaggatatggccagcgggaaaaatgcccggcggccagggttaaagcgagcgctgcggcggctccgcccgggggatgtgctggtggtctggaagctggatcggcttggccgcagcgtacgcgatctgattacgctcgtgtcggagttgcaggcgcgcggggtgaatttccgcagtcttactgacagcatcgacacctcgacgcctgcgggacgtttcttcttccacgtcatgagcgccctggcggaaatggagcgcgagttgattgtggagcgtacccgagccgggttagccgcagcgagggagcaggggagagtcggcggccgccgccgggtaatgactgaagaagtggtggagcggtgccgcagaatgctggagaacggctctacccggcagcaggtggcagatgtcatcggggttggggtgaagactatttataagtacttcccagcgggataaggaagcccgcccggtagccgtatgcaagagctacccggcggacagatgcccggaatggacaccgtgaatgattgtattggctgctcagtttataaaccagtcatcagccgtttcccaggcgtctttcagagtagtctctacaaactccttagcaatttccttatcagtcgcccacaaaacgctcagcccatcattactggccgttttcacgatcacttcaacatcgtcatattgcttactgacacggcgggtcatctcgtctttcaaagcctccagtgaaccctttggcattttcccggctttctctttggcaatgctgatttctacacgcatgatcaacacctcgatttactggctggatatacagttgtattgctgtaagtatatccagtgtatgcctggtgtctatgctttttaggtgtgtatttttgttacgattatttacaaatagaaaaccccagactgtgaaatctggggttcttttgaagtgcacgtgcattttgcgtgcatatttttgtctttatttggtctgcttaccgtctggtcggtgtccgtaagtgactgttttaactatcactgtctggttgcagtcctatctaaagtggtggagctggcgggagttgaacccgcgtccgaaattcctacatcctcggcactacatgcttagtcagtctttacattcgcttgccagctgcggacagacacgccactaacaaactagcctgattagatttaacgcttcaaccccaggcagggcatccacgcgatctcttttgggtttgacctctctttgatccccgtcttaagagcggaagctagggagagagggctcagagcaggttattaagctgctaaagcgtagttttcgtcgtttgcgactattttttgcggctttttacgaggccaaccgcccctcggcatgcaccttgggtttcgcaaatcccgtcgaatccagaatcagccccaatgtgtaggtcaagtataacagatttgtgaatgtcgttaccagccccatcacgcaggattatttcagcagggtggacgaaaaagcagcatcaacaaggatatagcgtaagggccagcgagagctggccctcggggaggggaaattaacgtccggcgtgcttcataatacgcgccttatccagcgcccattcacgatctttcaggtcggtacgcttgtcgtgctgtttcttacctttggcgacgccgattttcactttgcaccaggcgttcttccagtacagcgacagggcgacgacggtgtaaccttcgcggttaatgcggccgtacagcgtgtcgagttcgcgctggttgagcagcagcttacgggtgcgcgtcgggtcgcagacatagtgggtggaagccacggccataggcgtaaagttggcgccgaacaggaaggcctcgccatccttcaggatgacatagctatcgccgatgttggctttgcctgcacgcagggatttgacctcccagccctgcagggcgagaccagcctcgtattcatcttcgataaagtattcgtgacgggcgcgtttattcagcgcaatggtggctgatccaggtttgtgggcttttttcttagtcataatgtcctgaagtcatcgtcttatacacagttacctcgatcgcatcctgcgaggtgtactgcgcatcttagcacgagttgcggcacagcgttttttttagcagcagataaatgatattatttgcactgtgtttaaatgtggaacctgctatgcctcagattagccgtactgcgctggtgcctttcagcgcggaacagatgtatcaactggtaaacgatgtgaagtcctatcctgattttctgccaggctgcaccggtagccgcgtgctggaattggggccgacgcaaatgacggcggcggttgatgtgtccaaagccggcatcagtaagaccttcaccacacgcaatacactgaccagcaaccagagcattttgatgagcctggtggatggcccgttcaagaagctgattggcggctggaagtttattccgctgagccccgaggcctgcaaaatcgaattccatctcgatttcgagtttactaataaactgattgagatggcttttggccggatcttcaaagagctggccgctaacatggtgcaggcgttcacttcgcgcgccaaagaggtttacagtgccggctaatattcgtgttgaagtcgcctacgcgctgcctgaaaagcagtatctgcagcgggtcaccctggacgagggggcgacggtcgagcaggcgattatcgccagcggtctgctggcgctgcgtgatgacatcgatctggcgaaaaacaagctgggtatctacagtcgtccggtaaagctgcatgacgaagttcacgacggcgaccgggtggaaatctatcgtccgctgatcgcagacccgaaagagctgcgtcgccagcgggcagagaaaagcgccgcaaagtaacctgcagcagaccggctatcagccataaaaaaagcgctcaccgagcgctttttgcttttccgggccttactgactggtcagcgcaggcttgttatcaatgttagtcaacacaccgccgctgttgaaggtcagggtcagggtctgctgagtcactttctggtggcccggctcctgacggaagacatagaaccaggtattggtgccgaacggatccgtcatcattggcgtccccagagcataagctacctgctgttgcgtcataccgacacgaatttttgctacatcgtttggtgccagatagttaccctggttgatgtcaggacggtaaaccactcgttccagagtggaacagcctgcggtcaacataagaagaaccgctgcggcagcagtcagcgttttacagcgcatagtgatttgattcctttttgggcccgagcagtacgtggctcatctgtaatatgccgataataatagaccttcgcgccgttggaaacctccggctgcaggtcagcaggcaatttgctgttcactatgaccctgtgaaaatcaaaaagtttacgccgcaagcaactctttcgcgttcgccagggtgttgcgcgtgacttcgctgccgcccagcagacgggccagctcctgcaagcgagcacgtttatccagcggctgcatatgggtttcggtcatctcgccatcggtctctttgcagacaaagaaatgatggtggccgcagcctgcgacctgcggcaggtgggtcacgcacatcacctgcgtggactcgcccagctggcgcagcagcttgccgaccacggcggcggtcgggccgctgatgccgacgtccacttcgtcgaagatgagcgccggggtttccattttacgcgcggtgatcacctgaatcgccagcgcaatgcgcgacagttcgccgccggaggccactttggcgattggctgcagcggctgaccggggttagtggtgacgcggaactcaatatggtcggcgccgtcggcggtgagatggcgttcatcgaacgcgacctcaatcgcgaagaccccgtgcggcatcgaaagtgagtgcatactttcggtgataagctgggtcagctcgtcggcgctggcctggcgcagggcatgcagctggcgtgcggtctccagcgccagctgatgatgttcgaccacctgctggctgagggattccagcgagccggcgctgtcgtccagcaggcgctgctcttccagcatcgcctgataaaccgccggcagctcttccggcatcacttgatgtttacgcgccagcgcgatttgtcgggaaatccgttgctcaagttcaaacagacggttcggatcgagatccagacggtcatggtagtggcgcaactcgtcgctggcctcgctaagctgaatggccgcctcttccagcatatccaggacgccggaaagcttgctgtccatgcccaccagctcgctgaccagctgcttcgcggtataaagctggctctgcagattggcctcttcgccgtccgccagtaccgtaagggcgtgctggcaggtgctgagcagctggccgctgttggccaggcgcttgtactcttcgtcaatctgctcgaattctcccggcagcgggttaaattcgttcagctctttaagctgatactgcagcagatcggcgcgggcggcgcgctcctggctctgctgctgatgctgggccaactcgcggcagctctggtgccactggcgatagtgctcggccatacgctgagtaagcgcatactcaccggtatagccgtcgagcagcgttttttggtgttcgggtttggtcagcagctggtgggcatgctggccgtggatctggatcagcagctggcccagctcgcgcagctgcgagagcgggacggcggtgccgttgatgaagccgcgcgagcggccgtcggcgctgatcacccggcgaagtaaacactcacgcccgctctccagctgattctcttccagccagcgctgggcggcaggggtatctttcagcgcgaagcgcgcgcacaggtcggcacgggtggcgccgcgacgcaccatgtcggcttccgctctgccgccgaggcacagccccagcgcgtcgatggcaatggatttcccggcgccggtttccccggtgatggcggtcatgccgctgtggaaatcaatttccagttcacgaacgatagcaaaattactgatggtgagttgcgccaacatagctgccttcctgtatgaaaaaccaatactgtgttttcgtacagtatagactggttttttatccagtaaagaggcagccgtgaaaatcagaacaattttttcgaccagccgagcttggtgcttaatgtattgaaatagctgtaatctttagggtgaatcagattgaggtgataatcacagcggcgaatgaggacatcttcgccatcctggatcggcagggcaatctggctgtcgcagctgatctccagatcgctgcagcggtgagagaagcgtaggcggatggtgctgtcgccgttgatcaccagcggtcgcgctgaaagggtgtgcgggaacatcggcaccagggtgatggcgtccagcgacggcgtaaggattgggccgccggccgacagcgaataggcggtggagccggtcggagtggagataatcaggccatcggatcgctgagagaacgcaaagacttcgtcgatatagacttcgaactcaatcatatgcgccactttgccggggtgcagcaccacttcgttgatggcggtgctgatacgtttctggcaatcctgctgacacacctgggcctccagcagaaagcgtttctcggcgatgtagtggccttccagcacgtcggcgagctgctgcagggcgttgtccgggtcaaggtcggtgagaaagccgaggttgccgcggttaatgccgatgacgttaatgtcgtaacgggccagggtccgcgccgcgccgagcatattgccgtcgccacccaccaccaccgcgagatcggcctgttggccaatctccgccagcgtgccggttttcacgttgctgagctgaagttcatgggcgatctgctgttcaaccagcacttcataccctttgctgcacagccagcgccagagcatttcatgtgtggtcagggcggtggggtgacgaggatgtcccacaatgccgatacacttgaaatggttcttcatgatctggatgtccttgcgttaaatgaaatagtgacaatctgtccgcttcccttgaaacccggaaactgatccccataataagcgaagttagcgagatgaatgcgaaaaaaacgcggagaaattcatgagtagtaaagaacagaaaacgcctgaggggcaagccccggaagaaattatcacggagcagcacgacgacgttgaggcagtagagcctgaagtttcggctgagcaggtggatccgcgcgatgaaaaaattgcgaatctggaagcccagctggctgaagcgcagaaacgtgaacgtgaagtgatgctgcgtgccaaagccgacgaagataacctgcgtcgccgtaccgagcaggatatcgagaaagcgcacaaattcgcgctggaaaaattcgtcaatgaactgctgccggtgatcgacagcctggaccgcgcgctggaagtggccgacaaggctaatccggagctggcgccgatggtggaagggatcgaactgaccctgaaatctatgctggacgtagtgcgtaagttcggcgtggaagtgatcgccgacaccaacgttccgctggatccgaacgtccaccaggccattgcgatggtcgagtctgaagatgtggcggcgggcaacgtgctgtccgtgatgcagaaaggttataccctgaacggccgtactattcgcgccgcgatggtgacggtagcgaaagcgaaataacgcttgctgccttgctcaacggctgcctgcgggcggccgttttttgtgtcatcgctgctggcgcgagataaaaaaacggcgggccgcagcccaccgtgatattacttccttcgctcgcgctactccgcgacgctctcgcgtaatgatttcaccggcatcactttcacctgtttgatcatgttgtcctgcacgtcgaggatatctatatcgtactgctcaatgcgcacgcgggtgcccgggaccgggatctcttccagcgcttcgaggataataccgttgacggtgcgcgcttcatcttccggcaggtgccagttaaacgctttgttgatttcgcgaacgttggcgctgccgtcgataatcaccgtgccgtcgttaagcggggtcacttcctccgccagggtgggtgacatggaggtggtgaagtcgccgacaatctcttcaagaatatcttcgacggtgaccagcccctgaatatcgccgtattcatcgaccaccagaccgactttctttttattacgctgaaatttcaccagctgggtgctgagcggcgtgccttccggcacaaagtagatctcatctgccgcccgcagcatgatctcttttgtgaactctttcttctccgtcatcagacggtaggcttcgcgaacgcgcagcatgctgatggcatcgtccagcgaatcgcggtagagcacgatgcggccatgcggggagtgggtcagctggcggacgatagatttccagtcatcattgatatcgatgccgacaatctcattgcgcggcaccatgatgtcgttaacgctgaccttctccaggtccagtaccgacagcagcatatcctgattgcgtcgtgagatttgtgaacgggattcattcacaatcgtgcgcagttcatctttgctcagggcgctgctgatgacggtatcggtgcggatgcccatcatgcgcatcagtatgcgggtgatggtattcagcagccacaccagcggcatcatcagcacctgcaggggcgccaacaggaagctgctggggtaggcaaccttttccggatagagggcggcgatggtcttcggcagcacttcggcaaataccagcaccacaaaggtaagtacgccggtggcgatcgcgacgccggcgtcgccgtacaggcgcatgccgacgatggtgcccagcgccgaggcgagaatgttgacaaggttattgccgatcagcacaaggctaatcaggcggtccggcttgcgcagcagcttctccacgcgcttggcggggcggttgccttgtttcgccatgtggcgcaaccggtagcggttcagcgtcatcatgccggtttcggaaccggagaaataggcagagataatcaccatgacgatcagcgttatgatcagcgtggtggtggagatatgttccacgtaggattccttaaaagacttagctcacgaactgctgcagcacgcggctaccaaaataggccagcgtcagcagaccggcgccagcgacgctgaaccagaccacacgacgtccgcgccacccttcatgatagtgcccccacagcaggacgatatagacgaaccacgcaataatcgacagcaccgctttatcgatattttcgctgctgaacagattgtgcatgtagaacaggccgctgcacagcgtcagggtcagcagcaccacgccgacctgggtgatgtggaacattttgcgctcaatgctcatcagcggcggcatttcgctgctgaaggccagctttttattcttgagctggtagtcgatccacgccagctgcaacgcatacagcgcggcaatgatcagcgtggcgtacgagaagagcgacaggccgatatgcaccagcatccccggggtggtttccaggtgggtgatatattcgttaggcacgaatgtggcgaaagccaggttgatcagcgcgaaggcatagacgataggcagcagcagccagccgcgattgcgcgaggccacgatagtcatcaccgtacagatcatcaggctgaccagcgacccgacgttcagtaagctgagattttgcccgctctcgccgccggggaatatccgtgcttccagcgcaaaagcatggcagatcaaggcgatagtcgcagataaaatcgccattcgccgccagctgctgtttttttgcagcaagccggggataatcagcgcgaggctgacggagtaggcgacaagggcgagtagagcaaaaacaggcataggtgtcggctgttggctaaataagaaagagaagcagtataacgttagcaggcctctgctccaaccgttgcagcacattcagattgatgtcgtgttatactccgccacattcgttttgtgtgtcgctgcggcgaccgaccgtttccacctcaggcgagagacaatgtttgataatttaaccgatcgtttgtcgcgtacgctgcgcaacattagcggccgcggacgccttacagaagacaatattaaagacaccctgcgcgaagtgcgcatggcgctgctggaagcggacgttgcgcttccggtggtccgtgatttcatcagccgcgtcaaagagagcgcggtcggccatgaagtcaataaaagcctgaccccgggtcaggagttcgtcaaaatcgtccgcaacgagctggtggcggcgatgggcgaagagaaccagacgctcgacctggccgcgcagccgccggccgtggtgctgatggcgggcctgcaaggtgctggtaaaaccaccagcgtcggtaagctggggaaattcctgcgcgagaagcacaagaagaaagtgctggtcgtttccgcggacgtttaccgcccggcggcgatcaaacagctggaaaccctggccgagcaggtcggcgtcgatttcttcccgtctgacgtcgggcagaagccggttgatatcgtcaacgcggcgctgaaagaagcgaaactcaaattctacgacgtgctgctggtggataccgccggtcgtctgcacgttgacgaagcgatgatggacgaaatcaagcacgtccacgccgccattaacccggttgaaaccctgttcgtcgtcgatgcgatgaccggtcaggatgcggcgaataccgcgaaggcctttaacgaagcgctgccgctgaccggcgtggtgctgactaaagtggacggcgacgcccgcggcggcgcggcgctgtcgattcgccatattaccggcaagccgattaaattcctcggcgtcggcgagaaaaccgaagcgctggagccgttccatccggaccgcgtcgcttcccgtatcctcggcatgggcgacgtgctgtcgctgatcgaagatatcgagagcaaggttgaccgcgcgcaggccgagaagctggcctccaagctgaagaagggcgacggtttcgacctcaccgacttccttgagcagctgcgccagatgaaaaacatgggcggcatggccagcctgatgggcaagctgccgggcatggggcagatcccggacaacgtgaaagcgcagatggacgacaaagtgctggtgcgtatggaagcgatcatcaactcgatgaccctgaaagagcgcgctaagccggaaatcatcaaaggttcgcgtaagcgccgtatcgccgccggctgcggcatgcaggtgcaggatgtgaaccgtctgctcaagcagttcgacgacatgcagcgcatgatgaagaagatgaagtcgaaaggcggcatgatgaagatgatgcgcgggatgaaagggatgatgccgccaggcttcccgggtcgttaaaaacaagggcataaggttatcttgtttgccattttagcgccggggtgtgctcgccatcctcacgtactacctgtacgttacagtggttgcgcacacgctggtactaaactggctgcaccgccgacggccttttacagcagacttatcaactgctgattgcattttccccagaaatcagtaaaattttcgggcttttaatatgacaccgggctccgttcctcgatggggcccggttgttttattcacacaagaggatgttatggtaactattcgtttagcacgtcacggcgctaaaaagcgtccgttctaccaggttgttgtcaccgacagccgtaatgcacgcaacggtcgcttcatcgagcgcgttggtttcttcaacccgatcgctaacggtgcggaagaagaaactcgcctggatctggatcgtatcgctcactgggttggccagggcgctactgtttccgatcgcgttgccgcgctgatcaaagccgctaacaaagcagcttaatctgtcacggtggtcatgatgagcaagcaacacaccgcgcaagcacctgttgatccgatcgtattggggaaaatgggttcttcctacggtatccgtggttggctcagagtgttttcctccaccgaagacgccgaaagcatttttgactatcagccctggttaatccagaaggcgggtcagtggcaggtcgttgagctggaaagctggcgccaccacaatcaggacatcatcatcaagctgaaaggtgttgacgatcgtgatgccgcgaatctactgactaattgcgaaattatcgtggattcatcgcagttgccggagctggaagagggtgactactactggaaagacctgatgggctgccaggtagttacgacggaaggctatagcctcggtaaagtcatcgatatgatggaaaccgggtcgaatgacgtgctcgtcatcaaggcaaacctgaaagatgcatttggtatcaaggagcggttggttccgttcctcgatgggcaggttatcaagaaagtcgatctcactacgcgtactatcgaagtagattgggatcctggtttttaaattctccggataaacggtaaaagacggcgctatgtggattggcataattagcctgtttcctgaaatgttccgcgcaattaccgattacggggtaactggccgggcagtaaaaaatggcctgctgagcatcgaaagctggagtcctcgcgacttcacgcatgaccggcaccgtaccgtggacgatcgtccttacggcggcggaccggggatgctaatgatggtgcaacccttacgggatgccattcatgcagcaaaagccgcggcaggtgaaggcgcgaaggtgatttatctgtcacctcagggacgcaagcttgatcaagcgggcgtcagcgaactggcaacgaatcagaaactgattctggtgtgcggtcgctacgaagggatagacgagcgcgtaatccaaaccgaaattgacgaagaatggtcaatcggcgattacgttctcagcggtggtgagttaccggcaatgacgctgattgactccgtttcccggttcattccgggagtactgggccatgaagcatcggcaacggaagattcctttgctgatgggttgctggattgcccccactatacccgtcctgaagtgttagaggagatggaagtaccgccagtattgctgtcgggaaaccatgctgagatacgtcgctggcgtctgaagcagtcgctgggccgcacctggcttagaagacctgaacttctggaaaacctggctctgactgaagagcaagcaaagctgctggcggagttcaaaactgaacacgcgcaacagcagcataaacatgatgggcaggcgtgagcccccaatatcagtttacccaggataagagattaaattatgagcaacattattaagcaacttgaacaagaacagatgaagcaggacgtaccttccttccgtccgggtgataccgtggaagtgaaagtatgggttgttgaaggttccaaaaaacgtctgcaggcattcgagggcgtggttatcgctattcgtaaccgcggtctgcactctgcattcactgttcgcaaaatttccaacggcgaaggcgttgagcgtgtcttccagactcactctccggtagttgacagcattgctgttaaacgtcgtggtgctgtacgtaaagctaaactgtactacctgcgtgagcgcactggtaagtctgctcgtatcaaagagcgtcttaactaagattcgctttcgcgacatcctgatagaaagggctggccagatggctggccctttttttatctttgttgtaaccatcgtgatgtaaatcatttacaatacgccctctatacggaggggcggtggtcagtaacagttttcagcaaacgacacctaaacggcgagccgcctggctggcgctgttggcgatcctgctgatcgtggtggcccccctgatctccgtctccctgcaaaaagaccccataagcgccatgcccggcatgcaccacgccatgatgatggatagctcgtccgcgagcatggcgcagatgcccgggcacaagatggcgatgatgcacagcacagacggcgctacgcataccggacacgaaatgctgctggaccatgccgaagcgtgtggctattgcgtgctgttagcccatgtcccggggctccttttcgcgctggcgctgttcgtcgccatgctcctgcggcgcattcgcctgccggtttctcgcccggtattaaagcactggcactactttccctggctctaccccgaaacccgcgccccgccgcggctgtctgctttttccctttaataaaaatcaatctgcgcaccgcgcaacaacctcttttgctttaaaaaaggaaaagtatgacaacctgcacctcgcgcgcggcatggctgaacctgctgcgtcgcctccatttctatattggtctgtttatcggaccgtttatctttgtcgctgccctgaccggcacgttgtacgtggcgacgccgcagctggaaaactggctctatcacgacgcgctgcatggccttgccgaggggactccgcagccgctcagcgcccagattgcggtggccgaagaagcgacccagggcaatctgcggctgctggcggtgcgtccggcgcctgcgttgggcgagaccacgcgcattatgtttgccgatccgggtctcggagagtcggaatcccgggctatttttgtcgatccgatcgcgctgcgggtgaagggcgatatgacggtctacggcaccagcggcatcctgccgctgcgccagtggattgattatgcgcatcgctctctgctgctgggcgacagcgggaggttatacagcgaactggccgcctcctggatgtgggtggccgcgctcggaggcattgccctgtgggcgatgacgcgtccaaaacggcggctgaataacgccctgcagaaccatcgtcggctgcacgtgacgctgggctggggcttactggtgggtatgctgctcttctccgccaccggcctgacctggtcgcaatgggccggcggcaatgtggacaaaatgcgggcagcgttcggctggctgacgccgcaggtcaatacccagctgcatggcgagatgccgatgacgcacgatccccatgccggacatcatatggatgcgatggccatggcccagcatcagccggcgctgcagttggcccagtttgaccaggcgctggcggcggcccgtcaggcggggctgaacgccagccggctggagatccgtccgccagtgtcagacgaccgcgcctggacggtgaatgagatcgaccgtcgctggccgacgcaggtggacgcggtggcgatcgatggcgccacgatgcaggtggtggatcgcacgcgttttgccgactttccgctgatggcgaagctcacccgctggggcgtcgatttccatatggggatcctttttggtctggcgaatcagctgctgctggtgggatttggctgcgcgctgtgcgttaccatcggggtggggtaccggttatggtggatccgccgtccgcctcaggcggcctgggatccggcgcattcgctgctgcaggcgtggctgtcgctcgcctggcctgcccgaagcctggtgcttgggctggcgtttgcccttggattggccatgccgttaatgggagccagcctgctgctgttcattgccgttgactacctgcgctggcgcgcggcaacggcaatgaggatgatgaagtccagcgactaagtgaagacttacggcgtgctgatgaccaccgttacccggcggttttcggcgcgcccggccgccgtgtcgttgctggcgatcgggtattttttgccaaggccgcgggtgactaaattactgcgtgggacatgagcgccttccgcccaggcatcggccacgctgttggcccgcttaagcgacagggcttcattgtagctatcttcaccataattatcggtatggccttcaaggcggctatgggtgatcccggtagccgccagccgcgaggccatcgtggtgatctgctggcggctgtcgggacgtagtcggtagtcattcttgtcaaacaggatgctatcggataagcccagggaccaatcgccattgctttcagtgaagccgtaagatttcatcgccgccacctgctccggggtaaattttccctgaggagcctggcaacctgtcaaaagcgccgccgccatcagggcggggacgaaatattttctgatcataatgagtcctttattatttcagcgtctgctggatacgttggtttttcatccgatacatattctgatcggcaagttcttgcagtgattccgcggtggcgtgctcccacgccagggcataaccgacgctcagcgagagcgtggcgctatgaccgttgtgcaggttgaatggcggaagaaattgttccgttagcgcctggcacagggcctgcacttctgcttccgagcgcacctcgcgcagcagaacggcaaactcatcgccgccaagacgccacgccagatggcgtttaccggcaaaagtcatcaggcggctggcgacctccatcagcactttatcgcccgccgcatgcccccagttgtcgttaatcagtttgaaattatcgccatcaagaaacagcaatgccgaggtttgatgatcgacttcattctgcatcagctcggcgagcgcgttacgaaaggcggcgcggttagccaggccggtcaacggatcgtgtaacgaactgcgcaacagctgcgcgtttttggcctgcagctggcgctgccagtcctccatttcccccagcaggctgttaaagtcctgggcgaaaagatggaactcctcgatacgctcctccggcacccgccgggagaagtggcggttttcacgtatatcatgcacgacctcagtgatgctctgcagggcggcgacgatcccccggtgtagggagtgggtcagcagcagggcgatgaacgaggcgagcagaatgctgccggtcagcaccagaatcgagataccgagaaagtggctaatcagttcatcaagcgcggtcaatctcagctcgccgatttgtttgccctggtgccagatgggctgcaccgtgggctccggaaacagccatttactgataagcccgctcacttgctctttgttggccagcggttcatggcgccacgcggcgaagtgctgcatctggccgtttagcacgattgcctgggagatctgcccttgcttgcccaacgacgcgagggtctcctctgccgccgcgctgtcgccaaacaccagggcggcttcgaggctgcgccccatggtcgcggcagtgagctcaagatttttctgcgcgtactgcttgaacgtgaagattgaggctgtactcagcagcagccagaccagcgtcatggagatcaccacgcttatcacgctaatgcgacggagcgcgcgtttgaaagtcgggcgcggagtctgtgaaaagtccttattcatgtggtttcttccgggcaagcatcaggacgtccgggttaacccgaaccccgctgtgcgtcagaacgtccagattaacggagaagcggacccggtcgtcattgatgatcaggcaaaacgcgctaccaattgaacaatccgtattttgttctgcgatgagtaacagcggcctcgggccatagcggcgagtgagttctgactgttcagtcggcgattcgctgccaaaataaaaaccatcgcaggtcgtttttaacgcttcttcacgattacgtactatcaccggttgatagggtaatgcatccggatcttcatgagccaggctatgggtgaagcgtgatgaggcaaaaatgcacagctttggcgctcctgttaatgacggccaacgggtgtaggtcacgatcccggaaacaatagcgcgaacatgttctgaaggtccggcagcaaaaacaggagataccgcgatgagaaaaaatacagtcaataaaagacggtgtaatactgtcattaacgcttccgtcaaagtcgccatagcgcgggaaaagccgctgccgatgcccggcgaagaataccactgttaataaaacccgtcattagatgcgccctttgctttgggacaattctcaccaggatttttcgtagtaccgataccgtgggtgcgcaagtttggcttgttttttctatgtgtaaatattgttatacgcatcgcgccattgtgagtggcaattaattcgtttgtgtaaattaaaatttacggaatatggattgaattctttactttgtgtggtatcgttacgtcatgccctctgaggcaacccttatcgcaaacgagctacacaggatcgcaatcatgcaaaaagacgcgctgaacaacgtacatattaccgacgaacatgtattaatgaccccggagcaactgaaggcggaattcccgctgagcgtcgagcaggaagcgcagatcgcgcacgcccgtcagaccatttcggatatcatcgccggtcgcgatccgcgcctgctggtggtatgtggtccttgctccattcacgatccggaagctgcgattgaatatgctcgtcggtttaaagcccttgccgcagaggtcagcgatagcctctacctggtgatgcgcgtctattttgaaaaaccccgtaccaccgtcggctggaaggggctgattaacgatccgcacatggatggttcgtttgatgttgaaggcggcctgaagattgcgcgtcgtctgctggtcgagctcgtcaatatgggactgccgctggcgacggaagcgctggatcccaacagcccgcagtacctcggggatctgttcagctggtccgctattggcgcgcgtaccacggaatcacaaacgcaccgcgaaatggcctctggcctgtcgatgccggtcggctttaaaaacggtaccgacggtagcctggccacggccatcaacgccatgcgcgccgcggcgatgccgcaccgtttcgtaggcatcaaccaggccgggcaggtctgcctgctgcaaacgcagggtaatccgaacggccatgtgatcctccgtggcggcaaggcgccgaactacggtccggaagatgtggcgaaatgcgaaaaagagatggcgcaggcgggactgaagccgtcgctgatggtagattgcagtcatgggaactccaataaagatttccgccgccagccggccgtggctgaatccgtggtcgcgcagatcaaagatggcaaccgctccattatcggcctgatgatcgaaagtaatatccacgaaggcaatcagtcctctgaacagccgcgtgaggcgatgaaatacggcgtctcggtgacggatgcctgcatcagctgggagactaccgaggcgctgctgcgtgaactggataaggatctccgcggccacctggcggcccgtttggtttaagaggaaagtatggttgctgaactgaccgcgttacgcgatcaaattgatgaagtggataaagcgttgcttagcctgctggctaagcgtctggagctggtggccgaagtcggcgaggtgaagagccagtatggcctgccgatttacgtcccggagcgcgagtcggcgatgctcgcctcccgacgtgaagaggcggctgcgctcggcgtaccaccggatctgatcgaggacgttctgcgtcgcgtgatgcgggaatcctattccagcgaaaacgacaaaggcttcaaaaccctgcagccgaatctgcggccagtggtcatcgtcggcggcggtgggcagatggggcgtctgtttgagaagatgttaacgctgtccggctaccaggtgcgtattctggaaaaaaacgattgggcccgggcggcggatatcgtcgccgatgccggcatggttatcgtcagcgtaccgattcacaccaccgtggagacgatcggcaggctgccgccccttccggcggattgcattctggttgaccttgcctcggtgaaagcggagccgctgcaggcgatgctggcggcgcatcagggcccggttcttggcctgcacccgatgttcggtccggacagcggcagcctggcgaagcaggtggtggtctattgtgatggccgccagccggaggcctatcagtggttcctcgaacaaatccaggtttggggcgcgcggctgcaccgcatcagcgccgttgagcacgatcagaacatggcctttattcaggcgctgcgccactttgccaccttcgcctatggcctgcacctggcggaagagaatgtacgtcttgagcaactgctggcgctctcgtcgcccatttaccgactggagctggcgatggtaggccgtctgtttgcccaggatccgcagctgtacgccgatattattatgtcatcggtaaacaacctggcgctgattaagcgctactaccagcgtttcggcgaagcgatcggcctgctggagcagggcgataagcaggcgtttatcgacagcttccgtaaagtcgaacactggtttggcgattacgcccagcgtttccagagcgagagccgcacgctgctgcgtcaggcgaacgataatcggcagtaaagcgaaaaagatgtatacaataaagccagcgaccgctggctttttttatagggatgacaacgatggctgaaccacaaccgctgtttgactacaccggatacctgccggaatgcccgacctggagcgaggcagagcaggccctctactgggctgatatcatggaatgtgaaattcaccgctacgatatccgcagcggagaacaccaggtgctgcagtttccagaggaggtcggctgttttgccctgcgcgagaagggcgggtttatcgtggcattgcgcagcggcatctggctgaccgacgcccacggcctgctgcggcggaaagtctgcgataacccgagcaacccggagctggcgcggtttaacgacggcgggaccgatcgcgatgggcgcttttatgccggtaccttctgggggcctggggattacaacggcgcgctgctgatgcgagtggataacgacctgcagccgaaagtgatccagtgtgacatccatggcgccaatggcctggcctttagcgccgaccggcgctggatgtatacctctgatacgccgaacgccgtgatctaccgtacgccgctggatgagcagggtgagcctggccgacgcgaagtctttcgccgttttcagccgggcgaagggatccctgacggggcggcgatcgacgtggagggatgttactggagcgcaatgttcgacggctggcggatcgcccgtttctcgccgcagggcgaggagctggaatcctacccgatgccggtacgttgcccgacgatggtctgcttcggcggggcggatatgaaaacgctctatatcaccaccacccgggaaaacatggaggacgatgagctggcgcagtatccgctgtcaggcgccatcttcaccctgccggtagcggtggcagggatgaagaaattaccgttccgcgaatgttaaaccggatccaccgggaccacgttttcgctagggtagcagccgaggaccttcatggagcgggtgatatccgccagctccttcagcgccttgcgcatgggcagcgaatccaggttggcctgaatatcgagataaaacatctcttcccagggattgccgtggatcgggcgggattccagtttggtcatgatcagattgtggttgcgcagcaccagcagggcttccaccagggcgcccgcctgctgaccggtcgccattaacagcgtggtcttggccggcacctggtcggagacgttcaccgctttgcgcgccaggacgaggaagcgcgtgatgttctgcgtctggttggcctggcagtgctccagcacctgcagaccatacagagcgccgcccgcttcgctacccagggccgcgacggccggggagttcgcctgcgccactttttccattgccgccgaggtgctctcggtatactcaatcttccagtgcgggtagcggctcaggtactggctgcactgctggaacggctgcggatggctgtaaacggtctgaattttatcggcatccgtcgaggtgctcaccagtacgcaatgatcgatagggatcgtcagctcgccaacgatcgacaggctggtgtgctgcagcagatcgtagacgtcgttgatcccgccggagctggtgttttcaatcggcaccaccgcgtaatcggcctggccggtttctacctgattaaaaatatcggcgaacttcgcgcagccgctctcaataaactgctcaaagtggcgagcggcgtactgacgcgccgccagatgcgagtaagagcccttgggaccgaggaacgccacgcgggccgaatgcgggttaattttattcagatgctgctgcagcagggtttgctgggtaagaacagagtcttcgataatcagctggaacaggcgggtgatatagtgcgcatccagattatggcgcttgccgatagtcatcaggcgctccagcagatcgcgttcgcggtcaatatcacgcaccggacgatgggaggccagtttggcttttccaacctcaacagccagtccgcggcgctccgccagcaaagcaagcagcttctcgtccagggcgcttatcttatcgcgcagcgccagtaatgggttttcctcggtcatagatgttgcctttgttgttatcaaataaaaaaggcctcccgggagggaggccttattgttcgtcttcgcattctttcttatacgacgaattgcctcccggtcaggggaaggtaaaaaagaatgcgaagaagaacgggacaagtttcatggtaaattcctttaggtagtggggattacagtacctgtactgttttcactctgtcaataaaaaacgcgcccgaaggcgcgtggcatgacacaacttaagttaaggattactcttcttcttccacaaagcctgcctctttcaccgacgtcgcggcgcggcgggcttcccctttgtgttgcactttattgagctgccgttccagcttgttgatcaattcgttaatggcggcgtacatatcttcatgacgcgcactggcaaccagatggccgtttggcgtgttgatggttgcatcagcgataaaaccctgcggctccttagacagaatgatgtgcgggttgattaaatgagtttgccacttatccagtttggcgagacggtctgcgacatgctggcggattgccggagtaatttccatttgtttactggtaatgttcattgtcataaattttacctcttgtctttcccgtcttggtgaatccagcatacctttcccaatgtcaaaatgtgtgatctaaatcacattttattgtcactttttgtcaacaaattcattttgtgagacagggcaggaagaagtgagattttacttgtcgaacccgataaagcaggccatatttgatgagttaacccggcgctaaaccgcttcagctcgtcgggaaacgtataaaaaaacggcagccagtggctgccgtttgcgatcgatgagtcaggctcaggtgttcttgctgttcgcggcgataatcttcgcgactttgtccgcctgagcgttcatttgcatctgacgataggcgttttccatcttcggcagggcatcgcgggtggcctgggtatccggataattacgcatcatcccttccacacggttaaccacggcaacccatgcgccacgatcggtgtagtaatccacgaccgacagctcatatttggccagacgatctttcaggaacaccatgcgtttataggcgtcagtggcgtactggctgttcggataaccacgcaccagtttggagaagtcattgaaggcatcgcgcgcgtgctgcggatcgcggtcggagcgatcaacgccgaagaagccctgcagggcgctgtcatccagggccatgttggtcaggccgcgcatatagatgacatagtcgatgttcggatgggtggggttcaaacgcatgaagcgatcgatagccgcctgagccagaggaagatcggcgtttttataatacgcataaatcagatccagctgtacctgttgggaataagggccgaatggataacgattatccaatgcttccagttgcgttatcgcctgtttccagttaccgtcctgcagtttttgctgggcggtcgcgtagatttcattcggcggattatcaggcacctcttccttagagccggagcaacccaccaaagccaggctcagtgtggcggctgccaccaggtatttcatgcgcgtcatgacgttttgacttcctcaaaatgtttatgcgggagaatctctgttcctgctcccgattaagaccagctacaatagcacactatattaaacggcaaagccgtaaaacccaacgttaaacgaagaagctgtatatggcacaacgagtacaactcaccgcaacggtgaccgaaaatcaactcggtcaacgcttagatcaggctttggccgaattgttccctgattattcgcgatcgcggataaaagaatggatcctcgaccaacgcgtattagtcaatggcaccattggcgataaaccgaaagaaaaagtgctggggggagaacgcatcgctatcgatgtggaaatcgaagaagaggcgcgcttccagccgcaggatattccgctcaatatcgtttacgaagatgatgacatcatcgtgatcaataaaccgcgcgatctggttgtacatcctggcgcgggcaaccctgacggtactgtgctgaatgcgctgctgcactactatccgcctattgccgatgtgccgcgcgcgggtattgttcatcgtctggataaagacaccaccggtctgatggtggtggcgaaaaccattccggcgcaaacccggctggtggagtcgctgcagctgcgcgagatcacccgtgaatacgaagcggtggcgatcggtcatatgaccgccggtggcacagtggaagagccgatcagccgtcacccgaccaagcgtacccatatggcggtgcatccgatgggcaaaccggcggtgacccactaccgcattatggaacatttccgcatccatacccgcctgcgtctgcgtctggaaaccggtcgtacgcatcagatccgcgtgcatatgtcgcatatcacccatccgctggtgggtgaccaggtctatggcggccggccgcgtccgccgaagggcgcgtcggaggagttcatcaccgcgctgcgtaaattcgaccgccaggcgctgcatgccaccatgctgcgcctgtatcccccgatctccggcattgaaatggagtggcacgcgcccatcccacaggttatggtcgagctcatcgaggcgatgcgcgccgattttgaagcccataaggacgatattgactggttatgacgaaactgattgtaccgcagtggccaatgcccggcagcgtggcggcctgtagttctacccgcatcggcggcgtgagtctgccgccctatgactcgctcaacctgggcgcccattgcggcgacaatctgcagcatgtcgaagaaaaccggcggcggatgtttgccgccggcggcttgccgtcttacccggtttggctggagcaggtccatggcaccgaggttctgacgctggacggcggaccctatccgtcgaaacgcgcggatgcctcttatagtcgtacgccagggaccgtctgcgcggtgatgaccgctgactgcctgccggttctgttctgtaaccgcgacggcaccgaagtcgccgcggcgcacgcgggatggcgcggcttatgcgaaggggttctggaagcgacggttgctcgtttcgccgataaagccgaaaatattatggcgtggctggggcccgccatcggtccgcaggcggttgaggtgggaccggaagtccgggatgcctttatggcgaaggacgagaatgcgcaccgggcttttcgtccggcaggcgaaaaatattttgctgatatctaccaactggcgcggcagcgtctggcaaacgtcggcgttgagcagattttcggcggcgatcgctgcacgctaagcgaaaaggatgattttttctcttaccggcgcgacaagaccaccggtcgtatggcaagtttcatttggctgatataacctagagaatcaagacgatccagaaggcaaacttatttttcgcatagttcaggtctttaaccttgaataattgagggatgacctcatttaatctccagtagcaaatttgacctgtttatgggaggagttatgcgtctggatcgtcttaccaataaattccagcttgctcttgccgatgcccagtcgctcgcactcgggcacgacaaccaattcatcgaacctcttcatttaatgagcgccttgctgaatcaggaagggggatcggtacgtcctttattaacctcggcgggcgtgaatgccgggaaactgcgcactgacatcgaacaggccttgagccgtttaccgcaggtggaaggcaccggcggcgatgtgcaaccttctcaggatttagtgcggatcctcaacctttgcgacaagctggcgcaaaagaaaaaggacaactttatttcgtcggaactgttcgttctggcggcgcttgaatcacgcggtacgctgaccgaccttttaaaatccgccggagcaacaaccgccaacgtgactcaggcgattgaacaaatgcgcggaggggaaagcgtgaacgatcagggtgccgaagaccaacgtcaggcattgaagaaatttaccgtcgatctcaccgagcgagccgagcagggcaagctggatccggtgatcggccgtgatgaagagattcgccgtaccattcaggtactgcagcgtcgtaccaaaaacaacccggtgctgatcggtgaacccggggtgggtaaaacggcaatcgtcgaaggcctggcgcagcgtatcgtcaacggcgaagtaccagaagggctgaaaggccgtcgggtattggcgctggatatgggggcgctggtggccggggcgaaataccgcggtgagtttgaagagcgtctgaaaggcgtgctgaccgacctgtccaaacaggaaggcaacgtcattctgtttatcgacgaactgcataccatggttggcgctggtaaagccgacggcgcgatggatgcgggtaacatgctgaagccggcgctggcgcgtggtgaactgcactgcgtcggggcgacgacgcttgatgaataccgtcagtacatcgaaaaagacgccgcgctggaacgtcgcttccagaaagtgttcgtcgccgagccttcggtagaagataccatcgcgattctgcgcggtctgaaagaacgttatgagctgcaccaccacgtgcagatcactgacccggctatcgtggcggcggcgaccttatcgcatcgctatattgccgaccgtcagttgccggataaagccatcgacctcatcgatgaggcggcatccagcatccgtatgcagattgactccaaaccggaagagctggaccgcctcgatcggcgtattatccagctgaaactggaacagcaggcgctgaagaaagagtctgatgaggcgagcctgaagcgtctcgatatgctcaacgaggagctggcggataaagaacggcagtactcggtgctggaagaagagtggaaagcggaaaaagcgtcgctctccggcacccagaccatcaaagctgagctggagcaggcgaaaatcgccatcgaacaggcgcgccgcgtcggcgatctggcgcggatgtccgagctgcagtacggcaaaattccggaactggagaaacagctggcggcggccactcagtccgaagggaaaaccatgcgtctgctgcgtaataaagtgacggatgctgaaatcgccgaagtgctggctcgctggaccggtatcccggtctcccgcatgatggaaagcgagcgtgacaaactgctgcgtatggagcaggagctgcatcatcgggtgattggccaggatgaagcggttgaagcggtatcgaacgccattcgccgcagccgtgccgggctgtccgatccgaaccggccgattggttcgttcctgttcctcggtccaaccggggtcggtaaaaccgagctgtgtaaaacgctggctaactttatgttcgacagcgacgacgcaatggtgcgtatcgatatgtccgagtttatggagaaacactccgtctcgcgtctggtcggtgcgcctccgggatacgtcggctatgaagagggcggttacctgaccgaggcggtgcgccgtcgtccttattccgtcatcctgctggatgaagtggaaaaagcgcacccggatgtgttcaacattctgctgcaggtactcgacgacgggcgtctcaccgacgggcaggggagaacggtcgacttccgtaatacggtagtcatcatgacctcgaacctcggttccgatctgattcaggaacggttcggcgagctggactacggacatatgaaggacctggtgctgggggtagtcagccagaacttccgtccggagttcatcaaccgtatcgacgaagtggtggtcttccatccgctgggcgagaaacatattgcctctattgcccagatccagctgcagcgtctgtataaacgtctggaagagcgcggatatgaagtgcagatgtccgatgaggcgctgaagctgctgagcgccaatggttacgatccggtatacggcgcgcggccattgaaacgtgctattcagcagcagattgagaacccgttagcccagcagatcctttccggtgagctggttccgggtaaaaccatcgagctggtagtaaaagacgaccgcattgtggcagtgcagtaaatcacaaaacgacaaaaacgggcccagcgggctcgtttttgtttaaaaaccaggcaagaattaaagctcaatacctgatttggttgaaaagtgagcggttgaattctttttttgaatttatccttgtcacttcagaattaccccctataatgcgcctccactgacacggaacaacggcaaacaagccgccgggccaggaggattcagcgacggaaatcgacgttgaaagccgacagagaaaagcaaaataagcgcttgactctgaatgaggaaaacgtattatacgggacctcgcgacagagcgctaaagcgcgtcgcaactgctctttaacaatttatcagacaatctgtgtgggcactcaaagtgacatggattcttaacgtcctaggacgaaaaatgaataccaagtctcaagagtgaacacgtaattcattacgaagtttaattctttgagcatcaaacttaaattgaagagtttgatcatggctcagattgaacgctggcggcaggccta

SEQ ID NO: 86 - DNA, 26515 bp, Unknown
  source: /note="Description of Unknown: KP2-Mcoc1 Bacteria Sequence"
taggcctgccgccagcgttcaatctgagccatgatcaaactcttcaatttaagtttgatgctcaaagaattaaacttcgtaatgaattacgtgttcactcttgagacttggtattcatttttcgtccgaggacgttaagaatccatgtcactttgagtgcccacacagattgtctgataaattgttaaagagcagttgcgacgcgctttagcgctctgtcgcgaggtggcgtatattacgctttcctctttcagagtcaacccgtttttcaggatttttctctgcaaccgaaccggctgtttgtgtgaagtgattcacatctgccgtgtcagtgggtgcgcattatagggatcccatttttttgcacaagccttttttcgatctttttttctgaatggtgatttttcacccttttcgccgtgtaattgcacgatttgctcaattttcaccgttttcaggggttgcacagggagataaaagccaccaaagtcttcttacgttcccgtattttgaggtctatatgtctgctcagctgcgcccctacaaagcatttttcccacaaatcggtcttcgcgtcatgattgacgcatccagcgttgtcatcggcgatgtcagaattgccgatgacgtcagcgtctggcctctggtggccattcgcggcgacgtcaactatgtatcgataggtcaacgcagcaatattcaggacggtagcgttctccatgtgacccataagtcctcttataagccggagggaaatccgctgatcattggtgaggatgtaactgttggtcataaagtgatgctgcacggctgcactatcggcaaccgcgtactggttggtatgggttcgatcttattagatggtgtcgtcgttggcgatgacgtcatgattggtgcgggcagtctggttccgcagaataaacagctggaaagcggctacctttactttggcaatccggtcaaacagatccgccccctgacagaggcggaacgggaaggactcaagtattcagcaaataactatgtgaaatggaaaaatgagtacctggatcaggataaccagatccagccctgagcatcttcctgaccatcgcggatcaatgcttctgcctcttcctctagatcccaacgatgttcctggaaggcggccagccactgcgctggcccctctgcgccgaaacgctgctgcaagatttggcctgaaattgcgcaggttaattgcatcccattcaccagcgcgggaaaaaccacgccctgccgttcggcatcccatgattcccggtcaggaaactgaatcgcctgattcatgcattcagttcctgctgcagcgtttcaatgaccggagcgatagccggcagaacgccgtgccatagcagaacagcatgggcggcttgcgccaccagcattcccagcccatcggcacagtggactgcgccatattgctggcaccagtgaagaaacggtgtcggccctttctggtaaaacatgtcatagcaatatacgtcagcgttgacaatagatgccgggatagctggtacatcaccgtctattccactggacgtcgcattgacgatcagatcgaatgtttccccggataaggtatccatctcccttgcgctaacgctcccggtatgggcgaagagagtggctaactcacgggcacgagaataggtgcgattcacgatcgtgacggcgcatcccagcgacagaagcggcaaaagaaccccgcgagatgccccaccagcaccaaccagcaggatccgttggcgtggcttaatgaatcccaggcgttccagatcgctcagaagaccaataccgtcggtgttgtcccccagtaaacggccatcttccaggcgtttcagggtgtttactgctcccgccagcgctgcgcgttctgtcagttcgtcggcacgcgcaaaggcttcctctttaaaaggaacggtgacgttggccccctttcctccttctgcaaagaactgattcagagaagagacaaaatcgtccagcggcgccagtacacgtccataaggatgagtaattcctaactggcgggcaaacagctgatgaatagcaggcgacttgctgtgcgcgatcggattaccaaaaacggcataggtttccatggttcacccctggcggaacagttcacccgtcagggcatcacggatttcagatgggttttgccggccgcccgtggcgccatccaccaccgggaagctgtcgccaaactgagcatggacctctgcggtagtacggcacggtggttgcccggtgagattggcgctggtcgaaaccagtggttttccgtaggcttcgcacaattcgattaccagcggatggttagtcacgcgtacggccagtgaatcaaaacgtccagtcagccagcgcggcgtttcaggacgcgccgggaatacaaacgtcaccggtcccggccagcaagagaagatggcttcccgctgtgagtcacttaaccgtgaatcatcaatatagggcttcagttgctcaaagctggcggcgataaggatcaatcctttctcaacaggacgctgcttcagctccagcaggcgcataacggccgtttcgctgtcagggtcgcagccgacgccaaacacggcttcggtgggataggcgatgacatgttcatttttcaggaccgccacggcatgggcgacggcttctgagggcaggttattgttcactgatttattccgccgggatcggctttccacattgtttactggcacagaagcgtctgagcccctgcgccgtcttcttttctattaacagcgggtaatggcattcagggcattcgcccgccgccggtttaaaattgataacgaactggcaatcaggatagcgatcgcaggagtgaaaggttttaccgaaacgggaacgacgctggaccagatggccttgtccgcactgcgggcaagcgatagccgtctcatcgggtttatcaatcagctcggtatgttcacattccggatagcggctacagccaatgaacatcccaaaacgcccctggcgtaacaccataaccgcaccgcacgatgggcactcttgcccctccagcaccttaacgatatggccgtccgcctggcttttcaggggacgaatatagtcacagtccggataatgcgaacagccgagaaacgggccatgtttcccggaacggatcaccagttcggccccgcactgcgggcagggctcatttttacgcaccgaaaacagtgctgatttggtcataacaactcgatgttgctgcaaaaagattaatgcagcataccttcatttacttcgaagagtaattcttccatttgctgataggcgttttcacagcccggaatattgaacagtaccatcaggatgacccatttcaggtcttccagctcaaattccgccgtatccagcgccagtacgcgctctatcaccatttctcgcgtttcgaggttcaacacctgaatctgctcgaggaagagtaaaaacccccggcaactggcatccagacgctggcactcctcttcggtatatacccgaagagagagcgggtcggaagcgagctgcatgggttcaacgagaccttcctgataatcagccagtttctcgagccacattaacgcgttatagatgtcttcccgctcaaaacccgcatcggtaagatcccgcgtcagtttgtcctgatccacgcgcatttctgcttcgctatggatgtaagtttcaaacaaatacatgagtacgtcgaacatggcttgccctccttaatcggacatagccgccgggtacagctgcgatccagcctgctaactccagttcaagtagctgagctacggttactggcacagattggccggcacgttcagcgacaacgtcaacaggtgttacctcatctcctacgttagccaggagctccggaaatggcaatgctacagacggctgatcgacgcaaatatttatcgaatcagacgtatcagtcagccaggccagctcgttatgccagtattccacaatatcctctggcgaggtcactggcaccgcaccttgcttaattaaccagtgcgggccttccgatcccggattgcctaccgggccaggcagggcgaacacatcccttccctgctccagggcgcagcggacggtgaccagcgatccgcttcgcaacgccgcctcaatcaccagcacgcccaggcttaagccgctgataatccggttgcgcctggggaaatgtgcgggaagcggcggcgtaatgagtggaaattcagataccagcgtaccgccattgtcgatgatctgccgggcgagggttgcatggcgccgcggataaacctgactcagcccattgaccagtaccgcgatagttttaccctccgccgccagcgcgccgcggtgcgcgaccccgtcaatgcctaacgccagcccactggtgatggtaatccctttatgcgccagcgtttcgctgaacagtttcccccagcgggcgccataccaggagtgcgagcgactgccaataacggcaagctgcgcgctgtgaagcagggcgaggccgccgctgaccagcaacgcgccggggtaatcagcgatagcctttaaccgcaatggatagcgcggatcgtcaccccgtaacagatgatgatccggttgttccagccagcgccgcgtctcgtcaagctcatgctcgtcaagccggaaaaataactttgcctgcgccgcggtcatcccgatggcatgcagcgcttcacgatcaacgctggcggctgcgcataagcgctgagcgacctctaccatcctgtcgccatacaagctactgaccttcatcagccgcagccaaatctcgtcgggcgtcatccttaccccctgccataagcggtattgacaatctttgcgattggacagtgagactgtcaattgcagggggttttgtctagaatagagctaataatcttatcaactcctgaatacgactctggaactttatggcagttttgcaagtgttacatattccggacgagcgccttcgcaaagtcgccgagccggtcaaagaagtgaatgcggaaattcagcgtatcgtcgatgatatgttcgacaccatgtacgccgaggaaggcatcggtctggccgcaacccaggtcgatatccatcagcgcattatcgttattgatgtgtcggaaaatcgtgaagagcagctggtattaattaacccggaaatgctggagaaagatggcgaaaccggtattgaagaaggctgcttgtctattcctgaacagcgcgccctggtgccgcgtgcggaaaaagtgaagatccgggcactggatcgcgatggtaagccgtttgaactggaggccgatggcctgctggctatctgtatccagcatgagatggatcacctggtcggcaaactgtttattgactatctgtcaccactcaaacaacagcgcattcgtcagaaggtagagaaactggatcgtttacgttcccgtgcctgataacaaggaataccgtgtcacaatcactacgtatcattttcgccggcacccctgattttgcagcgcgtcatcttgatgcgctgctgtcgtctgaacatcaggttgttggcgtattcactcagcctgatcgccctgctggtcgcggcaaaaaattgatgccaagcccggtaaaagtactggcagaagcccataacttacctgtgtttcagccatcctccctgcgtccgcaagataaccagcggttagtcgccgatctcggcgccgatattatggtggtagtggcgtacggtctgattctgcctaaagcggtgctggagatgccccgtctgggctgtatcaacgttcacggctcgctgctaccgcgctggcgtggcgcagcgcctattcagcgttcactgtgggcgggggatagcgaaactggcgtaaccattatgcagatggacgtcggccttgatacgggggatatgctgtataagctttcctgccccattaccgcagaggataccagcggcagcctgtacgataagctggccgagctcggccctcaggggctgctggcaacgttagcccagctggccaacggcaccgcacggcctgaagtacaagatgaatcgctggtgtgccatgccgaaaagctgagtaaagaagaggctcgtatcgattggtcgctttccgctgcgcagttggaacgctgcatccgcgcgtttaatccgtggccaatgagctggctggaaattgacggacaaccggtaaaagtgtggcgggcatcggtcatcgccgaagccgctcacgccgaaccgggtactatcgtggcagcaaccaaacagggtattcaggtcgccacgggggatgggatcctcagcctggagtcgctacagcctgcgggtaaaaaagcgatgagcgcccaggacttactcaattcccgccgggagtggtttatccctggcacccgtctcgcctgacggtcgtctcttctgaagcccgggttcgccgggcatttttatttttgcgcttatgaaaaagaatataaatttacgcagcctggccgcccaggctatcgaacaagttgttgaaaaagggcagtctttaagcaacgtactgccccctctacagcagaaagtcagcgataaagataaagcgctactgcaggagttgtgctttggtgtactacgtactctaagccagctggagtggcttatcagcaagctaatggcgcgtccgatgaccggcaaacagcgcaccgtgcactttctgatcatggttggtctctatcagttactctacacccgcattcccccgcacgccgcgctggcggaaacggtagaaggcgcggtggccattaaacgcccgcagcttaaagggctgatcaacggcgtgctacgccagttccagcgccagcaggaagcgttgttagccgaatttgctgagcatgaaaaccgctatcttcatcccaaatggctgctgaaacgcctgcagcaggcctggccggagcagtggcaggagatcgtcgatgcgaacaaccagcgcccgccgatgtggctgcgcgttaaccgcaaccatcattcccgggatgagtggcttgccctgcttaacgaggccggtttagagggcttcacccaccctgattatccggacgccgtacgcctggccacccctgccccggtccacgcgttaccaggatttgatgaaggttgggtaaccgttcaggacgcctcggcccagggctgtatgcgctacctgcaaccggaaaatggcgaacgcatcctcgatctctgcgccgcgccgggcgggaagacgacgcatattctggaagtcgccccccagtctcaggtcatggcggtggatattgatgaacagcgtctgtcccgcgtctatgacaacctgaaacggctgggcatgaaagccgaagtcaagcagggcgatggccgcttccctgagcagtggtgtggcaatgagcagttcgatcgtattctgctggatgccccctgctccgcaaccggcgttattcgccgccatccggatatcaaatggctgcgccgggatcgggatatcgccgagttagcccagctgcaggccgagatcctcaatgccacctggacgcacctgaagcctggcggcacgctggtttacgcaacctgttctattctgccggaagagaacagtcagcaaattgccgccttcctcgcgcgaaccccggatgcagaacttcacgccaccggcacgccggcgagccccgggcagcaaaatctgccgggcgtggaagaaggtgatggcttcttttacgctaagctaatcaaacgtcggaactaatgggtcactgcagatgaagattattattctgggcgccggccaggtcggcggcacgctggcggaaaacctcgtcggcgagaacaatgatattacgctggttgataccaatggcgaccgtctgcgcagcctgcaggataagttcgacctgcgtgtcgtccaggggcatggctctcaccctcgcgtactgcgcgaggcgggagccgatgatgccgatatgctggtagcggtcactagttcggacgaaaccaacatggtggcctgccaggtcgcttactcattgttcaatacgccaaaccgcatagcgcgtattcgtgcgcctgattacgttcgtgatgcggaaaagctcttcaactctgaagcggtacccatcgatcacttaatcgctccggaacaactggtcatcgacaacatccaccgtctgatcgaatatcccggcgcgctgcaggtcgtgaacttcgccgaaggaaaagtcagtcttgcggtagtaaaagcctattatggtggcccgctggtggggaatgccttatccactatgcgggagcatatgccgcatatcgatacgcgcgtggccgccattttccgccacgatcgccccatccgcccgcagggttcgacgattgtcgaggccggagatgaagtcttctttattgccgcctcgcagcatattcgcgcggtcatgagcgaactgcagcgactggaaaagccgtataagcgtattatgctggtcggcgggggcaatattggcgcgggtctggcccataagctggaaaaagattacagcgttaagcttatcgaacgtaatcagcagcgagccgctgagctggcggaaaagctgcagcatactatcgtcttctacggggatgcatcggaccaggagctgttggctgaagagcatattgaccaggtggacctgtttattgccgtcactaacgacgacgaagccaatattatgtcggctatgttggccaagcgaatgggcgcgaaaaaagtgatggtgctaatccagcgcagagcctacgtggatctggtccagggtagcgtcatcgatattgcgatttcgcctcagcaggccacaatttccgcactcctcagtcatgtccgtaaagccgatattgtcggcgtctcctccttgcgccgcggcgttgcagaagcgattgaggcagtcgcgcacggcgatgagagcacctcccgggtagtcgggcgttcgatcgatgagatcaaacttccaccgggcacgatcatcggcgccgtcgtgcggggcaatgacgtgatgatcgccaataataatctacggatcgagcagggcgaccatgtgatcatgtttttgaccgataagaagtttatttccgatgtcgaaaggctgttccagccaagtcctttcttcctgtaattcccagggcgccgaacaggcgcctttttattatcccttattattcaaaggttaatattttgcagtaactatctgctgggaatggcaaatgaaaatacatttgttaaacttacaacgtcagctggcacaaggagaataaaatgagttttttaaaagagtttcgcgaattcgcgatgcgcgggaacgttgtcgatttggcagtgggtgtgatcatcggtgcagcattcggtaaaattgtttcatcactggtcgcggatattattatgccgccactcggcctgttgattggcgggatcgattttaaacagtttgccgtcacgctacgtgatgcccagggcgatgtcccggctgtggtgatgcattatggggtattcattcagaacgttttcgatttcatcatcgtcgcgtttgccatcttcatggcgattaaattgatgaataagttaaatcgtaagaaagaagaggctccggcggcaccgccagctccctctaaagaagaagttctgctgagcgaaattcgcgatctgctgaaagaacaaaacaaccgttcttaatcagcagagaaagcagaaggccagtggtaaaaaagcgattcgcttgcttgccactggcctcccgatcaattcttcctgcatgtttatctttacgttgatagcttcctttccctttcttgtttttctctacgcgctgcctgaataacggatcgtggagaagtgcctcaatggcgttatctttaatttgtcctttagtatgctgatagcgactcatagttactccggtatatgtataaactcggcgcgagtgtagatccgcgcgtttaaaaaatcaacgtccgccattgccgttgctggccccttgttcaagggcctcaaggatagaacagtaaacgctgctgtgggcagtgccgcaacaggcatcgttgagccgctgcagagagcggcgcatcgtctgtagctctttaatccgcgcctcaacttcacttaatcgcgcctgaacgatccctttcgactcctgacaggtatgatgctccggatcgatgcggatcgacaataattcgcggatcgcttccagggtgaaacccagttgtcgggcataacgaataaagcgcagccgttgaagatcgttatccgagtacagacgaaatcctccctcggtgcgtatgtcatgatccatcatctgctgcttttcatagtagcggatggtatcaggcgtcacgtcagccagttttgccaattcaccaatacgatacatatttactcctgatttattttttgcagcaacgcatcggcgtactcaccgcgtaaaaagtcggtgttcagacctgcctgacgtaacttcagctcgagcagggcaaggcgtttgctaagttcggcatgacgcggatcgtcctgacggacgccgttcaataagtctgccagagccaacgcctctttgcgttgctccagttccggagggagacatcctgcatttttcagaaggcgatagcctgcccgcaactccgccggcacatgtgaatcgtcatcgagagtcagcggttctccgctgccgggtaaattatcgaactcacctttggtttgggcatcgaggatatgacgttccgcccactgatccagcaaccacattctacggctccaggggatgaacaaaaagagtacagatagtgtagtgaaatggggatggggtagatataaaaaaacccgcctgggcgggtttttttacgttactacagattactctgcagcagcttctgctttcggctcagcacgatcaaccagctcgatgtatgccatcggcgcgttgtcgcctgcacggaagccacacttcagaatgcgagtgtaaccaccggcgcggctcgcgaaacgcgggcccagctcgttaaacagttttgccacgatctcgttatcacgagtgcgggcgaatgccagacgacgattagcaacgctatcagtcttggcaagagtaatcagcggctcaactacgcgacgcagttctttcgctttcggcagggtcgtcttgatgatttcatgacgaaccagcgaacctgccatgttacggaacatagcctggcgatggctgctgttgcggttcagttgacgaccactcttacgatggcgcatgaccttatccttctcagtaaaaccttaacctgtgatccggttactcgtcagcaatgcttgctggtggccagttttccaggcgcatgcccagagacagtccacgggaagccagcacgtctttaatctcagtaagagattttttacccaggttcggcgttttcagcaactcaacctcggtacgctgtaccagatcaccgatatagtggatagcttctgccttgaggcagttagcagagcggacagtcaattccagatcgtcaacagggcgcagcaggatcggatcgaattctggtttctcttctttcacttctggctgacgtacatcacgtaggtcaacaaaagcttccagttgttcagccaggatggttgccgcacgacgaatcgcctcttcaggatcgattgtgccgttggtttccatttcgatgaccagcttgtccaggtcggtacgctgttctacacgcgcagcttcaacattgtaggcaatacgctctacagggctgtagcaggcgtcgaccagcagacggccgattgggcgctcatcttcttccgaatgaattcgggcagaagccggcacataaccgcgaccgcgctgaactttgatacgcatgctaatagcagcgttctcatcagtcaggtggcaaatcacgtgctgcggcttgacgatttcgacatcaccgtcgtgggtaatgtcggctgcggtcacagggccaatgccagatttattcaaagtaaggatgacttcatctttaccctgaactctcaccgccagccctttcaggttgagcaggatttcaaggatgtcttcctgaacgccttctttggtgctgtactcgtgcagtacaccatcaatctcaacctcggtcaccgcgcaacccggcatcgatgagagcagaatacggcgcagtgcgttacccagagtatggccgaagccacgctctaaaggctcaagggtcaccttggcgtgcgtcgaactcacttgctcgatatcgaccaggcgcggttttagaaactctgtcacagaaccctgcattgtgtcctctctttggtactaagctttacttggagtaaagctcgacgatcaggtgttcgttaatgtccgcagacagatcagaacgctccggctgacgcttgaacgtaccttccatcttgccagcatcaacttccagccaggttggcttttcacgctgctcagccagctccagagcggctttcacgcgagattgctttttcgctttctcacgaatgctgacaacgtcattcgctttaacctgataagaagcgatgttaacaacacgaccgtttaccataatcgctttgtggctaaccagctggcgtgcttcagcacgagtggcgccgaagcccatacggtatacaacgttgtccagacgaccttccagcagagccaacaggttttcaccggtgttgcctttcagacgtgctgcttctttatagtagttacggaactgacgctccagcacaccgtacatacggcgaactttttgcttttcacgcaactgcacaccatagtcagacagacgcggcttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaactaacctggaaaacgcagcgttatacgcgacgttttttcggcggacgacaaccgttatgagggatcggagtcacatcagtaatattagtgatgcggaaaccagcggcgttcagtgcacgaatggtagattcgcgacccggacccggacctttgaccataacttccagattcttgatgccgtattcttttacggcttctgcgcaacgctctgctgcaacctgagctgcgaacggagtggatttgcgagaaccacggaaaccggaaccaccggctgttgcccaacccagtgcgttaccctgacgatcagtgatggtaacgatggtgttgttaaaagaagcatggatatgagccacgccgtcagagacttgttttcttacacgcttacgtgcacgaattggtgcctttgccattattcaatcaccccgattatttcttgatcggtttacgcggacccttacgggtacgtgcgttggtcttggtacgctgaccgcgaaccgggagaccacgacgatgacgcaaaccacggtagcaaccaaggtccatcagacgcttgatgctcagggtgatttcacggcgcagatcaccttcaacgacaaatttacctactgcttcacgcagaatatcaatttgttcttcagacagctcactgatcttaacattttcagcgatgcccgtttcagcgcagatggctttagaacgggttttgccgataccgaaaatagcggttaaagcgataacggtatgtttgtgatcaggaatgttaatgcctgctatacgggccactatgcactcctactatttaatatgtacgcaccatgctgaaaagcccgttttcaggatactcaaatggaaacgtacagacatacaaaagattggctggctaatctagccagctcaatccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccagttttaacggccgtagcctttcaggttcgccttcttcaatgcagactcatactgactggacatcatcagagtttgcacttgagccataaagtccataatcacgacaacaacgataagcagcgaggtcccaccgaagtagaacggcactttcatcgcgtcacgcatgaactccgggatcaggcagataaaagtaatgtacaacgcaccaaccagagtcaggcgagtcatcactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccacccccgaaccatgacgtgatggttgccgggaacagtataatactggaagcgaagattgccgggattacccccgccatattcactttcagcggtaaatgtgtgctctgtgcagcatagacacgacgaccctgttgacgtttcgcgtagtttaccacaatgcggcgttgaccacgctcaacgaatacaacaaagaaggtcactgcaaatactaatactgcaaccaacagcaacaggaggaagtgcaggtcgccttgacgcgcttgctcgatagtatgggcgatggccggcgggagtcccgcaacgataccggcgaagataatgatcgagataccgttaccgataccacgttcagtgatctgttcgccgagccacatcaggaacatagtccctgtgaccagactgacaacagcggtgaaatagaatgcaaagcctggattaatcaccaggccttgcataccaggcatattcggcagaccggtagcaataccgatcgactggaatatcgccagcaccagagtaccgtagcgggtgtactggctgatcttacgacgaccagactccccttctttcttcagttccgccagcggttgataaaccaccgtcagcagctgcacgatgatcgatgccgaaatgtacggcataatccccagcgcaaagatagaagcacggctgagagcaccaccagagaacatgttgaacatttcaatgatggtgcctcgctgttgctcaagcagtttggcaagtacagcggcatcaataccagggatcggaataaaagagccaatacggaacactatcagcgcaccgaccacaaacagaagtctgcgtttcagttcgccaaggccacctttggcactttgaaaatctaatcccggttgtttagccatctgctacttattcctcaattttaccgccagcagcttcgatagcagcacgagcacctttagtcacacgcaggccacgaacagttaccggacgagttacctcaccagacaggatcactttcgcgaactcgatctggacaccgataatgttagccgctttcagcgcgttcaggtctactacatcgccttctacgtgagccagatcggagagacggatctctgcggtgatcatcgctttacgagaagtgaagccgaatttcggcagacgacggtacagaggcatctgaccaccctcgaaaccgcgacgtacgccaccgccagaacgagatttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgaccataccacgaacagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatatccggggacttcatgttttccagaccgtcgatagttgcacgaaccacgttaattgggttagtggaaccatacgctttagccagaacgttacgaaccccagcgacttccagaacggcgcgcattgcaccaccggcgatgataccggtaccttcggaagccggctgcatgaatacacgagaacccgtgtgagtacccttaaccgggtgctgcagggtgccgtggttcagcgcgacgttaatcatattgcgacgggctttttccatcgctttctggatcgctgctggaacttcacgcgctttaccgtaaccaaaaccaacgcgaccgttaccatcgcctactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggaaacatctttgatgcctttttccagagcgcgttcagcgacagctttacccacagctgctgcagcgtctttgttaccggtgtacttcagttgttcagcgatagctttttctacagtagaagcagctaccagaacttcagaaccattcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttgtaaggctcaggacgacggtaggcgcgcagatctgctgcaacctggccgatcacctgcttatcagcgcctttcagcacgatttcagtctgagtcggacattctgcagtgatacccgcaggcagctgatgatcaaccgggtgagagaaacctaaagccaggtttactacattccctttgaccgctgcacgataacctacaccaaccagctgcagcttcttagtgaagccttcggtaacaccgataaccattgagttcagcagggcacgcgcggtaccagcctgagcccaaccgtctgcgtaaccatcacgcggaccgaaggtcagtgcattatctgcatgtttaacttcaacagcatcgttgagagtacgagtcagctcgccgtttttacctttgatcgtaataacctgaccgttgatttttacatcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagaccggccataactttcggcagctcatcttttttcttatagatgcgcagacctgggcggctgacacgctgaatgctttctacaacagctttgccctggaaatacttgagagtaagttccagttcaggcttggtgtcgccttcaactttaaaatcttcgataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacggcattccaacgatcttcgtcggttgcgttcacatcagagatgatagctttcagttcagcgcgtttagcgaagaatttatcagctaaagccacgcgctttacttcgcgtgctttcattgattgcttagccattaagtaaccctaccttacttgcggaacgggaagtcaaaggcagccagcagagcacggccttcttcgtcagatttcgcagtagtggtaatggtaatatccaaaccacgaacgcggtcgactttatcgtagtcgatttctgggaagatgatctgctcacggacacccatgctgtagttgccacgaccgtcgaaagacttagcggacaggccgcggaagtcacgaatacgcggtacagcaatagtgatcaggcgctcaaagaactcccacatgcgttcgccacgcagagttactttacagccgatcggatagccctgacggattttgaagcctgcaactgatttgcgtgctttggtgatcagcggtttttgaccggagattgctgccaggtcagctgctgcgttatccagcagtttcttgtcagcgatcgcttcaccaacacccatgttcagggtgatcttctcgacccgagggacttgcatgacagaattgtagttaaactcagtcatgagtttcttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgccgcattgaagattgcaacgttagaaacctgaattgcagcttctttttcaacgatgccgcctggttggttcagagccggaaccggcttctggtgtttcttaaccaggttgataccttcaacaatgaccttgccggaagacaggacattcttaactttaccgcgcttacctttatctttaccggttaacacgataacttcgtcatcacgacggattttcgctgccatgattcgctccttagagtacttctggtgccagagagataattttcatgaacttctcggtacgaagttcacgagttaccggcccaaaaatacgcgtaccgataggctgctcgctgttattgttcagaataacgcatgcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaattagggtcgttaaaaagccccatatcgagggcgcggcattataacaccacaaaccagatatgggtagaaaaaataaacggctcatcgctgagccgtttatccgtatcgagaatgcgtactctattacagaaccgctttctctacaacgcgaaccagcgtccaggacttagtcttggacagcggacggcattcgcggatttcaaccttgtcgccgataccgcattcgttgttctcgtcatgtacgtgcagtttggtcgtacgtttgatgaatttaccgtaaaccgggtgtttcaccatacgttcgatagcaacaacaatggatttctccattttgtcgctaactacgcgaccttgcagagtacggattttatcggtcattacgcacccgccttctgagtcagtaaagtcttaacgcgtgcaacatcacgacgcacttgcttcagcagatgagtctgttgcagctggccacttgcagcctgcatgcgcaggttgaactgctcacgcagcaggttcagcagctcagcgttcagctcttcaacgcttttttcacgcagctcttttgctttcattacatcaccgtcttagttacaaaggtggttttgatcggcagtttcgctgctgccaggccgaatgcttcacgggccagctcttccggtacaccgtccatttcatacaggactttacccggctgaatcaaggcaacccagtactccacgttacctttacctttacccatacgaacttccagcggcttctcggtgatcggtttgtccgggaatacacggatccagatcttaccttgacgcttaactgcacgggtcatagcacgacgtgctgcttcgatctgacgtgcagtcagacgaccacggccaacagctttcagaccgaaagtgccgaagctaacatccgtaccctgcgccagaccacggttgcggcctttgtgcactttacggaattttgtacgctttggttgtaacatcagcgacgctccttatttacggcctttacgctgctgctttttaggttgagcagccggttccggttgttcaacagcagccataccacccaggatctcacctttgaagatccataccttaacgccgattacaccgtaagtggtgtgcgcttcagaggtgttgtagtcgatgtcagcacgcagagtgtgcagcggtacgcgaccttcacggtaccattcggtacgtgcgatttccgcgccgcccagacggccgctaacttcaactttgatacctttagcgcccagacgcattgcgttctgtacagcacgcttcatcgcacgacggaacataacgcgacgttccagctgagaagtgatgctgtcagcaaccagttttgcgtccagttcaggtttacgaacttcggcgatattgatctgtgcaggtacgccagcgatatccgctacgaccttgcgcagtttttctacgtcttcgcctttcttaccgataacgatacccgggcgagcggtgtgaatggtcacacggatgctcttagccggacgctcgataacgatgcgagatacagacgctttagccagttctttagtcaggaactgacgtactttaaaatcgctgtccaggttgtcagcgaattctttggtgttcgcgaaccaggtagagttccatggtttgacaatacccaggcgaataccattaggatgtactttctgacccattgctagtctccagagtctcagcgatcggacacaaccacagtgatgtggctggtgcgcttcaggatgcgatctgcacgacctttagcacgcggcataatgcgcttcatgctcgggccttcgtctacgaaaattttcgcaactttcagatcatcaatgtcagcgccatcgttgtgttcagcgttagcaatggcagattccagtaccttcttgaccagtacagcagcttttttgttggtgtaggtcagaatatccagggcctgcgacactttcttaccgcgaatcaggtcagctacaaggcgaaccttctgagcagaagaacgagcatggcgatgttgagctaaagtttccatctcttcctcctaccttatttcttcttcgcttttttatcagcagcgtggccgcgataagtacgagtcggtgcgaattcacccagtttgtgaccgaccatttcgtcggaaacaaatactggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgcaggccccacggggataccgggtgcttaccaaagttacgaccttcaccaccaccatgtgggtggtctactgggttcatcgcagtaccgcgaacggtaggacgaacaccacgccagcgtgcagcacctgctttacccagaacgcgcagcatatgctcagcattgccaacttcgcccagagtcgcgcggcagtctgcttcgactttacgcatttcaccagaacgcagacgcagggtgacataagcaccgtcacgagcaacgatctgaacgtaagtaccagcggaacgagccagctgaccgcctttacctggtttcatttctacgttatgaacggtagaaccaaccgggatattgcgcatcggcagggtgttgcctgctttgattgcagcatcaacgccagactgaatctggtcgccagctttcaggcctttcggggccaggatgtaacggcgctcgccgtctttgtacagaaccagcgcgatgttcgcggagcggttcggatcgtactcaagacgttcaacaactgccgggataccatctttgttgcgtttgaagtcaacaatacggtaagcctgcttgtggccaccaccgatatgacgggtggtgatacggccattgttgttacgaccaccggatttgctgtttttttccagcaacggagcaaaaggtttgcccttgtgcagctctgggttaaccactttaacgacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaacaaccagggtgttaacgacttcgacttcgacttcaaacagtttctgcacagcagctttgatttctgctttggtcgcgtctttagcaactttgagaacgatggtgtttgttttttccatcgcagtagacgctttttcagaaacgtgcggtgcgcgcagcaccttcagcagacgttcttcacgaatcatgccagcatctcctcaacttgcttaacagcatcagcagtcattacgactttgtcgaaggcgatcaggctaaccgggtcgataccgttcgcatcacgtacgtcaaccttatgcaggttacgtgcggccaggaacaggttctcgtccagctcaccggtgatgatcagcacatcttccagagccatgtctttcagtttctgtgccagcagcttagttttcggcgcttcaacagagaacttctcgacaacgatcagacgatcctgacgtaccagttcggacagaatgcttttcagcgcgccgcggtacatcttcttgttaactttttgactgtggtcctgcggacgagcagcgaaggtcacgccaccggaacgccagatcgggctcttgatagaaccagaacgcgcacggccggtacctttctggcgccacggttttttaccggagccagtgatttcagcacgagtcttctgagcacgagtgccctgacgcgcaccggctgcataagcaacaacaacctggtgaaccagcgcttcgttgaaatcacgaccgaaggtagtttcggaaacagtcagcgcgctctgcgcgtctttcaatactaattccattgctatctcctcacgccttcacagctggtttaacgatcaggtcgctaccggtcgcacccgggacagcacctttaaccagcagcaggttgcgctcagcgtcaacacgtactacgtccaggctctgaacggttacacgctcattacccagctgacctgccattttcttgcctttgaacactttgcccggagtctggttctgaccgatagaacccggaacgcggtgggacaaggagttaccgtgagtagcgtcctgggtacggaagttccagcgcttaacggtaccagcaaaacctttacctttagaggtaccggttacgtcaacttttttaacgtcagcaaacagttcaacgctaatgttctgacctacggtgaattcttcgccgtcagccagacggaattcccacagaccacggccagcttcaacgccagctttagcgaagtgacccgcttccggcttggttacacggttagcttttttagcaccggtggtaacctggattgcgcggtagccatcgttagccaggtctttaacctgagtaacacggtttgcttcaacttcgattacggttactgggatagaaacgccatcttcagtgaagatgcgggtcatgcccacttttttaccgactaaaccaatcattgtttcaacctctcaatcgctcgatgacctgattaacccaggctgatctgcacgtctacaccggcagccagatccagacgcatcagagcatcaacggttttttcagttggctcaacgatgtcaaccagacgcttgtgagtgcgaatttcgtactggtcacgcgcgtctttgttgacgtgcggggagatcagaacggtaaagcgctctttgcgggtcggcagcgggatcggaccacggacttgcgcaccagtgcgcttagcagtctcgacgatttccgcggttgattgatcgatcagacgatgatcaaacgctttcaggcggatacggattctttggttctgcatgagaccagagctccaattattttatagacgaaatgattactcctcatacccattacgattgatgggagagtgtaaccgttcttacatagtcccccgattggggacattgtttgataacccaaatgcgattaccagggttcatattgaaccggccgtcaactttgacaggcccgcgcattatacgcaaattctggcgcgacgcaagtgctgtttagaaaatcatcaccaggatttgcgcgccttcgcattagcgcactgtacggggctgcaatgcggagtaagagggcggattgtgggctccattcccggaaaatgccttttgtgctgaacgggagaggatgagcatagtgacgcaatgttcatcgatcattgcggggtcaactatgctcgccgccctccccttcttgctgtgctatagcggtttgaccgtggcattatgccaccaggatctgcgccacggtctgttgcccgaccgttacacctgtcccctgctgtggagtggtttacttttttatctctgtctggcgccgcaccagctgcatgatgccgtctggggggcgatagcgggctatctctctttggctgcgatttactggctataccgcggtatccgcggctatgaagggttgggttatggagatataaaatatcttgccgccctcggcgcctggcatggctggcgattgctgccgcagttagtcctggttgcctcgctactcgccggcatagcgtgggcaggagcaggtttatacgccagttgcggcaggaagagcaaatggggaagaagcaacccgctgccgtttgggccattcctggcggccgcgggtttttggtgcgggtggcagacgctggctagtctgacactttgatctgcgactgcaggtaattttgcagaccgattttgccaatcaaatcgagttcggtttccagccagtcgatatggccttcttcatccgccaggatctcaatcatcatatcgcggctgacgtagtcatggacgctgtcggcataggcaatagcctcacgcaaattttgcgccccttccagctccagcctcaaatcggaccgcagcatctcttccacatcttcaccgatgccaagtttgccgagatcctgcagattagggataccttcgagaaaaagaatacgctcgatatacttatcggcgtgcttcatttcgtcgatggattcgtggtactcaatatcgttgaggcgcatcaggccccaatttttaaacattctcgcatgaagaaagtactgattaattgcgactagctcatttcccaataatttattgagataacttatgattttgacatcacctttcattatatagtccctccgcttccactcattgaagcgtagtccggcctatagggatgtcaaaagagaagcgtggacttcaggcgatttctttgaattccggcatggtggttaattcatcttccatcacttcacgcgcggcacgaacacacttaccgcattgatttcccacgggaacaaacttacgtaattgctgaaaagattgcggttgaaactggcgcacaacctgacgaatttttttatcgctgacgccattgcacaaacaaacgtacatagaaactcccgttcaatttatgcacaaatattaaatgagaatggttatgattacaatagaccatttgctcattatccgccgcaacgcacgatatgaatagccagcaaaaatccgtttttcgctgaatgacagacagcaaaaagggcgccgaaacgccctttttaattcaaagctaacgaattagcccagaactttagctacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtgccag

SEQ ID NO: 87 - DNA, 20912 bp, Unknown
  source: /note="Description of Unknown: KP2-Mcoc1 Bacteria Sequence"
aggccgggccgatcgacgtcgaggtgtacgccaactacggctttgactcaaaggcggtggacagcgacgcgcgtctcgaagcctggcagggcgggctggtgctgagccacaccaacgacagcggggtaaacaaggtgatcctgcgctactccgacaactcggataacagcgtctacaacaaaaccgacgccctgaccacggtctacgccagcttcgagggcagccataagttcacccagcaggcgcagatcgagtatctgctggccttccatgactacgacaacggcaaggacaacaccgacaaccgtaaaaactacggtgccatcgtgcggccgatgtatttctggaacgacgtgcactccacctggctggaagcgggctaccagcgcgtggactacgaccagggcggggataaccacggctggaagctgacgctgtcgcagaacatcgccatcggcatggggccggagttccgtccgatgctgcgcttctacgtgaccggcggccaggtggataacgagcacaccgcgaaggtaaacggcacccaggaccagcagctggattcgctgaacgtcggcgggatgtttgaggcgtggttctgatgcgatagcgttgtcgaaggagcgttcccggctggcgctacgcttagccgggctacgactggcgcgctccatttatgccggatggcggcatacatgccttatccggcctacagaaaacctcccccccccaggaccggcaagcgcagcgccgccgggcagctggttcaggccaactccctcagttcaccgtcaggcgcagggccagatcctgcgggtaggggtcaaaatagttctgcgcctgcaggtagcgatccggatactcggccagatagtgcttaagcagcgtcagcggggcgaggatcggcagcagcccggcgcgatagttgaggatcacctcccgcagctcgccgcgctggcggctgttcagctggtcgcggaaataaccctgaatatgcatcagcacgttggtgtggtttttccgcgaggcgggctgcttgaggatcgccatcagcttctcgcggtaaacctcgaagaacgcctccagatcctcccattcatgcagcgaggcgacgaacgggccgatctcccggtagcccgcctggtgatgagccagcagctgcagcttgtagcggctgtgaaaggccagcaggctgtggcgggtcaggccgcgggcgcgcagggcgttgagttcatgcagggcgaaaacgcgctcgacaaaattctcccgcagcagcggatcgtgcagccggccatcctcttccaccggcagccacgggtagcgcgccatcagggcgccggtaaacagccccacgccttccttacgcccgcgattgcctttttcgtcatacagccgcacgcgctccatcccgcagctcggcgatttggcgcagacgataaagcccgacagctcacccagggttgcgaggtgggcgctggcgaaatcagccatcttctccgtcacatcctcgtgcggggcgtggctgaagcgcatgcggatctccccgaccggggtctgcaccaggcggagcgccgggcggggaacgggcaggccgatcgccatctccgggcagacgggtttaaacgccacccactgcgcgagctcatccatcacaaagcccatacgcttatgcccgccgtcgaatcgcacggctgagccggttaaacatccgctgatcccaatgacaggttgcgtgttcatggcgctgtcctctcttctgctgtggttcgggtaaagaaaagggtcacggtggcgaccgtaatgccgaatttcttcatctcggttttgttaaataaatggctgccgtcctgcaggaacatccagtcgtcaaagtgcagcagccaccggctgccgctggcctcgacgctcatgctgtagcgccagtgaaaggcattgcctgccgcctggccgctggccacgccttcgatatccccggcggtgccctgataacggttatcgccggtgcggcgaatgcgccatatccgctgctgcttctcgccgtcgtcatagacaaagcgctcatggagggtcagggtgtcgccgacgacgtcgccatcgatctcaacatggaagcggcgcagctgcttgccgctacgatcctgcaccatcccccacgcctcggttcggccctgaaaatagtgaaagatgtcgagggcgggctgctgctgccggtattcggtgacctcggtgctgcagccggcgaggatctgcatcagcagcgccaggccaagggtcagaatgcgtttcatggtgtacctccgatcaactgctgacgcagttcgggataagtggtgcgcggatcgagccagatggcgagaaagcgggtgctgaacgccgccgactggcgcgggccgagcggggtaaaggcggtctgcgcggcgctggcgcggtaccagaactgcccctcgccgccgctgaccacgaacgccagctggctgcccggcgcgacgtccggccagatcccctgcagcatgcgtagccaggcttcgctgcgcggttcctgctgcagaatgccctgcgcctgccactggtcgcgggtggcctccaccagcgcctcgcgatcgatgtcgcgccggtaggtgatgatcagcgcccgatcctgctgcgggccgtcataccggccattgggcgtgcgcagctgcgagtgatagatggtgaacggcccccaggtgagggtcgcctcgccgacgcggcgccacgtcagccagtcggcggcgtgggccgccggggcgaggatggtcagccacagcagtaacagggcgaatctcatttttgcctccccatccccagatggaataacagcatgagcaccagccagccgcaggccatggcggccacgccaagcgccatcggcaccagcagggtcatggctccgaggcgagcgccgatcaggtaggccaccgggccgccgacggtggcggccgtggccagcacccagccgggaagcgtcgcggtgcgggtcagtcgggtccagacgacggcgaacatcagccacagggccaccatccacaggggcagcaggctgtcgccgcgaaaatcgatcagtcccgccagcgcccagcaggcgtccagaccgcagcccgccgcggccaacagcagggcgggcggacgactggccgccggcaaccgcagccaggcgaaaatggccagcgtcagccagatcagcagaccgcgctcgcgcaacatcaccaccagcgtccagtaaacatcgaacgcgagggccatcagcagatgctgcgccgggcgtgtcatacccgctccgcggtgagctgcaccacgctgatggtgcgggcgttaaatccggcttcacagtagccgaagtagtagagccacatccggcggaagcgctcatcaaagccgagcttttcaatatcctgccaggcgtgggtaaagcgctgtcgccagtgcgccagggtgcgggcatagtccgggcccatgtcgaacaggttgcgtatcacaaaatcggtatggcgggtcatcagctcgctcattgccgtgatgctgggcaaaaagccgccggggaagatgtagcgctggataaaatcgacgcttttgctgtagtcgcgatagcgctgatcctggatggtgatcgcctgcagggccattctgccgcccgggcgcaggcgcgcctggcaggtgcggaagaaggccggcaggtagcgctggcccaccgcctcaatcatctccaccgacaccagtttgtcgtactcgccgcgcagatcgcggtagtcgcagagcagcacctcgacgcgatcctgcagcccggcgcgggccatgcgctcggtagcccagcggtgctgctcccgggaaagggtggtggtggtgacccggcagccgtaatggcgggcggcgtactcggccagcgccccccagccggtgccaatctccagcagatgatcgccgggagtgagcgccagctggtcgcacaggcgcgccatcttggcccgctgggcctgggtcagatcctgctggtcgtcggtaaacagcgcgctggagtagagcaggtcgtcatccagaaaatgggcataaaattcgttgccgaggtcgtaatgggcggcgatgttctcccgcgcctgggcgcgggtgttgcggcgggtccagtggcgcaggcgggcgacgggcttgcccagcagacggaagccgcgctccagacgccccagcacctcgccgttgcgcgcaaggatctgcagcagcgccgtcagctggtggctctcccagtcgccgtccatccaggcctcggccgccgccaggctgccgccggtcagcagacgccagtacacctccggcgtgcagacccgcacctcggcgcgcagcgcggcggcggggtcgccaaaatgaaaagtctgcgccccttcgcgcatggtgagcgagccttcgcggaggccgctcaacagacgaaaaagcagccagcgcgcgagccgcacgttgcgcggcacatcgggttcaagcgcaaagacgggatcggtcatgagcgttcactcctgctgacaggatggttgtacagcggcacgcgcttcagccacagccgcagcgcctgccagtagatggcgaggacggttttcagggtcatcagcggcagacgcagcagcagcccgcgcaggttggcgcgggtcaacggcacgcggctcagggccagggtggcgtcgaacaccttgctggcctgatggttttcaatatgcatgtgcagcgttttgccgggcgcgttgaagcgccagtgatagaccatgtccatcgggttaaagggcgaaacgtgaaaggctttctccagcgggcgcgcctgctggccgtccaccgcgtagtaatgacgctcattccacggcgtgttgcgcacttcggccagcacccagcgcagggtgtcggcttcgtcatagcagtagtaaaagttgaccggattaaaatggaagccgaagtagcgcagctgggtcaggagcatcacgcggcccgccgggcggcagccggtcaggctctccagccggttcagcgcctgggccttcagcggcgcgcccagcggataatcggcatcgtaccaggcggcggcggccaggcggttgcggcggatgcccgcctcaggcagcctgtccagttcgtcgaggtcgagccaggccataaacaggcggtagacgaagtggtgcgccttcggctgcaggcgacggtggcgcaggacgccctgatagaggcagctgttcatttcagttgccctccgccgcggcgatgccctgcaccacgtcgagcgcgctgcgcaccccatcctcatgaaagccgttgtaccagtaggcgccgcagtaccagctccgctgctggccgttaatctcttcgcgccgcaactgggccgaccagctttgcgggttaaacagcggatgctcatagacgaagcgctgccagacgtagcgatcgtccaccggcgcgtccgggttcagggtaacgcagaacaggggggcgcccgcgggcagcccctggagaatattcatgttgtaggtgacgcaggcccgggcccgatccccgtcgctcaggcgatagttccagctggcccaggcgcgctggcgctccggcagccagcgcggatcgctgtgcagcaccacctcgttacgctgccagccgatgtccccaaggacttctcgttctgaatcggtgggcgccgccagcatcgccagggcctgcgcggagtggcaggcgaagatcacctggtcaaaatgcgcctccccggacgccagccgcagggtgacccccgccgggtggcggtccacctgctgcaccggcgcgttgagccgcaggtccagacgatcgccgagcctggcgagcagggcgcgaacgtattcccgggaaccgccgggcaccacgtaccattgcgggcgatcgcgaatatccagcagaccgtggttttcaaagaagcgcaaaaacagcggcagcgggaagcggcgcatctcctgcagcgacgacgaccagatggccgcccccatcggcagaatatagtggcgggcgaagaaggggctgaagcggtggcgggcgaggaagctctccagcgtcgcgcctggatccagcgcctcggtcagcgccagtttcgccagccggttgaagcggacgatctcgctcagcagtccccagaaggccggcttcagcagattgcgccgctgggcgaagagcgaggtcaggctgtggccgttgtactccaggccgctggccgggttgtggaccgagaagctcatctgcgttttttgcccgccgatccccagctcgctgagcaggcccataaagcgcggataggtgcgatcgttgtagacgataaatccggtatcgatggcccaggtgccctgcggcgtggcgacatccacggtggcggtgtggccgcccggcgtggcgcccgcttcgaacagcgttacctgatggtgtccggccagtcgccaggcgcaggtcagcccggcgatgccgctgccgatgatggctatgttcatgagcgcaccatcctgcgcaacagcaggcgctggatacccgatggcaggctggccagcagccgcagggccaggctgaagccggtggggaaggcgatgtggtttttgcccttcgccagaccgtggcggatcgccgccaccgcccgatctacgctcacccgaccgggcatggcgaagtcgtttttgcgcgtcagcggggtgtcgacgaagcccggaaagaccaccgtgacggcgacccctttcgactcccagtccagacgcaggctgttagcaaaccagctcagcgccgccttggaggcgccataggcttccgcgcgcgggaagggcagccagtgcgccatggagctgaccagcaccacccgatcgcctgcctccagctgcgtctgcagcgccgccaggcagttcaccggcccgaggaagttggtggccatcacccgctccacgagggcggcatccacctgtccgtggtcgaggtattcgcaggtcccggcgcagagaatgatcaggtcggcaaaacagcctgtcagcgcctggcgacaggcgtccctgtctgtcatatcgaacaggcgtacgctgatgttggggctgaactgctggagcgctgccaggcgcgacgcatcgcgcccgcaggcgatgaccagatggccatccgccgcgaaggatttcgccaggccggcgccgatcccggagctggcgccggtgatgagcaccgtcatcatgagcgcaccctccgcttcacgccgcgtaccgcccagcccagcaggggaagatgctcgtagatcatctccccggcgtcgtagtagtcgcgctgatggagaacctgctccccggcgatgtccaccaccgagcagcccggcagggccagggtttctccaccggcaatgcgcggatgcgaccagtgcatggtccaggtcacggcgaaccgctggccgtcgcaaagcggcgtgtcgatggtgaaccggcactgctccacgttggccagcagatgggtaaagtagcgctgaatggcgaacagcccctgatgctgaccaaaaggatcgctcagcgtcgcgtccggatggtacagcgcggccagcgccgcgggcggctgtgcatccagcccggcgtagtactcaacgaaacgacgaatcacggacggcgaggtgctcatggatcacatcctggctagatacggtagcgtaatggcatacttaaaacttacacaaataaaattatttgtccaagtttgtagaaaaatatattttatttgtgttaaaaatcatgttgttatgattggtgttttaaggagtgaaaatcacgggtggtgcaaagggcaagcgtgagcccgccgcgccaccgggcgctggcggaacagagcgtggaggtaagtgaaaacagggggttagagcgggatcacctcgagggagacgacctgctgctgccagagttcgacctgcctctggcgggcggcggaaagtttgccgctggtgaccagcagccagttgcgctgggggaaaatctccggcgccagggcggcgggtggcaccggcaggacgtcgatgcgatggccctggccggtacgtttgagcgcctcaagccagatttcgcaggcgtcggtcaggtgccagccggtgatcagaaagttgtccccgggcgccttcttgtcgccttcgaggcaaaacgaggtataggcgatgatgatgccgtcgagaatttcgcgcagcgtcatgatggccggcacgttggcggagacctggctgcgcagcggacgcagcacctcggttaccagctcctggcgcggatattcgcgcccggcgtcgtagatcagctggcgcagagactcgatttttccctctttcagtcgctgcagcatggtctcctgcagcgtcagccagttattggtgcgccgcgcgccggggcgcgacagcaggggtttcacctggctgaccggcaccccttttttcacccagtcgaggatcttcagcgcctgctggacgtcgtcatcgctgtacagacggtgtccaccatcggtgcgcagcggcttaagcaggccgtagcggcgctgccaggcgcgaagcgtggtcgcatttatcccgcatagtcgggcaaattcgccgatggagtaaggcatggggaccacctgttaacaaagaatattctcaatatactacgaatcacgacggctggcgtgaagtgtagtggctttgcactacactttccccaaccgcgtaaatgaaaggagttctcatgaagctatggcctgttgtcaccggcgtcgctatcgcgttaaccctggtggcctgcaaatcgcccacgccgccgaagggcgttcagccgattagcgggtttgacgccagccggtaccttggaaaatggtatgaggtcgcccgcctggagaatcgcttcgagcgaggcctggagcaggtgaccgccacctacggcgcccgcagcgacggagggatcagcgtcgtcaaccgcggttatgacccggtcaaaaaacgctggaatgagagcgacggaaaagcctacttcaccggcgcccccaccaccgcggcgctgaaggtgtcgttcttcgggccattctacggcggctataacgtgatccgcctggacgacgactaccagtacgcgctggtcagcggccccaaccgtgactatctgtggatcctgtcgcgcacccccaccattccggcggcggtgaagcaggattacctgaataccgcgcgcgagctgggctttgacgtcgatcgcctggtgtggatccgccagacgccgcgctagcctcgccgcttagcggctgagcagatgggtataaaccacgtacagcccggccagcgccgccacgttgagcgctacgctgatgaaaaaccgcgtccggaagggctgcttttgcgttttatggcgaaagcactgctggccgaggatggcccccggccagcctcccgccaggcccagcaccagcagcgtggtttccggcacccggcgccaggctttgcgcgccgccagcttgtcggcgccatagataagccatgtcagtaggctgctcagtaaaaaccacatcgccagcgggtagggcagcagggcgctgcccacggcggtgagcagcagcagggaataacataccaggttcagattcatagggacgttcacgccggccagaagaatggcgccactatagccaatttcccggaccggcgtaaacgcggcgggctattggctacgcttgccccgatgccgggacagccacatcagcttatacgccgccggaatgataaacagcgacagcagcggggcggtgatcatcccgccaatcatcggcgcggcgatacggctcatgacttccgaaccggcgccggtgccccataaaatcggcagcaggccggcgataatcaccgccacggtcatcgccttcggccgcacgcgcagcaccgccccctggtacagcgcctcgtcgagcttatcgacgctgagagtctgcggattctccagcgatggctccgcctcgatggcgtggcgcaggtacatcagcatcaccacgccaaattctgccgccaccccggcgagggcgataaagccggtcccggtggccaccgacagatggaaccccatccagtagaggaaccagatcccgcccacaagggcgaacggcacgctggtgataatcagcagtgcttcgccgacgcggcggaacgccagatacagcagcacgaagataatcattagcgtcatcggcaccatcagcttcagcttctgattggcgcgctccagcagctcaaactgcccggagtaggacacactgatgcccggcttcagcttcacctccttgccgatggcctgctgcagatcgtgcactaccgacaccatgtcgcggtcgcgggcgtcgatgtagatccaactggtcgggcgggcgttctcggtcttcagcatggatggtcccgtgaccactttcacctcagccacgtcgccgaggacgatctgttgcttcagcggcgtgaggatcggcagctggcgcagggtctccgggctgtcgcgatagctctgcgggtagcggatgttgatcggatagcgctcgacgccctctaccgtttcgccaaccatcgccccgccgatggcggacgatacaaacagctgcacatcgccgacggtcatcccgtagcgggccgccttctcacgatgaatatcaatgttgaggtagcgcccgccgcccaaccgctcggctaatgccgacgtgactcccggcacgctgcgcgccaccccttcaatttgcccggcgatggcgtcgatatcggccaggttggtgccggaaaccttaatgccgatcgggctcttgatgccggtggagagcatgtcgatgcggttgcggatcggcggcacccacaggttcgccagccctggcagacgcacggttttatccagctcgtcgacgatcttctccatggtcatccccggccgccactgatcctgcggcttgagctgaatggtggtctctaccatctccagcggcgccgagtcggtggcggtctcggccttgccggttttgccgaacacccgcgccacttccggcaccgccatgatcagcttatcggttttctgcagcatatccgccgcctgcgcagcggagatccccggcagcgtggacggcatatacagcagatcgccctcgttgatctgcggcagaaactcgccgccgacccggttaagcggccagacaaccgtcaggatcgacaggagcgcaatcagcagggtagtcttcggccagtgcagcaccttcagcagcagcgggtgataaatgcggatcaaaaagcgattcagcggattgctgttctccgctgggatcctgccgcggatccagaagcccatcaggatcgggatcaccacgatcgccagcagcgccgccccggccatcgaccaggttttggtgaaggccagcgggccgaacagtttgccctcctggccttcgagggtgaaaatcgggataaacgacagagtaatgatcagcaggctgataaacagcgccgggccgacctccaccgaggcctcggtaatgattttccagcgtgtgtcgttgctgagcttctctcccgggtgctgatgctcccactcctccagccgcttatgggcgttctcaatcatcacgatggcggcatcgaccatcgcccccaccgcaatggcgatcccacccagcgacatgatgttggcgttgagcccctggaaatgcatcatgataaaggcgaagcacaggccgagcggcagcgagataattgccaccagcgccgagcgcacgggccacaggaacagggcgcagaccagcgccacgacgataaactcttccagcagcttgtagctgaggttgtcgatggcgcggtcgataagctggctgcggtcgtaggtggtgaccacttccaccccttccggcaggctgctttgcagcgacgccagcttctctttgaccgccgagatcacctcgcgggcgttcttgccggagcgcaggatcaccacgccgccggccacttcgccctcgccgttaagctcggcgataccgcggcgcatctccgggccgatctgtacccgcgcgacgtcgccgagataaaccggcacgccgttatccccggttttcagcacgatatttttgaagtcgtcgagcgtctgcaggtagccgctggcgcgcaccatatattcggcttccgccagttcgacggaagagccgcccgcctcctggttagagccgcccgcctcctggttagaggcgtccagcgccgatttcacctcgccgaggctgatgccgtactgggtcagcttcatcgggtcgacgacaatctggtactccttgaccacgccgcccaccgacgccacttccgagacgttaggaatggttttcagctcatattttaagaaccagtcctgcagggagcgcagttcggcgagatcgtgcttgccgctgcggtcgaccagcgcgtactcgaagacccagccgacgccggtggcatccgggcccatttcggcgctgaccccggcgggaagtttgccctgcacctggttgagatactccagcacccgcgagcgcgcccagtaaggatcggtgccgtcttcaaaaatcacgtatacgtaggagtcgccaaactgcgagaagccgcgaaccgttttggcgccggggactgacagcatggtggtggtcagcggccaggtgacctggttttcgacgatctgcggcgcctgccccggatagcgggttttgacgatcacctgcacgtcagagagatccggcagggcgtctaccggggtgtggatgatggtccaggttccccagatgctgagaaacagcgccgccatcatcaccaggaagcggttggccaccgagcggcggataatccattcaatcatggttccgttccttagtgcgcgtgggcggcagaggccgcggcatcaggggcctgcgcgcgcatgcgctccagcgcgccggcgatattggcctccgagtcgatcaggaacaggccgctggcgacgactttctcaccctcctgcagcccgctgcgaatggccgtgacgccggcggattcatggaatacctgcacgattttcggcacgaagcggccctcgttatcgacggtgatcactcgctgctcgctgccgctgtcgatcagcgctttggaggggatcagcagcatcggggcgctttcgctggtcagctgcagataggcgttcatccccggcttcagcgcttcatccgggttgttgacctgcaggcgcagctgcagggtgcgggtggcgctatcgacgctggggagaagggtccatttgctgatgcggaaggttttgcccggccaggcgggaacctgaatgctgaactgcgaggcgtctttaatcagccaggcgatggattccgggaccgccacgctgacccacaccggatccatgccctgaattttcgccaccacgttatctttggcgatgttcattccggcgcgcagatcgaaggcggtaataacgccatcgatcggtgctttgagagtaaagcgggtctggattttacgcgtggctttcaggcggcggatatcgtcatccggcattccggcgagacgtagacgctcgaggatcccctcgacctgcgtagcggtgcccccggtctcctgcaatagcagatattcgctctgcgcttccacccagtccgggatggtcagctcgagcagcggcgtgccttgtttcactttgtcgccgacggtcagcggatagactttattgataaagcccgccgcccgcgcctgcataatcacatactggtactcgttatagctgatattggccgggaaggtctgagcgtagcgcagcggcccgcgggtgacggcggcggttttcaccccaagattctgggtctgcgtcgggtcgatacgcacccccggtgcaccggcggcggcatgctcctcatcggcgtatttcggcaccagatccatatccataaacggcgatttacccggtttatcgaagcgggtgttcgggtacatcggatcgtaccagaacagcactttacgctgctgctcggccgccggagcggcagagtgggtcggagcccatcgggcgtacagcgccgcggtaagcgcgccgccaatcagcatgctgccgaggatcagcgccgtatttttcagtgtcagggatgccatgtgtcgtccattcagttgttgaggggcctaccgtcgccgggccgttattgggcgcggatatcctgtaacagcgacaggttgccctgctgaacgaaggtgaagtccacgctgtcgccatccttcacattgttgagctgcgtctgcggggtgatggtgaagcgcatggtcatcggcggccagttcaccgccgggatggcctcgtgggcgatagtgatttttttgttatccatatcaatggctttaatgacgcctttgccgcggatgctttgcgtctgcgcggcggcgggctgctcgtgcatcgccatgctggcgtgcgggtcggcagcctgggcggcgaacaccgcgccagagagcagggtgaacagggcgattttagatagtgaattcatgttcgggactccttgggttattccatccagccgccgccgagagcggtgaacagggtgatttcatttgcctgacgggaatagttgagttccagcagggtttgtcgggtggtgaaaatatcgcgctgggcgctcaggacttcgatatagctgaccgcgccgtggcgatagagcgcagtggcgcgctgcagggtgatattcagcgaggcgagatagcgctcctgcgcggcaatttgatcggccaggctctggcgcagggccagcgcgtcggccacctctttaaaggcggactggattttttgttcatagttgaccacctgctgctgctggcggatctccgccagatcgaggctggcctggttgcgcccggcgttgaaaatcggcagttcgattttgggaatgaagttccacatcgcgccgccggcgttaaacaggctggagagttcgctgctgctgccggagagcgagctggtcagggtgatcgacgggaagaaggccgcccgcgcggcgccgatgttggcgttggccgcttgcaggctgtgttcggcttccagaatatctggccgctgcaggaggatcgctgaggagagcgatggcggcagggttacgccttgcaggtctaccgcgctgctggcgctatcgtccggcagatgttgatagctgccgagcagtagctgcagggcgttattggcctgcgccagctggccctgacgtttggcgatatcggcgcgggtgctttcgatcatgtcgcgcgcctgctccagcgccagcacggtggtgctcccggtcagcagctgtttttcaacgaaggcgtaagactgctgatagttctgtaaggtatcgttggccacctgcagctgcgctgccgccagccgctggttgaagtagctttgtgaaacgttagcaatcaacaggatatgcactgcgcgccgtgcctcttcgctggcgaagaagttctgtcggtcggcctcgctaaggtttttcagccggccaaagaaatcgaggtcatagctgaggtttaagccggcggcataatcgctgctggtggtggtgtcgcctttgagcttgccgccataggtggtgctgccgtcaccgttaagctgtgggtagcggtcggcgtcggttacccggtactgggcgcgggcttcctgcactttcagcgtcgccatccgcagatcgcggttgttggtcagcgcggtgctaatcaggcttttcacctgcgggtcgacgaaaaaggtgcgccaaccggtctcctggtagcccgctgtcgcagtaaccagcttgttctggctgagagagaactgctgcggcaccggcgctgcggggcgctgatagtccggagcaagtgacagacagccggttaaggtaaatatcacgctgagggtaagtagctgtattgagcgcatggcggcagaagtttcgacgatttatccatggcggctactttacgtagcgggctctgttcagggcgtgacgggaaaatgacaaagctgtcattttcctgatatttcattgctatccggaggcgctcctctaaaattgaatacccgcacaaagcgcgcgtgaaggagcctgccgtgaagattttgattgtcgaagatgagaagaaaaccggagagtacctgaccaaagggctcaccgaggccggcttcgtcgtcgacctggccgataacggcctcaacggctatcacctggcgttgaccagcgattacgatctgctgatcctcgacatcatgctgccggatgtgaacggttgggatatcgtgcgcatgctgcgcgccgccgggaaaggcatgccgatcctgctgcttaccgcgttgggcaccattgagcatcgggtgaaggggctggagctgggcgctgacgactatctggtaaaaccgttcgcctttgcggagctgctggcgcgggtgcgtactctgctgcgccgcggggcggcggtcatcgtcgaaagccagtttcaggcggccgatctcagcgtcgatttggtcagccgcaaggtgacgcgcggcgccacccgcatcaccctgaccagtaaggaattcacgctgctggagttcttcctgcgtcatcagggcgaggtgctgccgcgttcgttaattgcctcgcaggtgtgggatatgaacttcgacagcgacactaacgccatcgacgtggcggtgaagcggctgcgcgccaaaattgataacgacttcgagccgaagctcatccagaccgtgcgcggcgtcggctatatgcttgaggtgccggatggccgctaagcgccccttttccctggccacccggctgaccttctttattagcctcgccaccgtcattgccttcttcgccttcacctggatcatgatccattcggtgaaggcccactttgaagagcgcgacgttcacgatctcagacagctcagcaccaccctggagacggtcctcgaccacgctgactacccgcaggcgcggcgtctggagatcgtgaagaatatcattgcgggctacgccaacgtcttcatctgcctggacgatggccagggcaatattctcttccagtcgcccaacgggccggatctcagccatatgctgagtacgccggggctggcgatgcagctccgcgacgggaatgtgatttcatggaccgacccgcagccgcgggcaatggcgcacgataatcatccactggagacccgcgcctggcggctgatcatgctgccgctgggcaagcaggcggacggtaaaccggcgtaccacctgctgatggccttatccatcgattttcacctgcactatattaatgagctgaaagcgaagctgatctccgcggcgtcgataatcagcctgctgatcatcgccatcgtgctgtttgtggtctaccaggggcataagccgatccgccagatcagccgccagatccagaatattacctcgcgggatctcgatgtgcgccttgacccgcaggcggtgcctgtcgagctggagcggctggcgctgtcgtttaaccatatgctggagcgcatagaggatgtctttacccgccagtccaacttctccgccgatatcgcccatgaaatccgcacgccgattaccaacctggtgacgcaaaccgaaatcgccttaagccagagccgcagcccgcaggagctggaagaggtgttgtattccaatctcgaagagttctcgcggatgtcgcggatggttagcgatatgctgttccttgcccaggccgataacaaccagctgatccccgaacagcgggcgctggatttggccgatgaagtgcataaggtgtttgagttctttgaggcgtgggcggaagagaaagcggtggcgctgcgttttgtcggtagcccctgccgggtgacgggcgatccgctgatgctgcggcgggcaatcagcaacctgctgtcgaacgcgattcgctatacgccggccgggcaggcggtgaccatccagttgagcgaaagcgcggagacggtacgcctggtggtggagaaccccggtatgccgattgccgccgagcatctgccgcgcctgtttgaccgattctatcgcgtcgacccctcgcgccagcgcaaaggggagggcagcggcatcggcctggcgattgtgaaatcgattgtcggagcccaccacggcagcgtggcggcgcagtccgatctgcgctcgacgcggtttattgtgatgttgccgaaataggcgcaatccgcgagtgatagttgagtatgtggctttctgtcgctatattgaatgtacggaaaataaccgtacatgaagtttgcaacaggccggagataacgtatgcccgcacttaaaaagcagcgtatagatttgagattaaccgatgatgataagagcatcatcgaggaagctgcggcaatttcgaatcagacgattacccagtttgtggttgccagtgcctcagaacgtgctgcggaagtgattgagcagcaccgcagaatggtcctcaatgagcaatcatggagcctggtgatggaggcgattacccaaccgccagccccgaatgatcgactgaaacgtgcagcgaagcgtctacaaaccaggtaaggtagagctaatggagcagcaactgacgattgagatgattgccgatgcgttcagctacgatatcactggatttgattgcggcgaggaagcgctgaatacgtttttaaaagagcacctcaagcggcagcacgatggacaaatcttaaggggttatgcgctggtctccagggataccgttcccaggttgctgggttattacaccttatcggggagttgtttcgagcgaggcatgttgccgtctaaaactcagcaaaagaaaatcccgtatcaaaatgcgccaagcgtaaccctcgggcggctggccattgataaatctgttcaggggcagggctggggagagatgttggttgcccatgcgatgcgagtggtgtggggagcgtctaaagccgttggcatctacggattgtttgttgaagcccttaatgagaaggctaaagcattctatcttcgtctggggtttatacagctcgtggatgaaaatagtaacttactgttttatccgaccaaatcgattgaacagctctttactgacgatgagtcataaaagaaaccgggcagcgccaggcggctgcccgcagtatcgcgactctcttactcttcgaagtaccagtagccctgattaatcagccgcgtcagttcgctcacgaacgccggattctgcaggccgctgccgagctcttcctggcctaatgaggtatagcgacacagcgcatccagcgcttcggcatcggtggtgtcgagttgttcgctatgcacgaagaagctgtcgccgatatgcagaacgcgcaggccgctcaggcgggaaagcttttcaccacccagcagcgcatcgaccacttcctcttcttcatacggtggttccgccggcgcaatatccagctcgtgacgcggggtggtgacgaaactgccgaaccactgcttgaagtcttccggctggcgaatcatatcgatcatcatggtgcgcagacgttcgagttcatactcttcaacccggcccggatgctcgcggcaggtgaggtccggatcgctgtagtgctcgtcgccgagatcgttctccagcacatagtcggcgaagctgctgatcaggtcgcggccgtttggcccgcggaagccgacggagtagttcagggcggtttcgtgggttatgccgtcgtgcgggaatcccggtggaatatagaggatgtcgcccggctgcagatcttcatcaatgatcggtgggaacggatcgacgtgcagcagtgccggatgcggacagaactgacgcatcggcagcttgtcacccacgcgccagcggcggctgcccatgccctgaataataaagacgtcatactgatcgatatgcgggccgacaccgccgccggggacggagaaggagatcatcaggtcgtccaggcgccagtccggcagtacgcggaacgggcgcaccagctcggcggccggcatatgccagtggtttaccgcctgggccagcagggaccaaccggtttcgcccagcccgtcgaaatgttcaaaaggaccattgctggcctgccatttgccgtttttcaggctgaccagccggctgtcgacttccggctccatggctaatccggccagctcgtccggagtaatcgggtcgacgaagtccggaaacgcgttttttaataccaccggctgtttctgccagtatttttctaaaaactcgggccagttaatgttgagttgataagccatcgattattaccagtaagaagaaacgggcctgattatagaaatgagggccgggcgggcgcattgtcgtgggtcaagagtggtgcttaattcaccatcggcgcgataatggcgttgggtaagagagaaaaatcacatttttgccaaaaaccgatcttagcgtaaattgcgctgcaggccgcatgagcactgggattgagcctttaatggtaagaagatgaattcgcgaaaagttcaaataatgagcggtcgataagatttttctattttaacgcttgctacttccgacgaactccctataatgcgctcccactgacacggcggatgtgaatcacttcacacaaacagccggttcggttgaagagaaaaatcctgaaaaacgggttgactctgaaagaggaaagcgtaatatacgccacctcgcgacagagcgctaaagcgcgtcgcaactgctctttaacaatttatcagacaatctgtgtgggcactcaaagtgacatggattcttaacgtcctcggacgaaaaatgaataccaagtctcaagagtgaacacgtaattcattacgaagtttaattctttgagcatcaaacttaaattgaagagtttgatcatggctcagattgaacgctggcggcaggccta

SEQ ID NO: 88 - DNA, 11928 bp, Unknown
  source: /note="Description of Unknown: KP2-Mcoc1 Bacteria Sequence"
cgtgcggctcctcgcgttctgtctccctcttgttttcactgctccgcccccctccgctgccctccctctcctcttcgtcggcagcgtcagatgtgtataagggaccgcgctgctgatcgccctgaccatcgtcgccgccctctggccttcggcccgctggcggcggctggcttcccgtctgccgctgctgctggcggtgccccatctcgccctggcgacggcggcgctgctgctgttcgccgaagggggctggctctggcagcagttgccgtttctgacgccgccggtcgaccggtacggcattgggcttggcctgacgatggccctgaaagagagcgcctttgtgctgtgggtgatctatggcctgctgggagagaaacgcctcgccgaccaggcgaccgccctgaagagcctcggctacggccgctggcagtgcctgcgttggctggtgctgcccgccctgctgcccgccctcggcatggtgctgctggccaccaccgcctggagcctgtcggcggtagacgtcgccctggtgctggggcccggcaatccgcccaccctcgccgtgctggcgtggcaatggttaagccagggcgatgagctgcagcaggccaaaggggcgctggccagcctgctgctgatggcgatcctcggcgggcgggcgctggtcgcctggggcggatggcggctacagcgccagtaccagcccgatctgcacggtgttcgtcacccgcatcctcatgccctgcccggccgcctgctggcggcgctgctgccgctgagcggtctgctgggcgcgctattgctggcggggctggcgcgctcggcgccgccgcagatggatgctctgggcaacagccttgggctggcgctggcggcctgcgccctcggcgcggctgtctgcctgctgtggctggcctgcggcccggcgcgaggcgatggctgggtctggctaccgctggtcctgccggccctgccgctggccgacggccagtaccggttggcgctgtatgcctggcttgacggtgactggtggaccgtcctgtggggccatctgctgtgggtggtgccctggatgctgtttattttgcgcccggcctggcgccagcgcgatccgcggctgacggttgtcgcccgcacgctcggctggggatcgacgcgtattttctggttgctgaccctgccttcgctaactcgcccactgctgaccgccctggcggtgggcttctcagtgagcatcgcgcagtatctgccaacgctatggctgggggctggccgaattccgacgctcaccagccaggcggtggcgctcagcagcggcggcgaggcgcagacgctcgccgctcaggcgctgtggcaattattgctgccggcggtatgctttaccctgaccgctctgctggcctggctggcaggccgctatcgacgaggacttcgctagtgctaaccgtaaaccatctgactctgagcgtgagacgccagccgctgctgcgggaggtcgccttttcggtagccccgggggaggtgctgacgctgatgggcccctccggtagcgggaaatcaacactgtttgcctggatgattggcgccctgtccggcgattttcgcgcccgaggcgaactgtggctcaacgaacggcgttgcgatacgctgccgacagagcatcggcgcatcggcattctgtttcaggacccgttactgttcgaccatttcagcgtcgggcaaaatttacagctggcgctgccggagaacgtgcgcggcgaggcgcgaaaaaccgcggtggaggaagcgcttagccgcgccgggctggcgggcttcgccccgcgcgatccggccacgctctccggcgggcagcgggcgcgggtgagcctgctgcgcgccctgctggcgcgccccgaggcattactgcttgatgagcccttcagccgcctggatgccagcctgcgcgccgggttccgccgctgggtctttgaagaactggaccgccaggccattccggcgatcctggtgacccacgatcgcgaggactgcccgccgacggggcgctgcctggcgatggagcgctggcaatgaaggacaatagtgtgcaaacctgcgttaccgcaaagaaatcggcgcctggcgagtggagaatacgccctccactttttaccgtcgggcatttcgatgaaacgtgtttctcaattgaccgcactcgccctgctcatggggcttgctgcttccactacctgcgccgctgaaaccatgccagcgctcactctctcccacctgcaacagcagcacggcgtggccatcgacacccggctgagcgcttattacaacggctggccgcagcgcgccaacggcccggaaggccatgagccgcaggccctcaatctttccgcctgctggctcggcgccatgagcgacgatcagctgcgcgcctgggctaagcagcaccagctccagtccgatacccccatcgcgctgtacggcagcccggaggataacgccagcgtcgcggcgcggctgaaacaaacgggtttcacccggctcagcaccctgagcgatgcgctgagccagaccgaccgtctgcaaaagctgccgcactttgaacagctggtctacccccagtggctgcacgacctacagcaagggaaagcggtcgccgccgccccggcaggcgattggaaagtgtttgaagccgcctggggagcgccgaagctctatctgctgagccatatccctggcgcgggctatatcgataccaatgaggtggagagcgaaccgctgtggaataaagtgtccgacgcgcagctgaaggcgatgctggcgaagcacggcatccggcatgacaccacggtgatcctctatggtcgcgacgtctacgccgcagcgcgggtggcgcagatcatgctgtacgccggggtcaaagacgtgcgcctgcttgacggcggctggcagacctggtccgacgccgggctgccggtagagcgcggtatgccgccggcgcagcagccggcgcctgatttcggcgcgccgatccccggcccgccgcagctgatactggataccgaacaagcccgcgggctgctgcatcgtcaggacgcctcgctggtcagcgtccgctcgtggccggagtttatcggcaccaccagcggctacagctatatcaagccgaagggcgacatcgctggggcccgctggggccacgccgggagcgactccacgcacatggaggatttccataacccggacggcaccatgcgcagcgccgacgatatcgctgccctgtggcgccagtggaacattctgccgagccagcaagtggcattctattgcgggaccggctggcgggcctcggaaacctttatgtatgcccgcgccatgggctggccgcacgtcgcggtgtacgacggcggctggtacgaatggagcagcaacccgcacaatccggtggcccgcggagagcgcggcccggaaagcagtcagtaactcgccccgcctcagcgcgtcgccctttgtcggcgacgcgcgataccccgtttacgctgtggtcgttacccgctttaaggtctggtagccactgcagatgcgcgtcgccgtcgtcagccagcacagcgcgccaaacagccacgccagccaggcgaaatgcgccggaaacaggcagccgaggacaaacaacaggatggtctccgtcccctccgtcagtcccccgagatagtacagcgatttatgggcgtagccgggattggcgatctggtgcctggccgccagggcggcaaaagcgagaaagctgctgccggtgccgataaaggcaaacagcagccagccgcccgccagggcattgttcagcggatccgccagaataaagccgaacggcaccagggcgtaaaagagaaaatccagcgcaatatcgagaaagccgcccgcgtccgtgagcccgcgccgccgcgccagagcgccgtccaggccatccagcaggcggttaaggagaatggccgccagcgccgcgccataccaccccagcgccagaaagggcagagccagcacgccgatggcaaaaccaaccagcgtcagcccgtccggtgagatgccggggcggtcaagggcgccggcgacagcgttaagcaggggtttaaggcgcggatgcaggtggctatcaagcacgaaggtctccagcagggttggcggttgtcagttacggtctatggcggtgataataggccatattcgtcttattaaccttaatgcttatgctaaaaatgattgatgttgtcgccgccattattgaacaggatggccagattctgctggcgcagcgtccgccccacgccgaccagccggggatgtgggagttcgccggcggcaaagtggagccgggtgaaaaccagccgcaggcgctggcccgcgaactgcaggaggagatgggcatcatcgcccgcccggcttgctatatcgctagccatcatcgggaggtctccggccgccgggtccatctgcacgcctggtgggtgccgcactttcagggcacgccgctggcccactatcacactcagctgcgctggtgccttcccacagaagcgctggccctcgatctcgccccggccgatattcctctgctgcacgcctttatcgcccagcgccccaccctttccgtccgctgatccgcccgccgcctcgtcatcgcttttagttatgacgagcgggcaattataaattttgttgtcggctcaatttttccttgcttgcctaaggattagcggtgttatagtcggaaaatcggttttttcaaggaccgaatcataataaatacatgcaaccacaaccataaggggaactgatatctatggatcagacgtgcactctggaaggctttctcacccgcgttcaacagcgcgatcctcatcaaaccgaatttgctcaagccgtccgggaggtgatgaccaccctgtggcctttccttgaggaaaatccgcgctatcgtcagcttgctttgctggaacgtctggtggaaccggagcgcgtgatccagttccgcgtggtgtgggtggacgaccgcaatcaggtccaggtcaaccgcgcgtggcgcgtgcagttcaactcggccatcggcccgtataaaggcgggatgcgttttcacccgtcggttaacctgtcgattctcaaattccttggcttcgagcagaccttcaaaaacgccctgaccactctgccgatgggcggcgggaaaggcggcagcgatttcgatcctaaaggcaagagcgatggcgaagtgatgcgtttctgccaggcgctgatgaccgaactctatcgccaccttggcccggataccgacgtaccggcgggcgatatcggcgtcggcggtcgcgaagtcggctttatggccggaatgatgcgcaagctctccaacaacagcgcctgcgtcttcaccggtaaaggactctcctttggcggcagcttgatccgtccggaagccactggttacggcctgatctacttcaccgaagcgatgctcaaacgtcacggcctcggcttcgaaggcgctcgcgtggcggtctccggctccggcaacgtcgcgcaatacgccattgagaaagcgatggagcttggcgcgcgggtggtgacggcctccgactccaacggcaccgtcgttgacgaagcgggcttcaccaaagaaaaactggcccgcctgatcgacattaaagagcgtgcccacggccgcgtggccgattacgcccgcgaatttggcctcacctatcttgaaggccagcagccgtggtcagtgccggtggatattgccctgccttgcgcgacccagaacgaactggacgtcgatgccgcccgccagctgattgccaatggcgtcaaggccgtggcggaaggcgccaacatgccgaccaccatcgccgcaaccgacctgttcctggaagctggcgtgctgtttgccccgggcaaagcggccaacgccggcggcgtggcgacttccggtctggagatggcgcagaacgccgcgcgcatgggctggaaagcggaaaaagtggatgcccgtctgcatcacatcatgctggatatccaccacgcttgcgtgcagtacggcggcgaagcgaagcagaccaactacgtgcgcggcgcgaatatcgccggtttcgtgaaggttgcagatgccatgctggcccagggcgtgatttaacctcccctaactccatcccggcggcagcccgccgggatgcgtctcacgacgtcatcgtgatcaccactttccccagatgctgaccactgtccagacaggcatgggcctcggcaatctccgccatcgggtagctggcgtagatcagcggcttgcatttccctgcctcaagcagcggccagacgtggcggcgcagcgcctcggcaatctgctgtttctccgccgccgtccggccgcgcatggtcgagccggtgacggtggctcgcttgagcatcagagtctgaatatcaacctcatgagcgattcgcccgcccataaagccgatgatgaccagtcgtccatcctttttcagtagcccaaggttgcggttaaagtaagggccgccaacaatatccagaatgacgtccaccccttcatcgttggtcagctggccgattttctcggcaaaatcatcggttttgtagttaatcgccgtagcatagggacgtagcgcagcaattttttcgtcctggccgacggtggcatagacggtcatccccagcgcgtggcacagcaggaccgcggtggtgccaatcccgctggcgccgccgtggaccagaatgctttcgccaggctgcagcttacccagctggaagacattcgcccagacggtgaagaaggtttccggaatggcggccgcttcgctaaagctgagacccgccgggatcggcaacgtctggcctgccggcacggcgcagtattcggcatagccgccgccgttggtcagcgcgcaaacgcgatcgccgggcgtaaacgctgtgacctgcgcgccgaccttaacaaccacgcccgccacctcgaggccgggcacgggggtgacgccctcaggcatgggatacagaccctggcgctgcagaatatccggccggttgacgcccgccgccttcacctcaatgagcacctcatgctccccgatgatggggatctccccttcgcggatctgcaatacctccgggccgcccggttggctgatagcaatatatttcacgggtcctccttatcgcctgtgagagaaatggggcatcggcctcaggaaaagcgcagcgggcatcccctgctcaggggccccgcgtccaggctcttcccggctgtttagtgtagaccattggcctggctggcggagaagcggtggccgcggggtaacgcatcctcgcgaccaccggcgggttactgcggcggcggcgcggtatcgtctgccgcttttttgcctttcggcttccctttacctttgctgaacgacttcttcgccccgcccggcgccaccaggccgcggaactgacgcaccggcgtgctgcgcgcctgatcgatcagttgatacagcgtccccaccagcggctgcataaagtcctgatagcggcactgtttctcgctgatctgcgtcaacaccgactcccagtgggcggtcatgtccggtcgcccggccatctccggcagggaatgaatgagcgccctgccggcctccgaagagtggatatagcgcccctttttgctcaggaaaccacgcttgaacagcagctcgataatccctgcgcgggtcgcttccgtgccgaggccgtcggtggcgcggaggatcttcttcagatctttatcctgcacgaagcgggcaatcccggtcatcgccgacagcagagtggcgtcggtaaagtggcgcggcggctgggtctgacgctccaccacctcgcccctctcgcacagcagttcatcgcctttggccaccaccggcagcggcgtgccgtcgttctcttcatcgcgctctttgctgccaagcagcgtccgccagcccgcctcggccagaaaacgcgccttggcgacaaacttgccgttggcgatctcaagatcaatctggcatttgcggaacactgcgtcagggcagaactgcatcagatactggcgggcgatcagggtgtacaccttcgcttcgttatcggtgagcttcacctggctgctgcgggcggttgggataatcgcatggtgcgcgtcgacctttttatcatcccagcagcggttgcggatctccggatccactaccggctgcggcagcaggtccgccgcatagacggcaatcgcattcaacaccgcatggcggccagcgaagtgctcttccggcagatagcggctgtccgaacgcggataggtgatgagtttgtgggtttcgtacagcttctggcagatatccagcacgttctgcgcgctgaagccgaaacgtttggccgcctcaatctgcagcgccgacagcgagaacggcagcggcgcgggttcggaatcgcgcttatcgttatagccggtcacgattgccggctggccttcgatgcgcttaaccacatgctcggccagcggacgatgcagcaggcgcccttcttcatcctggtaaggttcgcaggcttcgctcggcacccaggtggcgacaaaacgctcctcctgcggcgtgacgatatgcgccttcacgtcgaagaaatctttggcgacgaaattttcaatctcttcatcgcgacggaccaccaggccaagtaccggggtctgcacccgccccaccgagagcaccccctgatagccggcgttgcgccccagcagggtgtaggcgcgggtcatattgatgccgtacagccagtcggcgcgggcccgcgccagcgccgacacgcagagcggcacgaactcgctgttggcgcgcagacggttgatcgcccgctccaccgcctgcgggttgagatcgttaatcagacagcgctgcacctgctgacgcttctccggcgccagctgcaggtagtcgagtacttcgtccaccagcagctgcccttctctgtccgggtcgccggcgtggataacctcctcggcgtcgccgagcaggcgcttgatgacattcagctgtttggtgaccgagggctttggctgcagctgccatttctccggcacaatcggcagatcgttgagattccaccgggcatagcggctgtcgtagatgtccggctgcgcctgctccagcaggtggccgatacaccaggtgaccacctgcccgttgccgcactcaatatagccatcgcctttgcggtgcggtttaggcaacacatcggcgatagcccgaccgagactcggtttttctgcaataaacaaccgcatcgaatcaacggatctcgatcatgggtcgcccgccgcgggcggtcaccagctcgccgatggcggccagcttaatgccgaactccgccgcggcggcctgaacttccgcctccgcctccggggtcaccgccagcagcagaccgccggaggtctgcggatcgcacagcagatcccgccactccgtcggcatctcgcccatgagatggccgtagctggcaaagttgcgcccggtgccgcccggcaccgcgccggcggcgatatagtcctccacccccggcagttttgggatatcggcatagcgcagctgcgcctgcacgccggccccgcggcacacctcgctgaggtggccgagcaggccaaagccggtgacgtcggtcatcgccttcaccccgtcgatggcggcaaacgcggcgccggcgaggttcatctggcacatggtctccgtcgccagtccctgatgctctggcttgagcagcgattttttctccgcggtggtcagtacgccgatccccagcggtttagtaagatacagtttgcaacccgcctgggcggtgctgtttttcttgatgcgctcggtgggcaccacgccggtgaccgccagaccgaagatcggctccggggcgtcaatggagtggccgcccgccagcgcgatccccgcctgctggcaggcaaagcgcccgccctccaccacttcgcgagcgatttccggcgccagggtgttgatcggccagccgaggatggcaatcgccataatcggtttcccgcccatagcgaaaatatcgctgatggcgttggtggcggcgatgcggccaaagtcgaacgggttatcgacaatcggcataaagaaatcggtggtgctgacgatcgaggtgccattaccgagatcgtaaacggcggcatcatcgctggtttcgttgccgacaagcaggtttggatcgacaaacttcgcctgctcgctatgcaggatagtttccagcactttcggggaaattttacaaccacaaccggctccgtggctgtattgcgttaaacgaatggcttgctcgctcatggacatctcctgtcattgcaatcccgctatgttagcgcccaaacgccagggtggtaagtacgacagtctgaaatcgcgtatggctgctcattaagcagacaaaaagccgtttttgcgagacgcgacaattttttcccgaccattttcacttttacttaaagatgacagaaatgtgacagcacaggactgtcttctctggaatgattatgacgtaaggaaattctaatgaaaaagcgtgttcttgccctttgcctggccagtttcttctccgttaacgcctttgctctggttccccccgggaacgatgtcaccaccaagcccgatctctactatctgaccaatgcccaggccatcgacagcctggcgctgttgccaccaccgccggcggtgggcagtatcgcatttttaaacgatcaggcgatgtatgagcaaggacgtctgctgcgcaataccgagcgcgggaagctggcggcagaggatgccaacctcagcgcgggcggcgtggccaacgccttctccagcgcctttggttcgccgatcaccgagaaagacgcgccgcagcttcacaaactgctgaccaatatgattgaagacgccggcgacctggcgacccgcagcgcgaaagagaaatacatgcgcattcgcccgtttgcgttctatggcgtctccacctgcaacaccaccgaacaggacaagctggcgaaaaacggctcttacccgtccgggcatacctctatcggctgggccaccgccctggtgctggcggagatcaacccgcagcggcaaaacgaaattttgaagcgcggctatgagctcggcgagagccgggtgatctgcggctatcactggcagagcgatgtcgatgcggcgcgcatcgtcggctccgcggtggtcgctacgctgcacaccaacccggccttccagcagcagttgcagaaagccaaagatgaattcgcgaaaaggcagaagtaacgtcatcgccgttgcattcccggatgcggcgcctggcgcgtcttgtccgggctacaaaaaccgcgattgattcgaatggtaggggttgtaggccgggtcaggcgccagccgccacccggcatagatgcggctccgagcctgctgccatcgcccggcggcgctgcgcttgcgcggccagccggacggttccctctccctccgggagagggccagggtgaggggaagcactgcagtgtggttgtttatgttatctgtggcttcagcgtagtttgcgctcccggttaatcgtctgcgttatgtcacttatggcgccgggagcgcacagggggcggccagtcgccgccgccccctgtacccccgggctccggccagcaaaatcgccgctgcgcggtcccttcgacttatccctgcaggcttcgggtcgggccgaggcagcgtccctgcaaagcacggccctcagcccgcatccatgcgggctgccccggcctgccgggaacgtctcagcgattttgaggccgtcagcaccggcagtttcagcaagaaaagtgaataaattaacgacaggtcgtacgaacgtaggccgggt

SEQ ID NO: 89 - DNA, 11328 bp, Unknown
  source: /note="Description of Unknown: KP2-Mcoc1 Bacteria Sequence"
gggcgcggtggctcacggtcagtcacgacgcgcggcggctttttgccctgggggacgctgaccggaacgatctcctcgcgaaagcgcccggcggcgatagcggccgccgctttgcgctgggagctggcggcgaaggcgtcctggcgctcgcggctgatgtcgaaggcgtcggcgaggttctcggcggtaatgcccatgtggtagtcgttaaaggcgtcccacaggccgtcctggatcatgctgtcctgcaggctggcgtggccgaaacgcaggccgtcgcgggcgccatgcatcagatagggagcattgctcatgctctcctggccgccggcgataacgatcccggcgtcgccgcagcggatcgcctgcaccgcctgctgaaccgctttcagtccggagccgcagaccagattgacggtgaccgccggagtgtcgaccggcaggccggcccgcagcgcggtctggcgcgccgggttttgcccgcagccggcggtaagcacctggccgaaaattagttcgtcgaccgctgcggcgggcagctggcagcgttcaagcaggccgcgcaccaccgctgcgccgaggtcgacggcggaaagaggggcgaaggcgccgcgaaagctgcctaccggggtgcgtactgcagcaacaatggcaatatcggtcatggtctctccttaactgaagcgcatttcgcgcacgtcgtcggcgacgatcagccgtcccgccgttttacgtatcacctcgtcggggctgacccccggggccacttcgcgcaggacaaacgcgccgtcgacaatctccagcagggccagatcggtgagtacccggcgaatacagcccacgccggtgagcggcagggtgcactgcggcagcagtttggattcgccgttttttgaggcgtgggtcatcaccacgatgatgttctgcgcgccggccaccaggtccatggcgccgcccatccccttgaccatttttccagggatcatccatgaggcgatgttgcccgcgacgtcgacctcaaaagcgccaagaacggtcaggtcgacgtggccgccgcggatcatggcgaacgactgggcggaatcgaagatcgccgccccggtttgcgcggtgacggtttgtttaccggcgttaatcatgtcggcgtcgatggtttcctcatcgggaaattcgcccatccccagcaggccgttctccgactggagcatcacttcaatgccggcgggaatgtagttggccaccagcgtcgggataccgatcccgaggttgacgtagtcgccgtcgcgcagctcctgggcgacgcgcatcgccatttgttcacgggtcagcatctcagtgccctccggcgcgcagggtgcgctgttcaatacgtttttcgaattgcccgacgatcagccggtcgacatagatccccggagtatggatggcggaggggggcagttcgcccggcggcacaatctcttccacctccaccaccgtaatgcgcccggcggtggccatcagcgggttgaaattctgcgcggtgtggcgatagaccacgttgccgtaccagtcggctttccagcctttgaccagcgcgaaatcgccgcggatcgcctcttcaaggatgtagtgtcggccgtcgaactggcgcacctctttgccttcggcgaccggggtgccatacccggtggcggtgtaaaagccggggatgccagcgccgccggcgcggattttttccgccagcgttccctgcggggtgagttctaccgccagctcgccgctgagcaccagctgttcaaacagcgcgttttccccgacgtaagaggccaccaccttgctgacctggcgcgactccagcagcatgccgagaccgaaaccgtcgaccccgcagttgttggagaccaccgtcagcccctgcacctggcgacgctgcacctcggcgatcaagttctcgggaatgccgcacaggccgaagccgccggcgagcagcgtcatgccgtccgttaacccttccagcgccgcttcgtaactggcgacgcgtttatccagtcctgccatcttgtctctcctgccttgcgatagccttatcattggcgcaggcgactgatttgataattttgaatttgtgactcactcatttggaattttaattaatttcctgttaactaatttttttcaattagttaacaggatgaaaaatgagaatgagtgtcaaacagttacgcgcgtttttagcggtagctcacactctgaatttcgcccacgccagcgaaaggctgaatctgtcgcagccagctctcagcctgaccatcaaagggttggaggaggcgctgggcggcgcgctgctgcagcgcagcacccgcaaagtgaccctcacccaggagggggaactctttctgccgatggcccgtcagctgctggccgactgggataacgtcgaggaggccatgcgtcagagctttaccctgcagcggggtaaaatctcggtcgccgcgatgccgtcgtttgccgccaacgttctgccggaggcgctgaaagcctttcgcgaccgctatgccggggtgaacgttacggtgcatgacgtgattaatgagcaggtgatcgagatggtgcgcgaggggcgggtggagatgggcatcgctttcgagccatcgcccaaccacaacctgctgtttaccccgctggcggtggaccgcttcgtggcgatcgttccccaacaatccccgctggcgaagaaaaagcagctcagctggcaggagctgttgaccctcgactttattaccctgcagcgcccctcggcggtacgcctgatgctggaggaggcgctggcgcgcagcggacgtcagctggacgtggcgctggagagtcatcagctggtgacggtggggaggatggtggccagcggcctggggggcagcgcggtgccggcgctgtgtaaaacgcagatggcatcgttgggcgccgtctgcatcccgctcagcgatccgccgattgagaagtgcgtcggcgcgatccatgccggacatctgccgctgtcgaaggcggcgcaggcgctgctggatacgctgaaagggtttttacccacctgaggtgtgggcgtcaaaaaaaaccggcctgctggccggtttgacaatcagattttgcaggcgtcgccgcagtcgtcgtcggcaacgatcgcctgggcttttttgtccgcttcttccagacgctccgcgttgcgctcttccgcttcatccaggccgctgaagaccaggttgtcgagatcaatttccataagttacctatcgttgctggttttgaatcagggtcaagtatagggcataaccgccagtagatgtagccgcgcttcgcgccgaaggcacagagcgttaagtcgctgagcggagggcgttacctaccataaataatcgttgacagaataagtttagcgacaaataacgtcgccaggataatttcctgcctaaatattaaatgaaaggacaacgaaggagtaattaagcgttgacgaaacgcttttatgttaatatggccgcgattatggatgaatctatggatcttaatcaatggaacatactgttgcaggcgccatcaaagaatggcgtaaacataataaagtgatcggtcaggtcaaaataagctataaaaaaattttacgaaaatgcagagagctctcgctcgcaggaggtaaatacagagaatatcaaggactttgtgcgaaatatcagtgcgcgcggttgaccgcggtgaccaaaggactggtgccttttgaggataaaccgtttaaagcgtatctcaataaacggatgtcaaaacgacgcaaactggatattgcccatggttcactgaatttcatcgagaaaacgtttcaccctgatgtcctgccgcagctctacaatgtcgcggattttggccgcgagatgttttctattgccttgaaaaatggcgataagcttgacgttaagctgctggcctcgccgtttcaggaggaaggggagctgatgctgcagctgtttcttggcgaccggcgcgtctatagcgtctgtttttcctgcaccgacgatggccgcgcttatatcggcggcatccagggcgggaaagatatcaccaatgacgaagtgaaggtgctgactaaagagctgcatggcgcgcggccgaaaaatatcatcatgagcgtgctgtatggtttgctgcgatatttcaacatctccacggtctacgccatcgattctgattaccacgtgaaaagcgatctggtgaaagccagttattcatcgctgtggctggaaatgggcggtgagaaacaggctcgcggctggtataaactgccggcgcaagagatcaaaaagagtattgaagaggtgaaaagtaagcaccggagccagtttattaagcgcgaaggtcttaaagagctgattcagattaatatggcgaatgccctgcagcaaattaccttgtctgcgcgggtgaattaacgccactcacacgtcaggcgggcagcagggggctgctgcccgcctgacgatatcctttcttcactggcgcgtttccagccagatttcatcctatcccagggcttttgtggccggtcgaaaatggcgaggccgcgcgtccggcaagcagtgccaggaatacattcctcaggtttcggcatgggtaccggctttgacgatctgtagcgcgctggggctcgccacgctgccgctggcggtgacgaaccccggatggacggtctcgccgctggcgctgtccaccaatgcaataggcgacgcgctatgcagcacgtgctggtggccccattccatcagggcgaacagcaccagcgccgggatactgctgtgactggtgccgatggccgccgccgccgcggtgggctttatcgtccatatggcgggactgtccggcgcaggatgaggttgggcggcaacgggccagcgacccgttagcgcccaaccggaccggggaccatcaggtcgtggggctttcgcgggtggcccgcgtcagcgggttgctgtcgagttccagctggtcgcgcagcgcccagccgcgcagcttgccggggttaagcaatcccgccgggtcgagagactgtttcaccgccacgacgtcgggacgaatcacgccctgtttgccgtcctcaacctgcagcacgtgggggttgttaatcttgacgtcgttgtcgcgaaatatctgcatgatggcgttaagacgttcgggcgtggtatagcgcaccagctgcagaccgctggcggtgagattgccctcgatatcgcgcaggaattcaatatgggacatcacctccccggcgaagtgctgctccatctgtaaaatttgctgcggatagcgcagcggatcaaacgccgtctgcagataggtcagcgtattgtccaccttgagcgcatgcagggtggtgtggttccagcagtattccattaacgagccgttgcgcgtccgggcctcctcgctggcctgccggatggcgttgctcccgcgatggcgcggtaacaggctggcgcagagtccttcgctctcctcggcgatcaggctgataaccgcatgctgcccggcgcggtaacgatcgttgaggtggctaaaatagtcagcgatcggcgtggccagcagcgccacctggcgcttcaccagccccggcgagcggacgcaggcgttggcatagttcagcgcatcggcgaaatcgtcaaacacgtccagacgttcaatccactggtgcgcaggcgccagcgccagctcaacctccaggataatgccgttggtgccgtaggcgtgatgcagcagcagcgcttcgggagccgggacggtcagcacgcgggggaccggctcgacggtcattactttgacgctgagcacattgccgggcgccgccagcggcccatagttgatggagccgatgccgccgaacccgccgccgtagagaccgcccagactcgccagtcgataggtcgatggcatacagcgcagctcccagcccgtcgggcgggcggcggtttcgatgtccgccaggcgaatgccggcctgggccctcactgtgccgttgccgagggcgacgatctggttgagcccggtcatatccaccagcagcccgccttcgagggggaccagctgtccgtagttgccggtggcgctgccgcgcagggtcagcggcagctggtgctgcgcgcaggcggagaccagctggcgcagctcctcttcatcgcgcgggcgaaccactgcgtccgcctgtttccccgccagttgctcggtgagtagcggactgaaccagtgaaaatcgcgggagagccgtttgatcttcgccggctgtaaggtccactccagcgccgggagtgcctgctggatcgccgcgaccgcgtgttgacgctgttcatcagtcatcattctttttcctgttcgtcagcagaacattaatgagattgcacggcttcgctttcatgccaggcgctaagcgcccggcgcgaaacccaggacatcacgccaaacagcgcgataccggcgagagagatcagcagcagcgcggcaaacatcagcgggatatccagctggtagccggcctgcaggatctgataggccagcccggtattggtcccgccggtcccggcgacaaactccgccaccaccgcgccaatcagcgacagcccactggaaatacgcagcgcgccgaagaaatagggcagcgccgaggggatacgcagccgcaccagcgtttgccagcggctggcgtgattgaggcgaaaatagctcagcaggccgggggagacgctgcgcagtccctgagtggtattggagatgatgggaaacaccgccatcagggtggcgcacaccaccagcgagagcgtggcatccttcacccagatgatgatcagcggggcgatggcgacgatcggcgtcacctgcaaaaacacgatgtagggaaacagggcggtttccacaaagcggttctgcaccaggataaacgccaccgcggcgccgatgacaatcgacagtagaaacgagatcagggtgatcttgagggtgaacagcagcgccagcagcagcggcgtgagatgcgtccacaggctttccagcatcaccagcggcgacggcaccagaaaggccgggatacggaaatagctcaccgcgccctgccacaggagcaccatcgccaccgcgacgagggtcggatagagaattttgagaaaacgcggatgctggatccacggcgttgcggttgtatttttcatattatgactccataccggactggctggcctgcaacagactgtcctgcagctgacgggcatacagggaaaaggccgggctgacgcggaacgcctcgctgcgcgggaacggctcgcggatggggatatcttcgaccacccgtccgggacgggccgccatcatgatcacccgctgggagagaaacaccgcttcgtggatcgagtgggtgacgaacactaccgtcaggttttgctcctgccagagacgcagcaggtcgctgtcgagtttgttacgcgtaatttcatccagcgcgccgaagggctcatccatcagcagcagctttggtcgggtgaccaggccgcgggcgatggagacgcgcatttgcatgccgccggagagttcgcgcggcaggacgtcggcgaacttgccgaggcccaccagctcaaggacttcactcacccgggtattgccctccgcccgcggcacgccggccagatccagcggcagcctgacgttattgcgcacgctgctccacggcatcagggtggcttcctggaagacgaacgacagcggatgctgggccttttcccgactgtcgcgccgccacagcatcagcttgccgtcgctgggctccaccaggccggcgaccatcttcagcagggtgcttttaccgcagccggacgggccgagcagggtaataaactccccctgattgatggtcaggttgacgggcagcagcgcccgggtgccgttgctgtagattttctccgccgacagcacctcgatggccggggtggcagcggcgggtataaagcgggtatcgctcatcacggtcagtttcggggcggtattcatggcatcactccggcgtctttgaccatctccagggtgtaagtctgctcaaacggcaccttgctggcgtcgatcagtttgtttttcaccagcatgtcccaggttttcttcagccgcggctcggtgatgatgccgataccgccggacttagcatcgccgccggtcaccagctggtactgcttcatctgggcaatgccaaaggcgatctgctcggcgcccatctgcggattcgctttaccgatcaggctgttgccgggggcgggatcctgcaggtagcttttccagccttccatggaggctttgacgaaggccgccaccgccgccggacgtttgcggatggtgtcggccatacagataatcgagttgccgtagggcgggtagccccagtcgctgagcggatagacatagaacggctgtccgcctttggcgacggagaacggctccgaggtcacgtagccctgctgcaccagatttttatcggcgaggaacggctgaacgttaaaggtataggggcgcactttgctgccagccagacccagctcgcttttcgcccacggccagaaggaggtataggcctcggtggcgagcaggaaggttttgtctttaagttccgccgggttctccactttgtcatgggtgataaacaccgtcggcgagtgctggaacacggtggcgacggtcaccgcgtgcaccccggcctgccaggtctccagcgcctggccgttgtcgccaagggtgcagtccgcctgaccggccgccatcagctgcatgacgttgatctgcgggccgcccattttaatttcgacatcgagaccggcgtgttgatacagcccggtggcctgggcctggtaaaacccgccgtgttcggcctgggcataccagttggtgagaaaggtaaacttctccgccgcgaagcaggaggctgaggtcgcgagggcggccacggtcagcagggtaaaaacgggcgtcaatctggtattcatcagggctccctggattcagcagcgaaagaaggtggtagggactgcacaaagccgtgccagtgctgtttgccccaggtcggttcgcgacgttcgacccaggccatgcggtggatctcgatgatcgcttgcgcccagctggcggcgagggagtcgagaagcccttcgccttgctcccgcgtcgccggggtcgggtcgccaatcaccccgctggggccaaagtcatacgacgcccacgccgccgccggacggcctttcgacagggttgggcaggggaattccggggggaaattagcgacggcccgttccatatggacgcactccggcgccagcgccagcatcagcgccgtttcgctatgcccggcgtgcatcgccatccgctgttcatgcgggctgagaaactgtttttcgcagttgggcacgttgaacacgtcgtgggggatggcgatgaaatccccgtggcgcaggcgcatttcccggcaggctatctgcaggatctgcggctggccgccgtggccgttgatcatcagcagcttgcgaaaaccggcccgatagagagattcggcgatctccagcagggtatgcagcagcgtatcgccgctaagggtcagggtgccgggaaaatgcagatgctcctcggacttaccgtagacgatcggcggaatggcgtaggccgggatcgtcgccggcagcctggcgagggcatggcccgccacgccggaagatatcacgctgtccaccgagcagggcaaatgcgggccgtgctgttcgatcgccccggtggggaggacgataaccgtattgcttttatccggcagggcggccacgtccgtccagctcagaaaaggaagaaagcgcgcggcaggaatgtaaccgttaatcatcgcggtgcctcggagttaaatgacgggggtaaccagacggtcgcttcgacttcaatcagtaccgtggcgtcgggcagcatttcgctgacctgcaccacggtggaaacgggcggctggtcggggtaaaacagcttcctgacccggctgtaatagggaaaatggtcaaggttgcgaaagtactgcaccagtttgataacgtcgctcatttgccctcccgcggacgccacggtgcggcggatgctctccaggacgtaccagctctgggcgaggatcgggccctgtttcgcatcggttgaaaattcgccggtcgcccccagcagctcccgcaccggctcaggcacatcctgaaagccgttgacgatggtgccggtcaggggattgaccggaataatgccggagagaaagataaaatcgccggctctgcgccaggcggcataccgcgccagcggcgccccggcgcctgcttcaagactcatgtgccatctcctcctgccacacgcgtcggtgggttaacctgccgtggttaaccaccagacgggcggcgctgtttaaaggccaggtaaaacggtcgctacccgggaaaatcactacgctggccgccgccccgacggcaaagggcgccgcgtctgccggcgaaccggttagcgccgcgcgatcgcagatcagccgcgactgctggtcgaacaggtcgctgagctgagcgccgaacagaccgcaggccagggtgtccagcgggtcgtagctccccgccgggcagaaggcatcctgcacgttgtcgcagccgagcagggtggccacgccggcggcctgcgcctcgtgcagcagggtgatcccccgctggcgcggcgtgcggccgaacgtcgcatcctgcagcagcaggttggtcatcggcagagcgataagggtgacgccgtgcgccgccagctggcgcaggatcggcgccgcctgttcgtcgctgccggcggccagcgcgcagccgtggctgcagcagatatgtccgggaaaagggtggcgggagagatgatccgccagccaggtcagcccctgagacacttcgctgagctcctcatcgatatgcaaatccagatccagatcccagcgggctgcgctgcacagcagattttccatggcggcggcgtcccagttggaggagtggatgaagccgcccagcaggcagcgctctccgctgttggcgaccgtccgggcgatggcctccgcttgcgccagctcgcgaaacaagggcagcgggatcagcgccacccgctccagggtgatgccgacggtatcgaggcgggcgatctcctgccaggcgtccggcgcgtcggcggtaaaccagtcgacatggctgcgcaaatgggtcacgccattcgctgccgcccgggccagcgcggcggacgcccgacgttgaatatccgccctggtcc

SEQ ID NO: 90 - DNA, 6130 bp, Unknown
  source: /note="Description of Unknown: KP2-Mcoc1 Bacteria Sequence"
tttacgggcttcttgccctaacaggatcccggtcatctcaaaattggcgttagtgttagacatatattcaagcctatctcttatctggagatacagctactgtccggtgtttcagggggctacatcagttcgctctgaatcgctcctggttcagactgaatctgtcaagactgctgcaaagtcacatttgaatataggagacagtccatgtactaatgaaaatatcctacatcttcgggttgtagtatggccctatccgttgattaaagatgttggctacatcataaaaggagaattagcctgtagtgctctgtgggggagtttacgtcccaccttaagtctggaacattttgataaaaaatggacttcgcgggaaggagtgtggctttttggtattaagcttatggatgatatatccgtcaatggatatatttctgaaggtattatggtgaccctatcaccatttgtcttcagacgattcgaaactgatatgtattcaaaaaactttagcgctgttgtcggaaatagtaagcatgacaggcattacttcaatataggacctgatgctcctcttcttgatcggcatgatagcgttccactaaggtttagagtgtttagggcatgtagcctacattatgatctctgtgttgcaggaggtgggtattttacggggatattttcagagcactggagcatacaaatgttattagtaacagtgtcactactttccggtttaatgatttatattatcattatgaacagagcagaactcaatagttcactatctgcaaggtttgtaaaggctttgaaaaatgaagtcctgtcgctggtctatcaacctatttacagaattgaagacggacagatctgcggatttgaggccttgctcagatggaaagatgaaagactcgggaatattagccctgaagtatttataccgctttctgaaagggaagggttgcaggaggatgtgactttattcgtcattaaccatgctatccgagaatttatccatactgctattcagaatgaaatatttttgagcgtaaacattaatccaagcgatcttgattcagaaaaattcagggataaactactaggattaatttctgaatataacatcccatataaaacaatccttcttgaaattacggagcgtcaaggaggggattttgaaggtatgaaaattcacattgataaatataaaaatcatggtgtcaggtttgccatcgatgactttgggacaggatattctaatcttaatctggtaactgcgcttgatgtagatgaaataaaaatagacaaatcgctaactagtgctattggtactgaatctttacgatatgatcttcttcccggactgcatgagatgttccgctccattgcagataagattgtgtttgagggtgtagagactcaggagcaggtgaactatctgaagacgttctggccacagagttatgctcagggctggtattactccagagcgcttccgctggaagaagcgagaaaacttaccatccgggaattgaactgaccggcactttcagcgcaaacactcagcaattgcttgccgatcagctggtagaaattgaagggcagtgtaatcacctgctgctggcgcaggggaaagcgttactgaaaagtcgttctgaactgcttaaataacagagaaaccaggatgtgatttgatgcaaaacacggaacagcgaatgtaatatttactgagatgagcgagctttgtctcatagtacagaggagtcggggctgccagtatccggtagacagcattattcgtctgcaacataactctgctggttgctgcggataactactcagcgccttccagagatggcattgatgaaagtagtagaaaaaacctggaatctttgaagatgtgtccctacctcagggggctggagtgccatctggccctaattcagcacagtgctgcagatatgtgttatgtacaagtagacactgtcttgaaaatcagaagtcgttgagggttgaatgcaattccaatatttgcttcagcagataacgaggaccgctatctattgcatctagtgaataggaagccgtttccatttttctctaaagcaactggtgttgacatcctgaattccttcaaatgtctgatattccttttttcaaagcactagaaaaatacccgaaagctgttaatctaatacattgactgaccatacagtacagcgttattttgttgggtttacttcacgtactttttattgtcggatactgttgggaaaagacacaaagaagcaagccattaagcggaatactgcgtagggttagaatatacaattaacttttccgtgataggactagtgataacaatatttccagcatgggctgacaggagtatagatggaactgctctccataggttaatacatctcgcaattaacacgcccgcatatgccacaaaactgacgcccattctcggaattttttttgccattatctttcctgcggcctaattactttccccacaactatggttttttattagagtcttcaccactaaataaattataataaattgattttattagacatctgtcagaatctatatggtcagcacgtattgcatgctctaatgtttcaaatgctaaattatgcgcggcctcagaaaatatcccaggccaacccttactcagcatagacagtcctttaaggactcttatctgtatctccctcataccggcaccatcgcgcgcgacaggtgagaaaaagtcttccagtagatcgttattctgaagtggtgcaacatgaactgaaggatatttcacttctatttcatcagatttattctgcgcgtaagtggaaagtatacgaacacctctgccaatgacatcaatggcggttccaggatcgttcactgcgggggaaagtgcccggcaggctatttcggccatgacgctaagacaaaatcggggatcctgagcaaatgaacgtacatccgagacaataatcgtctcaagtaaatcggcgctgattgatgactcctggccttgactcaggtacaaaacgggcatggatggatggatgaaactgcctggctgcgccacgaggtatacatgacggggatcattggtcagcagcttgctaagtttcaccatattaatatattcaacatagccaatcttcttcggataaactgcaaccgttcctttcggctgttcattgttctcaagccatggatatccgccgagacagggatttcttgctctcgcaataaatgtttcgatggccgcctgttctacttttgccgttgtctcacctacccttcccagagaggtcaaatgctgtatccagcgaagcaatgtgatgaggattaaggcaatgacaaccagtgtgacaatgaataaaatgactctccccctttctccataagctcccatactgagggcaataatccctaccagactgaagagaaaagaaccgatgaaggtggccagtacattttgtgtggttacgtcttcaacaactaaacgcgtagctctgggagtcacattagtagtggctgaaccgtaggctgtgaccatgatactcaacgaaaaagtggtcactgccagcatactcgatgccagtatgttcagaatgttatcgactgcttccgcaccaaccttcacggaaaccgactcaggtatcattgatttaaaaagaattgataaaagggccgttattatcgcgacaatggcgaataacgttgccctgaaccatagctttttaactgtctgcttcagaatccatttccagcgtgaaatcattctgcattcctcatattgcggccgggataaataattgccgcccccaggacggcatgttgctattaacgaacgaggtgcaggaagtgcagatgtttttcgtactggtccagtatgtcattaatcagctgctcctggttccagcccatcacatcataattttgaccgccttctttgagatatacctcagcgcgataatatctatgttgttcagtctgctgctcattattatccatcgcggcgagcgcgaaggtcggtgagctatacccgcgaagcctcacttcatatataaaattcagctcgttacccaaatcgacttcaagacgaatacgatcctcgactgcgtcactgatgtggcttatcgtcccctgcttgttcagctcttcctgaaccagcgtcatggcgggctggatgacgtcgtccataaaacgtttcacaagagatcgcttcggcagatacgcgatattgcgtaaccttctctgccagggaattgggttacgtgcagccgtaggagcaattgtcgccatgctcaggctttcacgcttggtcaaatcccggcgcaaagcttttaaaagtccgtatatggatatcagtaagatcactgagaaaggcaatgcactcgctattgtcactgtttgcagcgcacttagccctccggcaaggagaagcgcaattgcgacaatgcccatgagcgaggcccaaaatattcgctgccagacgggtgtgtttgccactccacctgttgccagagtatcaactaccattgcccccgagtcagcagacgtgacaaagaagacgatgaccatcgccattgcgatgaatgacagcacggaagagaacgggaaatgctccaggaaattaaacagggccagcgccacatcctgctgaacagtattggcgaggtctgtggccccctggttcataatgagatagatcgcgctgttaccaaacactgtcatccacattagcgtaaaacccgcgggaacaaacagcacgccggtgacaaactcgcgaatggttcgcccgcgggagacccgtgcgatgaacatccccacaaacggcgaccatgaaagccaccatccccagtacagtaatgtccagccccccagccatttgctcgacttaggctcatacgcgtaaaggttgaacgttttactcaccagttccgaaagataaccgcccgtattttccacaaatgacttcagcagaagcacggttggtcccagacacaggaccagcgccaggagcaacaacgccagacccagattgagctcagacaggatacgtattcccttatccaggccggacaccactgaaatcgtcgctaaccccgtgatgaccacgatcagaataacctgcaccgtttcattgatgggcaccccgaaaagatggttcaaaccggcattcacctgcaaaacgccgtaacccagcgatgtcgcgacgccaaagaccgtgcctataacagcgaaaatatcaaccgcatggcctacaggcccgtatatgcgatcgccaataatgggatagagtgcggagcgcagagttaaaggcagaccgtgacggtaactgaagaacgccagaatcagcgccacaatggcataaattgcccatgcgtgcagtccccagtggaagaaggtcagacgcattgcttccttggctgccgcaacggtttctggcgtgccaacgggaggcgaaagataatgcattacaggttcggcaacgccaaagaacatcaggccgatccccatccctgccgaaaaaagcatcgcaaaccaggaatggtagctgaaatcaggctgcgcatggtccgggcccagcttgatatcaccgtagcgtgagagtccaaggaacgtgacacttagtaaaatcagggccacagcaaggatgtagaaccagctggcattcgtgaagatttgttgctgtagtagtttaaaatttttgtcggcgacatccgggaatacggcggcaaaggcgacaagaaggaaaattagcaaagcagatgtaaagaataccgctttgttaatctggcttgtagacttcttcgggattgtatcattatcactcataatcatttattccattaattaaatccgcactggatagacggtactacctttcacagagtagcaaagttcaactggctatgcggcgttaatcggaacgcatggtgtaatgagttccgatacaaatcatccgatattcggtaatgactccaacttactgatagtgttttatgttcagataatgcccgatgaccttgtcatacagctccaccgattttgagaacgacagtgacttccgtcccagccttgccagatgttgtcgcagattcaggttat

SEQ ID NO: 91 - DNA, 4632 bp, Unknown
  source: /note="Description of Unknown: KP2-Mcoc1 Bacteria Sequence"
ccgggagcggatttgaacgttgcgcagcaacggcccggagggtggcgggcaggacgcccgccataaactgccaggcatcaaacaagtgaagagcccatcctgccggatgggctttttgcgtttctgttgtccggccagcgtgccggtatgtctccccggtggcgctgcgcttaccggggctacgggcctgtcgcgttctgtagcccgcaccggtacaccacatcaccaccggtaacgccccgcaatatcattgcccctgtaatcagacaagccttcccccgccagatacgataaactaacgccgattttgcatcaggaagccactatgaaccactccctcaaaccctggaatacctttggcattgaacgcttcgccaagacgatagtacgcgccgaaactgagcaacagttgctaagcgcctggcaaaccgctgccgcggcaggcgaacccacgctgatccttggggaaggcagtaatgtcctgtttctgaacgactatgccggtacggtgatcctcaaccggattatggggatcgaggtgagcgaaacgccggaagcctggcgcttgcacgtcggcgccggcgaaaactggcatcagttggtgcagttcacgctacagcatgcgatgccaggtctggaaaatctggcgttaatccctggctgcgcaggatcttcgccgatccagaatattggcgcctacggcgttgagctacagcgggtttgcgaatatgttgactgcattgagctggaaaccgggcgtaagcaacgtctttcagccgcggaatgccgttttggctatcgcgacagtatcttcaaacatgaatatcaggaccgctatgccatcgtcgcgattggcttatcgttagcgaaaacatggcagcctgtactgagttacggtgatttaacgcgtctcgatccgcagaccgtcacgccgcagcaggtatttgatgcggtctgtcatatgcgaatgactaaattgccggatccaaagattaacggtaatgccggcagcttttttaagaatccgatcgtcagcgctcaggttgcggaagcgctgctggcgcagttccctcatgcaccgcactatccgcaggcaaatggcagcgtcaagctggccgctggctggctaatcgatcaatgtgagctcaaaggacaacgcatcggcggcgcggccgtccatcgacagcaggcgctggtactgattaatgaagatcgagcgaccagcgaggatgtggtgaaacttgctcattatgttcgccagcgggtgggtacgaaattcgatgtatggcttcagcccgaggtgcgcttcattggcacgcatggtgaagtcaacgcagaggagagcattgcgtgaaagaccatactatccctttaacgctaatttctatccttgctgatggtgagtttcactctggcgaacagcttggtgagcagttaggcatgagccgggcggcgattaataagcacatccagaccttacgtgactggggcgtcgatgtgtttactgtgccgggcaagggttacagcctgccggagcctattcatctattagatgagaaaaagatttctcaagagatagaccatggccgagtgacggtccttcccgtcatcgactctactaaccagtatttgctggacaggcttgatgagctgacgtccggagatgcctgtgtggctgaatatcagcaagcagggcgaggccggcgaggcagaaaatggttttcgccctttggcgcgaatctctatctctcgatgtactggcgtctggagcagggcccggcagcggctattggcctaagcctggtgatcggtattgtgatcgctgaagttctgcagcagctcggggccgaacaggttcgcgtgaaatggccaaacgatatttacctgcaggatcgtaagctgtcagggatcctcgtggaactgacggggaaaacgggcgatgccgcacaaatcgtcagcggcgcgggtatcaaccttgtgatgcgtcgcgtggagtctgatgtcgtcaatcaggggtggatcagccttcaggaagcgggggtggtcatcgaccgtaacctcctcgccgcgcgcctgattaaagagctgcgcctgggactggagctgttcgagcaggaaggattggctccctatctaccgcgctgggaaaaactggataactttattcatcgcccggtgaaactgattatcggtgataaagaaatttacggcatttcgcgtggcattgacgcccagggcgcactattgctggagcaggatggtgtaataaaagcctgggtgggtggtgaaatatcattgcgcagtgcagaataaaaaagggagcttcggctccctttttttatttacgtaagcgtacctgattcactgagtgattggcgctcttagtcatgatcaggctggcgcgctcgcgagttggaaggatattttctttaagattcattaggttgatttcattccatagcgaagtggcaatatctaccgcttcttccttcgagagcttagcgtaattatggaaataggaatccggatcggtaaacgccccttcccggaatttaagaaagcggttgatataccagcttttcaataattcttccggggcatcgacataaatagaaaagtcgacaaaatcggaaacgaatacatgatggggatcgtgcggataatccattccactttgcagaacattcagcccttcaagaattaaaatatccggttgcgcgacggttttgtcaccgttgggaataacatcataaatcagatgggaataaaccggcgcggttgcctgcggtacccctgatttgagatcggagacaaacttcaccaggcgatgcatatcataggactgcggaaagccttttttcttcattaacccacgttcttttaaaaccgagttagggtgcaaaaaaccgtcggtggtaatgagttcgacatggcgatgctccggccaacgactaagcaaagcttgcagaacgcgggcggtggtgctttttcctaccgcaacgctgccagcgatactgataatatagggaattcgctgaccattggtgccaagaaattgttcgagaacagcctggcgacgcaggttagaactgatatagaagttgagcaaacgcgacagcggcaaatagatctcggcaacctcttccagagagagatcttcgttgatgccttttaaccgcgtgatttcttcctcggttaacgtcatcgggacagaatcacgaagtgcagcccattggtggcggttaaattgtaggtacggtgtcattaacgtctgctctttttggctcataagcatgttcttactatcaccgaataccttgaaacggtgatgcttcacacgagttaatcaggacaatgggcaggagggtaacaccagattgccgggaataataagaaaaaaactcattgaatgctgctttctcgcgccagcatcacaagagaagaataagtttcttatgctttgcaaagcatggcctttgctaacaggctaggctagcggcctgaatcctttccgtcagcggtcagcatgcgatagaggtaaccggagatgatcggacagcgcctgaagcgccgaattgttggcgaatatttgcactccgctgcttgaaattacaccgttttttcgcgtgagagcacaaaatgtgagcaagagaacgttttatgcaaatttttagttgcatgaactcgctcctctccctagaatgcgcgctacttgatgccgacttagctcagtaggtagagcaactgacttgtaatcagtaggtcaccagttcgattccggtagtcggcaccataacaatttgggtggggttcccgagcggccaaagggagcagactgtaaatctgccgtcatcgacttcgaaggttcgaatccttcccccaccaccactttctggcgacgctttgcggagccggagttggttgggtaaactaatcagctcaatactaaagagagcagtctctttagtattacagaaagaactgggtagccgagtttcaggatgcgggcatcgtataatggctattacctcagccttccaagctgatgatgcgggttcgattcccgctgcccgctccagacgtgctgatatggctcagttggtagagcgcacccttggtaagggtgaggtccccagttcgactctgggtatcagcaccacttcttttctctccttccctgtttctcttctgttatgttcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgccatcactaccgtactggctaaaacctatggtggttccgctcgcgcattcgaccagatcgataacgcgccggaagaaaaagctcgtggtatcaccatcaacacctctcacgttgaatatgacaccccgactcgccactatgcgcacgtagactgcccgggccacgccgactatgttaaaaacatgatcaccggtgctgcgcagatggacggcgcgatcctggttgttgctgcgactgacggcccgatgccgcagactcgtgagcaca

SEQ ID NO: 92 - DNA, 3485 bp, Unknown
  source: /note="Description of Unknown: KP2-Mcoc1 Bacteria Sequence"
gactataacggccaggatgtgtgcggcattacggtgcactttttaccctgcgatgacgtgaaggtgaccaccagctgctggtcaccgagaaatgcgaactatccgataaaagagcccgtcaggatgaaggagcccgccgtatgtccgaagtagcacgccttcgtttccccggggtgacatcaccatcccttcattaccctcaaccgacagggagagtccgatgaaatctgcattaatcagcccgctgctggcgggtctgctgctgttaaccggctgcgcgcagcctgccgcacaggccggaggcggcggtggcggaacaataaaagccatcaaccacaccaaatgggcgatcaaccacttcagtgtcaacggccagtcgggcatcgattcaataggcccgtttcaggggggcggaggcggctgctgcttcagcgtgcccgcccgctggacgccgggtatgacggtgcgcgttgaatgggaaaccgggcagggttcatccgcgggtttcccggggtttgctgatgaggcgaaataccttgcctggaaaaaagggattgatgcccaaaagaggcagcacagcaaaaccgttccgctgcccgactataacggccaggatgtgtgcggcattacggtgcactttttaccctgcgatgacgtgaaggtgaccaccagctgctggtcaccgagaaatgcgaactatccgataaaagagcccgtcaggatgaaggagcctgccgtctgtccgaagtagcccgccttcgtttattcaggatggcatcaccatcccttcattaccctcaaaccgacagggagagtccgatgaaatctgcattaatcagcccgctgctggcggggctgctgctgttaaccggctgcgcacagcctgccgcacaggccggaggcggcggtggcggaacaataaaagccatcaaccacacaaaatgggcaattaaccacttcagtgtcaacggccagtcgggcatcgacattataggcccgtttcagggcggcggaggcggctgctgcttcagcgtgcccgcccgctggacgccgggtatgacggtgcgcgttgactgggaaaccggggtgggggatatggaaggatttcctggctttggcaatgatgaaaagtaccttgcctgggctaagaaaatgaaggcccagaaccggcagcacagcaaaaccgttccgctgcctgactataacagccaggatgtgtgcggcattacggtgcactttttaccctgcgatgacgtgaaggtgaccaccagctgctggtcaccgagaaatgcgaactacccgataaaagagcccgtcaggatgaaggagcccgccgtctgtccgaagtagcccgccttcgtttattcaggatggcatcaccttcacttaatcaccctcaaaccgacagggagagtccgatgaaatctgcattaatcagcccgctgctggcgggtctgctgctgttaaccggctgcgcacagcctgccgcacaggccggaggcggcggtggcggaacaataaaagccatcaaccacacaaaatgggcgatcaaccacttcagtatcaacggtcagtcgggcatcgacattataggtccgtttcagggtggcggtggcggctgctgcttcagcgtgcccgcccgctggacgccgggtatgacggtgcgcgttgactgggaaagtggtgaggcatcgactgaaggttttcctggatttgctgattcaaaaaaatacagagagtggagagataatttaaaacaaaacaaccgtcagcacagtaaaaccgtcccgctacccgactataacggccaggatgtgtgcggcattacggtacactttttaccctgcgatgacgtgaaggtgaccaccagctgctggtcaccgagaaatgcgaactatccgataaaagagcccgtcaggatgaaggagcccgccgtatgtccgaaataaccgaaattcatgccgcctgggtcccgccgccgtttccgccgcagggacgtctgccgggccgggcgctgcaggttgggcagaactgccatcagcagaacagcgacgagcggcgctatcaccaggaactgtgcctggctgccggacggcgcgtggagccgccgtgctgcaagacgctgcatatcagcctgtttttcgacggtaccggcaataacttaaatcatgacttttttatcgcgaagccgaaacatccgaccaatatcgcccggctgtttcgggcgactattggaacgggaacggctggcggggtgccgtctgacgatcagagcaagttgtttgatgatgacggcgggggagacgggaaatattttaaattctatatgcccggcgtgggcaccccgttcccggaagtgaatgacccggactattccaccatgggtctggtgggggcagtcaagggggaggatcggattaactgggcgctgctgcgcataatcgatgtgctgatgtttagtgccaccgaaaaatggctgaccaccacagagagtcgtcgttcactgaaagaaatgagcaccagctggaaccggctgtggtttggcggcagccataaccgctatgaagagttcactcgcttgctgaatggtcttgccccgaaactgatgccgatgctgattcagcctgaaccgggcaagccgaaactgacaggcatcaagctgtatgtctatggtttttcccgcggcgcggcagcggcgcgcacctttgtgcgctggctgagcgaactgctgccccctccggcggcggagggtgaaaaaccgccgcagtgcctgcagacaggcgggatgcagctgcccgtcagcgtggagtttctcggactgctggatacggtggcctccgtcggggtggcgcatgtggtgccggttgccgacgggcatatgtcctgggcagacggcacgatggagctgccggatgatgaaacctatggcgggctgataaaaaaatgtgttcacctggtctccgggcatgagcagcgtctctgctttccgctggactcggtgcggcgggcaaacggcaaatacccgccctgtgccagagaggtggtttacccggggatgcactcggatattggtggaggatatccaccgggggatcaagggaaagcgaatggtaaagatgatgcattattgctgtcgcagattcctttgaacgatatatataccgctgcttttagcgcaggggctccattaaaagtaccacaggatacgctgccagagttttttaaaaatgatgcctggagaaaaatgccattagatttgttagatgcgttttttgttgatgaggctctggtcaaccgcttcaacgcctggcgcgaactcaccctgggccaaaccacgccgaaaacgttcgatcccgaagcagcctctcactacgaaccacctgccgccggcggcagtctggaaaccgtcattgctgagcagatggcctggatcaccgcctggcgcatcgaccgctatgccagaggctcgatgctgaaaacgccct

SEQ ID NO: 93 - DNA, 3053 bp, Unknown
  source: /note="Description of Unknown: KP2-Mcoc1 Bacteria Sequence"
tactggctttataatgaccgttttccgccgctatccggtacagacgggcaatctccgcatccaccgttttatcccggttaatcagattatttttttgccgccagcgggcgtatttaaacaggacatcagtatcagcagacgcctcaggaataatctggtgtttacaggtaaacgccaggcgggtatgaatatcggtcagcgggttcatcggcgcgtccttgtgggtattgttctggtcacaggcggtcagtaccatgcagaataaaagtaagagtcgtttcatcaatccagatcgctcagcgttgatttgttgtaaaaaaatttaatcagcgatgctacgggtttgttctttttagtgccttgtaaatctttattttctttcagaatataaccccattcctcaaatgccttcgctggatcatcctgcccccctcgtccgttagtatgcatattccataaccgccgtcgtaaatcccgcgtcacgctggcccattcatgggcaatattcatttcactgtccacccgcatactgcgcgtgttgatattcgctgaaccgtgggtggtaaatacatcattcacaatcatcagcttcgagtgaatatataccggcacccattcctccggtggtgagtccggagccaccagcgagcagatatgaaccttcagtccggggcgttcctccggcaggatttcactgctctgaatttcatcggccttctttttaaaatcagcaagtttctcactcatctcgcgattacgtttattgatatctccggggtcgatataaccaacagaaccaccgaacgttgcgttgctgagttgtccgatcttacgcagtttagtcacttcagggataatgtttgctcgacccagcacctcaagcatccgctgggtattcaccgtacccgccccaatgccttcatcggttacgttagtcacaacaaacaaatgcagttcgcgtcccactttactctgtctttccgcaacctgattaattaactctgccagcggcggccagcgaaaatactgattttcgatatagataaactgcgtcgcattatttacggcctgcagataaagcgtttcaatatcatgctttcctgcctgcgcctgagtgcgcaacagttgcgccatcaccggcgtaccgtgtagcgcacgcagtttcagctttttcgcgatggacacgctatcacgaatagtcagcagatcctgaccggtttccttctcccacgccatggcaaaattatgatgcagatgctccagaatcgggccggttacccgactggagatatcctgccgcggcagcttaccgttagcgcctaagcggggatccatattattgcccgggcgaaacagtgcagaatgtttatccgtatcccagtactcatcaagcatgttgtgacccataacaaaaccaaccgcagactccggcagttcgtagtcaaccagcaccgttttttgatgatgggtcacggtacctgcaagagtaagcatcgtgtcagggctgatatccggatcaagcgccatattcgcagcgcgataggcaatttcagctctctccaggaaattaaacccgcgcccgacaaacaaaggagaaagtgagcttaatttctcttgtcgttgcgctatgggtgcggcagcaatttccgctatcccggcctgtcccttttttaactgatgatcggaccattcccctgacagagaatactgactgaaccattgtcggtcataggcataacgttcatccgtagtactctggcctttccggtccttataacgaatgactcccttacccggtaaattggcctctcctcccacacctgcggcattacagggcatttcccagcccagaatacgcacctggactttttttgtttccgcaatcttgcaaagtaattcgccgatacacagcgactgaccatcacggataaagtacatcgaaggctgaaatccccagcaaataatatccaccgttttctgtgcattcatgatggcatgataaacggcagcaaacgcttcttccccgtttaccagcggcttataggtcgccggcatcggtgagtattctgtattctgcacaaaccagggagaggtgatcatacattgacgggtgtcaaccgtggcaatcggggtaataatgtcttcctgagtcattatattttatccttttaagtgagacttttgccattcagcgaggaaattaccgtcgtggcagtctccttatttttatctttccgttataagttttggtttcagcgtctttattgcaggactttctttctgtttgtgatggttcagggaccgggcaggaaaaaacgctttttactggccagctgacctgttgtatttcccggagtccggtgacgtcggcagcggcctgcccgtcgccgggttcagttgtttcgctttcgcaagtttctctatcagcgctgcgctgggcttcggcggcggcacattggcctcgcgctcttccagccatttcagtttgccgtcccactcagggagcagcgcgggtggtagcgggacgatatcattgatttccgggaccgtggggctggcgtaggaataattgctcaggatcttcgctatctgtttatagcgcctggcacgttccggatccttctgctgagccagataatagagcctgtctccaggttcaggaccactaaatccatttgctaaaaacctcgctgaactcccgttacccgcagcgactcccaactggaaggcttctattgcactctgataatcctctttaccttgtaaattaatacccagcattgccgccgccttcccctctccctgctccgcggcgcaacgacgcatctggtgcgcaatattgggcgccctgtccaccggcgccagcttatcccccacatatgcctgcgcctgcggattgccctcatccgccgccttacggtaatatcgcagggcaagcgccggatcctgctgcagccccgcgacgccccgttccagatagatagcggtcagatagtacccggtcgccaccccggcagcgataagctgctggctcagccggaactgctcatggc

SEQ ID NO: 94 - DNA, 2873 bp, Unknown
  source: /note="Description of Unknown: KP2-Mcoc1 Bacteria Sequence"
aacgttccttcaggagacttaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcaattctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctagcttatgccattgcactaacctcctgatgtccgaccaggattagctaaccttcgtgctcctccgttacgctttgggaggagaccgccccagtcaaactacccaccagacactgtccgcaaccccggtcaggggccaacgttagaacatcaaacattaaagggtggtatttcaaggttggctccacgcagactggcgtccacgcttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttacggataaccccatcaattaaccttccggcaccgggcaggcgtcacaccgtatacgtccactttcgtgtttgcacagtgctgtgtttttaataaacagttgcagccagctggtatcttcgactggtctcagctccatccgcagggacttcacctacacaccagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttacttcagcaccgtagtgcctcgtcatcacacctcagccttgattatccggatttgcctggacaaccagcctacatgcttaaaccgggacaaccgtcgcccggctaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgtagtttgcatcgggttggtaagtcgggatgaccccctagccgaaacagtgctctacccccgaagatgagttcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacacccgaaggtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcttcgagttcacaacctgtgcattttggtgtacgggactatcaccctgtaccgtcggactttccagaccgttccactaacacacaagctgattcagactctgggctgctccccgttcgctcgccgctactgggggaatctcggttgatttcttttcctcggggtacttagatgtttcagttcccccggttcgcctcgttaacctatgtattcagttaacgatagtgcaacgaattgcactgggtttccccattcggacatcgccggttataacggttcatatcaccttaccgacgcttttcgcagattagcacgtccttcatcgcctctgactgccagggcatccaccgtgtacgcttagtcgcttaacctcacaacccgaagatgtttcacttctgattgcgaaaatttgagagactcgaacacac

SEQ ID NO: 95 - DNA, 2314 bp, Unknown
  source: /note="Description of Unknown: KP2-Mcoc1 Bacteria Sequence"
cctttcgggttgcgggggtgcggagatgggtataagatacctatcctggtctgccgcctgctgccgtttgtcccgtttgacccggtcagctatgccgccggactaacctcgctgcgcttctggccctttatgctggccaccggcgtgggccagctcccggcgactatcgtttattcctgggccgggagtctgctcaccgggggcaccttctggctggccaccgggctttcgctgctttttgccctggcggtggtcatctctatcgccaaaaatatttaccgtgaacgtcataagagatcgtcgccatgagcttacccccgctggattctgtccccctgatccttcgtccgcaggcctggctgcaccgccggcattacggccaggtgctgagccccattcgctggtggggtcggatcccgtggctgttttacctggtttcgctgttcgtgggctatattgaacgccgccgctcgccgctggatccggtgctgcgctcgctggtcagcgcccgcatcgcccagctgtgccactgcgaattctgtatcgatatcaccagcatgaccctcgcggcgcggagcgggagccaggacaagctgctggcggtcgccgactggcgcagcagtacgctgttcagcgaaaaagagcgcctggcgctggcctatgccgaagccgccacccagacgccgccggcggtggatgatgccctgcgtagcgcgatggccgcgcattttgacgcccgggcgctcaccgagctgaccgccctgatcggcctgcaaaatttatcagcgcggttcaatgccgcgatggcgatcccggctcaggggttgtgccagatacccacctcttcctcgcagaataaggagtaacgatgcgccgtttgcgtgattacagcctctgtctgtgcctgctgctgctctggccgctggcggttaatgccgacgacagctggcggcagattcagacggaagctcgcggacagaccgtctggtttaacgcctggggcggcgatccggccgtcaatcgctatctggcgtgggtcagcgaagaggtcaaacgctattacgcaatcgacctgcgtattgtgcctgtcgccgacgccgccgacgcagtgaaacgcatccagaccgaggcgcaggccggtcgtcgccagggcgggtcagtggatctgctgtggatcaacggcgaaaactttcgcacgcttaaacaggccaacctgctgctcaccggctgggccgaatcgctgcccaactggcgctatgtcgatctgcaaaagccggtacgggaagatttttcagtcgccaccgagggcgcggagtcgccgtggggcagcgcccagctgacgtttatcgcccgccgcggacaaacgccgcagccgcccaccagcccgcaggcgctgctggccttcgccagagcccatccgggcagcgtaacctacccgcggccgccggacttcaccggtaccgccctgctggagcaactgctgatcgcgctcaccgaccagccagccgccctgcgccagccgccgcagccggcaaccttcgcggcggtcaccgccccgctgtggcgctatctcgatgcgctgcacccggccctgtggcgggcgggcaaggatttcccggcgtcgccggcgcggatggacgccatgctcaaccagggcaccctccgcctgtcgctgacgtttaacccgctgcacgcccggcagaaagccgccagcggcgaattaccgacggacagctacagcttcggctttaccgtggggaccctcggcaacgtccatttcgttaccatcccggctaacgcccgcgctgtcgctggcgccaaagtagtggccaatttcctgctctcccctgaggcgcaattgcgcaaggccgatgccgccgtctggggcgatccgagcgtactggatccgcagcgtctgcctgacggccagcgccaggcgctggcggcagccctgccgcaggatctgccgccggtgcttgccgagcctcacgcggcatgggttgacgcgctggagcaggaatggctgcgccgctacggtacccactgatcctgctggcctggggggcgatggcggcgatctatctgccgctgctccccgccgccggggaactggtgggcgctgcgcgctcctgtcgctgatacccatctgccgcttcctatgaagatctgagggtggagctcgctggtcacattaaaattcaaaaaaacaccaaggccacgaacaaacgcacaccgcacacaagcacacaccacactaccagaacggcccacggacacaaacctcacatgcgccacagagcatctcacacccgcc

SEQ ID NO: 96 - DNA, 1788 bp, Unknown
  source: /note="Description of Unknown: KP2-Mcoc1 Bacteria Sequence"
ttcacgcattacaatgaaaaccacccgcacagcgcgctgggatatcactccccgagggaataccggcggcagcggacatcgttaacttaagatacaaaagctgttcggagatggagggtcaagatcagcgattcagagcgaacaagcacatcggaagtatagtctttaattttatcccgaaaaatcaggtaagatacgctctcagataatacaaaaaaaatataccagctgaaagaatcgataaagagaggactgatagattatgtatccactttccagggctaatcaaacgttccagcttacgactaaccatgcagatctcccctcaaattgaaaagatataaagctatattttcgccaacttcactgaccgattagctggcactgaacatactattccagtatacctattcttgccttactcatcccgggtatgaatcaaataatgtgacatggttcggatagatactggttatgatttacagagataattcatgcgttattaatagcctcgtgaaggctccagatgcatggtgcaacttttaagcgatgcatgtaatgcggttttttacccactagtatagaacgaatattcatttcttgctgggcgatcgcacactaaggtgtacaccaaaataaagacactcttttttgaaaaaaaaagagtaaaatgttgtgtgacatcggcattacaaaacgaaaattcatgttataatcgggttattattgataatgttacgcattgcaacgtgtaaccggatatctgcatttgggtgaagatagcttaagatggataaaaaatatgatttttcgctcagttatgaagccttaacacgggtatgtgaaaatgcaatatgtgaacatattcgcagagcaggttctctggaagggttaggtttcgcacttgaatatacaaaggcctatgctatcctggaagtatggtctctgctggcagctgctggcgatacatttccagctctcattgagaaagacagaatatatctgttgcaactaatttccgggaaaaataatatagagctacattaaatcataaattatttggcagaacatctccgtttttacttaacgcccgccggaatcactgacgtgaggaaaatgaaatttgttgtgcaataataattctgattattctggtcagtcggattggccgtagagtttcagtattcttgtgcgatgacaaggcgggataactaccgtcatcgcgccctgtctggaatcaatgacttcagttttagatataaagaaaaaacaatatacacattagataaaagtgagaaaaactcgtcctgtataacatcaggtagagtaaagcatttatcattaacttactgaagacggaataactacatttatacccgaaagctattctctttgaatctactttagatttctattatttctgattgccataggcttttttacagtaccctgtgatttccttgacttcactttatattttattatcatcccatataataaaaccagcgaaatagacaaaacaacatacaataacataaaaatacctgtgttaacaattaaaaaaggagattaggtcgagtccgtgagtgattttaacatatacgcgaattgatacaactcatatgtgctagccagtttcatctttttctttatttcttttataggctttgttgaataaatcagatttcgggtaagtctcccccgtagcgggttgtgttttcaggcaatacgcacgctttcaggcatacctgctttcgtcattttgttcagcgctcgtaccagggccat

SEQ ID NO: 97 - DNA, 1741 bp, Unknown
  source: /note="Description of Unknown: KP2-Mcoc1 Bacteria Sequence"
ccggaaatcaacgatatcgtgccgctgccgccggccccgctgccggaatgggacggcaagctgaagtggctggaggaatgggaggcaaatatcccgccgccagtgcctgatgcagcgctgatagagaaactggcgaaagcgaaacagctgaacccggcgacgggcaggccgctgccgacgtcaccggactttgagaaggacagcgtggcgcggctgcagtgccgcagcggtgagccctgcccgcaaagcggctactggcagccggcgtggcggccccgtgaaggaatgagcgaacatgccatccgttatttccgcgagggagacatcatgccggtggagaaggtgaccttcgttcgcccacgtccctggccgctgcgcgacagactggtcgtggaagcgcaggagacggtgtggcgccgtgtcggcgaggcataagctctgcagaagataaggaaaaggagagcgtcagggaatgaaagggataacgacatggatagtgctgggcagcctgctgctgtcaggctgtgaccagaaaagcatccacaaggatgtgccggtgaacccgctgaccgatattaatgcccgcctggcgtttacctgtaaacatcagattattcctgaggcatctgctgatacagatgttctgtttaaatatgcccgctggtggcagaaaaataacctgattaaccgggataaaatggtggatgcggaaattgcgcgactgtatcgcatcgcggcggaaaacgggcattacaaagccagtattaacctgcagaacggtgcgctgcgcgggcgtttttcgctgagcagcactgaacttttgcgtctgagccaacaactgattgatgcgaaggttgccgccggctactactttattgccatctatctggagcacggtgcggcaggactggcgaaggatccagagatggcgctgcgctactatcgtaaggcggcagatgaagggaatccccaggcccaggcttatgttggtgaaaaactgtttccggccaaaatggcaccacaagtggccatgcagatgtttcaatgtgccgctgaacagggggaagggaaagcagctaattcgttaggaaatatgcttgcaatttacaaaaaatatccggaggcagttgaggttttccaactgggcgttgcagcaggagattcaacctcagccggtttcctgatgcacggattctccggacctgaaccaacggacaggctgttctatctggcattggaaaaggatcccgagcgtgcccgtcgttatgagcagatagtcaaggtcctggcgaaatactcatgggcccatcctgtcgtcccggaaatcaacgatatcgtgccgctgccgccggccccgctgccggaatgggacggcaagctgaagtggctggaggaacgggaggccaatatcccgccgccagaacccagcgcagcgctgatagagaaactggcgcaggcgaaacagcttaacccggcgacgggcaggccgctgccgacgtcaccggactttgagaaggacagcgtggcgcggctgcagtgccgcagcggtgagccctgcccgcaaagcggctactggcagccggcgtggcggccccgtgaagggatgagcgaacatgccatccgttacttccgcgagggggacatcatgccggtggagaaggtgaccttcgttcggccacgtccctggccgctgcgtgacagactggtcgtggaggcgcaggagacggtgtggcgccgggtc

SEQ ID NO: 98 - DNA, 1656 bp, Unknown
  source: /note="Description of Unknown: KP2-Mcoc1 Bacteria Sequence"
acaatctgtgtgagcactacaaaggcaggttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacatactttatgaggtccgcttgctctcgcgaggtcgcttctctttgtatatgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtcgatttaacgcgttagctccggaagccacgcctcaagggcacaacctccaaatcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactctagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaatcgccaaggttattaaccttaacgccttcctccccgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagccgttaccccacctactagctaatcccatctgggcacatctgatggcatgaggcccgaaggtcccccactttggtcttgcgacgttatgcggtattagctaccgtttccagtagttatccccctccatcaggcagtttcccagacattactcacccgtccgccgctcgtcacccgagagcaagctctctgtgctaccgctcgacttgcatgtgttaggcctgccgccagcgttcaatctgagccatgatcaaactcttcaatttaagtttgatgctcaaagaattaaacttcgtaatgaattacgtgttcactcttgagacttggtattcatttttcgtcc

SEQ ID NO: 99 - DNA, 1587 bp, Unknown
  source: /note="Description of Unknown: KP2-Mcoc1 Bacteria Sequence"
aatattcctggataacgtcaagcgcgctgacgagctggttaacggtccggccggaacggttaacgaccgcgcaggcgaaccgctcgatacctggcgccagatgatggctaagaatgacgaagttcggcagaacatcatcccgctcagtaagcagtatcaaacgctggaggctgcacaggcggatatcgcgaatattccggtgggctcgaccacgtactaccgtagcccggacgacagcgcgctcgcaatcgaggtgatgaacgttggcgggacgctgcagcctaccgggcgccgtatgccttcatatgacctggtggcggccatcagccaggcagtaacggcggaggtcatggcccgaacaggtctgatattcagcagcgatgaccagaccatgctctctttatgcgatgaatggggatatgaagccgggcggatcactgagaacagtttcgaaacgagaaaactcagactgatccagtcagagacaggtccgctactgacgctggttgatgatttcggttatgcggtgaatctgttttccgaaagaggcgcgctggttgccggaaataatgagttgtcagattcagagtcgcttatttccttccctgatgaattcgggaacgagctgattctggttgataagcaggggcggctgtatgccggggataacatcatatttgacgcgccggactgggcacgctgtaccgttgaccccttcgggtatgttatcgaaggcgtgaaattaaatggtgatgtggtcagcaagaatggaggcggcggtagcgtcgaacctgtgccctctgtactggagagcagcgcagcagcgcactggctgtttggctatgagtccacgtcgtatacaagccgtgtggggtataaaacgctgacaccgcaggccgcgccggaattcaataacaattacatttcgatctccgcctggggcggcgcgctgatgaccgatatccccgatgccggggaatacactgtctgcgcggtggtcagggtacctgaacaggccccgttaaccgactgcgtggtgatttacggcacacagaacgggtattcacttcgggatgacgacgacacctacaccggcaatcagctgtcgatgttttccgacagggatgatcggcgatggctgcgtgtgaaaaattccggttaccggggaacgtcccggcattatccgacactacagccgcctgtcggccagtggctgttcatttcacatgtggtgaaacttgagggcagcggactgcgttaccaggcaatcagcgtgggtggcgaagaatatcagatgctgcgcgaggccgatgcagatcgcctgattctttccggccgcaacatcgccattggcaacgggtggtgtgataacgccatgttcaaaaccaaaaatctcgacatcgctgaattcatctacttcgaccattcgctttctgcgcaacaggtccaggccgtttatcacaattcccgccagcgtatggctgagcgcgcacttaacttacagtaaaggagtctccctatgggcacagcaattatggccgctggcactgatgcatcagcgtacgcaaataattatcttccgccggt

SEQ ID NO: 100 - DNA, 1336 bp, Unknown
  source: /note="Description of Unknown: KP2-Mcoc1 Bacteria Sequence"
tgatgtagccccctgaaacaccggacagtagctgtatctccagataagagataggcttgaatatatgtctaacactaacgccaattttgagatgaccgggatcctgttagggcaagaagcccgtaaacgtaaaactcctcaggagaagatcgccattatccagcagacgatggagccgggcatgaatgtctcccatgtcgcccgcctgcatggtatccagcccagcctgctgtttaagtggaagaagcaatatcaggaaggcagcctcaccgccgttgcggccggagaggaagtcgttcctgcttctgagcttactgctgctctgaagcaggtccgggaacttcagcgccttctgggcaagaagacgatggaagttgagatcctgaaagaagccgtggagtacggccagtcgcgaaaatggatagcgcacgcgcccttgttgccaaaggacggggaatagccctggtcagccgcaccatgggcgtgtcgcgtgcgcagctgtcactgcggattaaccgttctgccgactggcaggacaagcgctgtaaccggcgtaatgacgaagcagacgaagaaatactgtcggctatcctcgacatcatcagcgatatgccgagttatggttatcgacgcgtgtggggcatcctgcgcaagcaacgtcgcacagagggacagccacctgtgaacgccaaacggctttacaggataatgagcgagcataacctgttgttgttgcatgacaaaccagagcgaccgaagcgtgaacataagggcaagatagcggtggcagaaagcgatatgcgctggtgttcagatggcttcgagttcggctgcgacaacggcgaaaaactgcgggtaacgttcgcgctggactgctgcgaccgtgaggccatagactgggcagcaagcacgggaggctatgacagttcaaccgtgcaggatgtgatgctgaggtcggtggaaaagcgcttcggcgacaggttgcccgatacagcggtgcagtggctgacggacaacggttcagcgtataccgcgtatgaaacgtggaggttcgcgagagagctgaatctggagccctgcacaacagcggtgagcagcccgcagagtaatggcatggccgaacggttcgtgaaaacgatgaaagaagactatatcgcgttcatgccaaaaccggatgtgagaacagcactgcgaaaccttgcagtagcgttcacgcattacaatgaaaaccacccgcacagcgcgctgggatatcactccccgagggaataccggcggcagcggacatcgttaacttaagatacaaaagctgttcggagatggagggtcaagatca

SEQ ID NO: 101 - DNA, 1059 bp, Unknown
  source: /note="Description of Unknown: KP2-Mcoc1 Bacteria Sequence"
ggctttgttgaataaatcgaacttttgctgagttgaaggatcagatcacgtatcttcccgacaacgcagaccgttccgtggcaaagcaaaagttcaaaatcaccaactggcccacctacaataaagccctcatcaaccgtggctccataactttctggctggatgatgaagctattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccattttttctctgatgaacgttccgctacgctgcccggattacagctgtgtcagcaggcaggcaaagtcggttaatgtcagtttcaaaacgcccacccggggtgaaatcgcacacctggtaattgattccaccgggctgaaggtcttcggtgaaggcgagtggaaagtcaaaaagcatggccaggaacgccgccgtatctggcgtaagctgcatctcgccgttgacagtaaaacacatgaaatcatctgcgctgacctgtcgctgaacaatgtgacggactcagaagccttcccgggtcttatccggcagactcacagaaaaatcagggcagcatcggcagacggcgcttacgacacccggctctgtcacgatgaactgcggcgtaagaaaatcagcgcgcttatcccaccccgaaaaggtgcgggttactggcccggtgaatatgcagaccgtaaccgtgcagtggctaatcagcgaatgaccgggagtaatgcgcggtggaaatggacaacagattacaaccgtcgctcgatagcggaaacggcgatgtaccgggtaaaacagctgttcgggggttcactgacgctgcgtgactacgatggtcaggttgcggaggctatggccctggtacgagcgctgaacaaaatgacgaaagcaggtatgcctgaaagcgtgcgtattgcctgaaaacacaacccgctacgggggagacttacccgaaatctgatttattcaacaaagccta

SEQ ID NO: 102 - DNA, 911 bp, Unknown
  source: /note="Description of Unknown: KP2-Mcoc1 Bacteria Sequence"
gcgcacgtagactgcccgggccacgccgactatgttaaaaacatgatcaccggtgctgcgcagatggacggcgcgatcctggttgttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgagatggaagttcgtgaactgctgtctcagtacgatttcccgggcgacgacaccccgatcgttcgtggttctgctctgaaagcgctggaaggcgacgcagagtgggaagcgaaaatcatcgaactggctggccacctggatacctatatcccggaaccagagcgtgcgattgacaagccgttcctgctgccgatcgaagacgtattctccatctctggtcgtggtaccgttgttaccggtcgtgtagagcgcggtatcatcaaagtaggtgaagaagttgaaatcgttggtatcaaagaaaccgcgaaaaccacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaacccgcacaccaagttcgaatctgaagtgtacatcctgtccaaagatgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcgatggacgacggtctgcgtttcgcaatccgtgaaggcgg

SEQ ID NO: 103 - DNA, 673 bp, Unknown
  source: /note="Description of Unknown: KP2-Mcoc1 Bacteria Sequence"
ccgtagtggatgtagttcccggcagcgtcttcgttgatcggcttagagccggaccacagggtcaggttggacggcgcgagatctgcggagccgccgaggaattccggcagcagcgggccgaaagcttcgatggcgttctgcgaggctttacggctggcgattttcgccgggttggcctgcagcttcgcgatgaactcgttagctttcgcgtcgaagtcagacggcatttcgcctttcatacggcgggtgaattcggctgcttcctgcgggaaggctttggcgtaggcagcgaacttctcattccacaccgcttctttcgcctggccggcttctttggcatcccactgggcatagatgtcagacgggatgtcaaacggcgcgtgtttccagcccagcgctccgcgggtcagggcgatttcggcgtcgcccagcggcgcgccgtgggagtcgtgggtaccggctttgttcggcgaaccgaaaccgatgatggttttacacatcagcagggacggtttgtcggtgaccgcccgcgcttcttctaccgcgcgtttgatggcgtcagcgtcgtgaccgtccacgccgcgcaccacgtgccagccgtaggcttcaaagcgtttggcggtgtcgtcggtgaaccagccttcaacgtggccgtcgatggagatgccgttgt

SEQ ID NO: 104 - DNA, 671 bp, Unknown
  source: /note="Description of Unknown: KP2-Mcoc1 Bacteria Sequence"
ggcctcaagttcagcggctacgcccgctatggcgcccacttccagaccggcgaccagaaatatgtcggcgtcgacggctcctataacggcgcctcggcgatcggccgtctgggcaacgaaagcaacggcggcgaattccagatcagcaaggccttcaaaagcgcgcagggggctatctgggatcttaacgtgatgttcgaccactggagcgacgaagttaacctgaagaaggcctacgtcggggtcaccaacgtgctggaatccaaccccaacgcctatatctgggccggccgcgacttccaccagcgtccgcaacaggggatcaacgactacttctggatgaaccacgacggccagggcgccggggtgaagaactttgatatcggcggcgtgcagttcgacgtggcggcggtgtcgcaggtgaaatcctgtagtccggaagtgatggccgacgagaccaacccgtcgcgcatcacctgtaccggcagctccgacaccggcgacaacggccactacgcgctgaccaccaaaacccacaacatcaaggccgggccgatcgacgtcgaggtgtacgccaactacggctttgactcaaaggcggtggacagcgacgcgcgtctcgaagcctggcagggcgggctggtgctgagccacaccaacgacagcggggt

SEQ ID NO: 105 - DNA, 666 bp, Unknown
  source: /note="Description of Unknown: KP2-Mcoc1 Bacteria Sequence"
tctctatcagcgctgcatcaggcactggcggcgggatatttgcctcccattcctccagccacttcagcttgccgtcccattccggcagcggggccggcggcagcggcacgatatcgttgatttccgggacgacaggatgggcccatgagtatttcgccagcacagcacctatctgctcataacgacgggcacgctccgggtctttctccagtgccagatagaacaacctgtccattggttcaggtccggaaaatccgtgcatcaggaaaccggctgaggttgaatctcccgctgccacacccaactggaatgcctcagttgcctgctgaaatcgcttattatttttcaggttaacacccagatcactggatacctctctctctccctgttcagcagcacagcgacgcatctgacgggatatatccggcgcaatatcaatcggagcgagtttatcccccacatacgcctgcgcctggggattcccttcatctgccgccttacgatagtaacgcagcgccatctccgggtcctgcgccagtcctgccgcaccgtgctccagatagatggcaataaagtagtagccggcggccaccttcgcatcaatcagttgctgactcaggcgcagacgttcatggctgctcagcgcaaagcgcccgcgcagcgcgc

SEQ ID NO: 106 - DNA, 638 bp, Unknown
  source: /note="Description of Unknown: KP2-Mcoc1 Bacteria Sequence"
cgtttgatggcgtcagcgtcgtgaccgtccacgccgcgcaccacgtgccagccgtaggcttcaaagcgtttggcggtgtcgtcggtgaaccagccttcaacgtggccgtcgatggagatgccgttgtcatcatagaacgccaccagtttacccagtttcagggtaccggccagggagcacacttcgtgagaaatgccttccatcatacagccgtcgcccatgaaggcgtaggtgtagtggtcgacgatatcgtgtcccggacggttgaactgcgccgccagggttttctcggcgatagccatcccgaccgcgttagcgataccctggcccagcggaccggtggtggtttccacgcctgcggtgtagccgacttccgggtgacccggagttttggagtgcagctggcggaagtttttcagctcttcaatcggcagatcgtagccagtgaggtgcagcaggctgtaaatcagcatcgaaccatggccatttgacaacacaaaacggtcacggtcagcccaggccggattgttcgggttatggttcaggaaatcacgccacagcacttcggcaatgtcagccatacccatcggggcccccgggtggccggatttggctttctgtacagcgtccatgctcag

SEQ ID NO: 107 - DNA, 628 bp, Unknown
  source: /note="Description of Unknown: KP2-Mcoc1 Bacteria Sequence"
tgccatccgttacttccgcgagggggacatcatgccggtggagaaggtgaccttcgttcggccacgtccctggccgctgcgtgacagactggtcgtggaggcgcaggagacggtgtggcgccgggtcagcgaggcataagctctgcagatgatgaggaaaaggagagcgtcagggaatgaaagggataacgacatggatagtgctgggcagcctgctgctgtcaggctgtgatcagaagagtgtccacatggaggcatcttcagatacagacccgctgagcgatataagttcctctccggcgtttacctgtcagcatgagacacttcccgcgccctccgcggataccgatgttctgtttaaatacgcccgctggctgcagaaaaataacctgctgaagcaggacaagagcgtcgatgcgcaaaccgaacggctgtaccggatagcggcagagaacgggcactataaggccagcattaatctgcagaacggcgccctgcgctggcagttttcgctgagcagccatgagcagttccggctgagccagcagcttatcgctgccggggtggcgaccgggtactatctgaccgctatctatctggaacggggcgtcgcggggctgcagcagga

SEQ ID NO: 108 - DNA, 619 bp, Unknown
  source: /note="Description of Unknown: KP2-Mcoc1 Bacteria Sequence"
agccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtgccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccaatcatctgttctccaatgactggtctaaaaactagtattaagactatcacttatttaagtgatattggttgtctggagattcagggggccagtctagtgatcttgaccctccatctccgaacagcttttgtatcttaagttaacgatgtccgctgccgccggtattccctcggggagtgatatcccagcgcgctgtgcgggtggttttcattgtaatgcgtgaa

SEQ ID NO: 109 - DNA, 607 bp, Unknown
  source: /note="Description of Unknown: KP2-Mcoc1 Bacteria Sequence"
gttccggtcagcgtcccgcagggcaaaaagccgccgcgagtcgtgactgacgatgagcaaccgcgcccggagaccagcgagcagcagctggcccagctgcgcccggcgtttcgcccggctgacggcagcgtcaccgccgggaatgcctcgtcgctgaacgacggcgccgcggcggtcctgctgatgcgtgtcgataaagcgcgcgagcttgggctgccggtgctggcgcgcattgtcagctcagcggtcgccggggtcgacccgtcggtgatgggcatcggcccggtgagcgcctgccgccaggcgctgcagcgcgccggctggacgctggacgaggtggaccttatcgaagccaacgaggcttttgccgtccaggcgctggccgtcggtcagctgcttgagtgggatagcgagaaggtcaacgtcaacggcggcgccatcgccctgggccatcccatcggcgcctccggctgccggatcctcgtcagcctggtgcatgagatgcagcgccggggcgccagcaaagggctggcaaccctgtgcgtcggcggcggccagggcatcgccatgaccctacaacgttaacaggagccactatgtttacacc

SEQ ID NO: 110 - DNA, 587 bp, Unknown
  source: /note="Description of Unknown: KP2-Mcoc1 Bacteria Sequence"
gagggcgcttaccactttgtgattcatgactggggtgaagtcgtaacaaggtaaccgtaggggaacctgcggttggatcacctccttaccttaaagaacctgcctttgcagtgctcacacagattgtctgatgaaaatagagcagtaagtaatctctgcaggcttgtagctcaggtggttagagcgcacccctgataagggtgaggtcggtggttcaagtccactcaggcctaccaaatttgcgaagcaaatttgaagaggttgcaaacgatggggctatagctcagctgggagagcgcctgctttgcacgcaggaggtctgcggttcgatcccgcatagctccaccatctttactgcgaacacaagaaaacttcagagtgaacctgaaaaggtgcactgcgaagttttgctctttaaaaatctggatcaagctgaaaattgaaacgacacacagttaatgtgtgttcgagtctctcaaattttcgcaatcagaagtgaaacatcttcgggttgtgaggttaagcgactaagcgtacacggtggatgccctggcagtcagaggcgatgaaggacgtgctaatctgcg

SEQ ID NO: 111 - DNA, 511 bp, Unknown
  source: /note="Description of Unknown: KP2-Mcoc1 Bacteria Sequence"
gggggggggggggggggggggggggggggggggggggggggggggggggggggggggtggggggggggggggggggggggggggtgggggggggggggggggggggggggggggggcggggggggggggggggggggggtggggggggggggggggggggggggggcgggggggggggggggggggggggggggggggggggggggggggggggggggggggggggggggggggggggggggggggggggggggggggggggggggtggggggggggggggggggggggggggggggggggggggggggggggggggggggggggggggggggggggggggagggggggggggggggggggggggggggggggggggtgtgggggggacggagggggatgcgtagcggggggatgggggaggggttcggggggcaggtggtggataccgtggatatcgaaaacgatatttgggtggcgaaaactgaaggccagaagctggcaggcgcgctg

SEQ ID NO: 112 - DNA, 491 bp, Unknown
  source: /note="Description of Unknown: KP2-Mcoc1 Bacteria Sequence"
ccaacttactgatagtgttttatgttcagataatgcccgatgaccttgtcatgcagctccaccgattttgagaacgacagtgacttccgtcccagccttgccagatgttgtcgcagattcaggttatgtcgctcaatgcgctgagtgtaacgcttgctgttaacgtgcagctttcccttcaggcgtgattcatacagcggccagccatccgtcatccataccacgacctcaaaggccgacagcaggctcagaagacgctccagtgtggccagagtgcgttcaccgaagacgtgcgccacaaccgtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatg

SEQ ID NO: 113 - DNA, 468 bp, Unknown
  source: /note="Description of Unknown: KP2-Mcoc1 Bacteria Sequence"
tgccatccgttacttccgcgagggggacatcatgccggtggagaaggtgaccttcgttcggccacgtccctggccgctgcgtgacagactggtcgtggaggcgcaggagacggtgtggcgccgggtcggcgaggcgtaagctctgcagatgataaggaaaaggagagcgtcagggaatgaaagggataacgacatggatagtgctgggcagcctgctgctgtcaggctgcgaccagaaaagtatccacaaggatgtgccggtgaacccgctgaccgatattaatgcccgtttggcgtttacctgtaaacaccagattattcctgaggcgtctgcggataccgatgtcctgtttaaatacgcccgctggcggcaaaaaaataatctgattaaccgggataaaacggtggatgcggagattgcccgtctgtaccggatagcggcggaaaacggtcattataaagccagta

SEQ ID NO: 114 - DNA, 439 bp, Unknown
  source: /note="Description of Unknown: KP2-Mcoc1 Bacteria Sequence"
ttaccactttgtgattcatgactggggtgaagtcgtaacaaggtaaccgtaggggaacctgcggttggatcacctccttaccttaaagaacctgcctttgtagtgctcacacagattgtctgatgaacgtaaagaagcaaggcgtcttgcgattgagacttcagtgtccccttcgtctagaggcccaggacaccgccctttcacggcggtaacaggggttcgaatcccctaggggacgccacttgctggttcgtgagtgaaagacgcgtgccgatgtatctcaaaactcatcttcgggtgatgtttgagatatttgctctttaaaaatctggatcaagctgaaaattgaaacgacacacagttaatgtgtgttcgagtctctcaaattttcgcaatcagaagtgaaacatcttcgggttgtgaggttaagcgactaagc

SEQ ID NO: 115 - DNA, 359 bp, Unknown
  source: /note="Description of Unknown: KP2-Mcoc1 Bacteria Sequence"
caatggccagtcggggatcgacattttaggcccgtttcagggcggcggcggtggctgctgcttcagcgtgcccgcccgctggacgccgggtatgacggtgcgtgttgactgggaaaccggggtggggtactccatggactttccggggtatcaggatagggaaaaataccttgcctggaaaaaaggaattgatgcccaaaagaggcagcacagcaaaaccgttccgctgcctgactataacggccaggatgtgtgcggcattacggtgcactttttaccctgcgatgacgtgaaggtgaccaccagctgctggtcaccgagaaatgcgaactatccgataaaagagcccgtcaggatga

SEQ ID NO: 116 - DNA, 356 bp, Unknown
  source: /note="Description of Unknown: KP2-Mcoc1 Bacteria Sequence"
cgcagattagcacgtccttcatcgcctctgactgccagggcatccaccgtgtacgcttagtcgcttaacctcacaacccgaagatgtttcacttctgattgcgaaaatttgagagactcgaacacacttaaacagtgtgtcgtttcaattttcagcttgatccagatttttaaagagcaaaatttcacaatgcacttcgcagtacattttgaaatttattatttatcaaacaatctgtgtgagcactacaaaggcaggttctttaaggtaaggaggtgatccaaccgcaggttcccctacggttaccttgttacgacttcaccccagtcatgaatcacaaagtggtaagcgccctc

SEQ ID NO: 117 - DNA, 351 bp, Unknown
  source: /note="Description of Unknown: KP2-Mcoc1 Bacteria Sequence"
ctcacacagattgtctgatgaaaatagagcagtaagtaatctctgcaggcttgtagctcaggtggttagagcgcacccctgataagggtgaggtcggtggttcaagtccactcaggcctaccaaattcgctctcgtgctttgttgtggcaaagctcgcatacttcagtatgcttcgcttcaccacgccgcgcccgaaaacgaattaaggttaaagagattcattcgatggggctatagctcagctgggagagcgcctgctttgcacgcaggaggtctgcggttcgatcccgcatagctccaccatctttactgcgaacacaagaaaacttcagagtgaacctgaaaaggtg

SEQ ID NO: 118 - DNA, 269 bp, Unknown
  source: /note="Description of Unknown: KP2-Mcoc1 Bacteria Sequence"
cctgccgcaccgtgctccagatagatggcaataaagtagtagccggcggccaccttcgcatcaatcagttgctgactcaggcgcagacgttcatggctgctcagcgcaaagcgcccgcgcagcgcgccattctgcagattaatactggctttataatgaccgttttccgccgctatccggtacagacgggcaatctccgcatccaccgttttatcccggttaatcagattatttttttgccgccagcgggcgtatttaaacaggacatc

SEQ ID NO: 119 - DNA, 256 bp, Unknown
  source: /note="Description of Unknown: KP2-Mcoc1 Bacteria Sequence"
agctgaaaattctctcaatccgccaaaacatcttcggcgttgtaaggttaagcctcacggttcattagtaccggttagctcaacgcatcgctgcgcttacacacccggcctatcaacgtcatcgtctttaacgttccttcaggagacttaaagtctcagggagaactcatctcggggcaagtttcgtgcttagatgctttcagcacttatctcttccgcatttagctaccgggcagtgccattggcatgacaaccc

SEQ ID NO: 120 - DNA, 256 bp, Unknown
  source: /note="Description of Unknown: KP2-Mcoc1 Bacteria Sequence"
gtctcctgaaggaacgttgaagacgacgacgttgataggccgggtgtgtaagcgcagcgatgcgttgagctaaccggtactaatgaaccgtgaggcttaaccttacaacgccgaagatgttttggcgatttgagagaattttcagctctgatacagattaatcgatacgtcggtgagacgtattgataaaacagaatttgcctggcggcactagcgcggtggtcccacctgaccccatgccgaactcagaagtgaa

SEQ ID NO: 121 - DNA, 255 bp, Unknown
  source: /note="Description of Unknown: KP2-Mcoc1 Bacteria Sequence"
aggagggattttcccggaggcggtgctgcgcaccttgtccggccacagggacgtagccccgtgtcggatccgtagccccggtaagcgcagcgccaccggggaggcatgccggcacgctggccggacgccagaaacgcaaaaagcccatccggcaggatgggctcttcacttgtttgatgcctggcagtttatggcgggcgtcctgcccgccaccctccgggccgttgctgcgcaacgttcaaatccgctcccggc

SEQ ID NO: 122 - DNA, 252 bp, Unknown
  source: /note="Description of Unknown: KP2-Mcoc1 Bacteria Sequence"
agccccactgttcgtccatttcagcgcagacaatcacatcactgcccggttgtatgcgcgaggttaccgactgcggcctgagttttttaagtgacgtaaaaccgtgttgaggccaacgcccataatgatgtagccccctgaaacaccggacagtagctgtatctccagataagagataggcttgaatatatgtctaacactaacgccaattttgagatgaccgggatcctgttagggcaagaagcccgtaaa

SEQ ID NO: 123 - DNA, 236 bp, Unknown
  source: /note="Description of Unknown: KP2-Mcoc1 Bacteria Sequence"
agacgatgacgttgataggccgggtgtgtaagcgcagcgatgcgttgagctaaccggtactaatgaaccgtgaggcttaaccttacaacgccgaagatgttttggcggattgagagaattttcagctctgatacagattaatcgatacgttggtgaaacgtgttgataaaacagaatttgcctggcggcactagcgcggtggtcccacctgaccccatgccgaactcagaagtgaa

SEQ ID NO: 124 - DNA, 231 bp, Unknown
  source: /note="Description of Unknown: KP2-Mcoc1 Bacteria Sequence"
cccccccccccccccccccccccgcccccccccccccccccccccccccccccccccccccccccccccccccccccccccccccccccccccccccccccccccccccccccccccccccccccccgccccccccccccccccccccccccccccccccccccccccccccccccccccccccccccccccccccccccccccccccccccccccccccccccccccccc

SEQ ID NO: 125 - DNA, 134 bp, Unknown
  source: /note="Description of Unknown: KP2-Mcoc1 Bacteria Sequence"
gaatctaagctgaaaattctctcaatccgccaaaacatcttcggcgttgtaaggttaagcctcacggttcattagtaccggttagctcaacgcatcgctgcgcttacacacccggcctatcaacgtcatcgtct

SEQ ID NO: 126 - DNA, 128 bp, Unknown
  source: /note="Description of Unknown: KP2-Mcoc1 Bacteria Sequence"
cccccccccccccccccccccccccccccccccccccccccccccccccccccccccccccccccccccccccccccccccccccccccccccccccccccccccccccccccccccccccccccccc

SEQ ID NO: 127 - DNA, 177911 bp, Unknown
  source: /note="Description of Unknown: PKP-55 Bacteriophage Sequence"
cagtgtgaatcctttaccggaaccagcaccgccagcaagaataacaacctgaccgaacttaggataagcacggcctccgaaggtgatcagcgcttcggttaaggtgctttctgtgaattgtttaaatgacttcatgtaaaattctccagtttattttctattatttattgacatgctttctgacagtggtgtatggttagggtgttcgacggataggccggaagaactttaaaccataaggtatatgatatgaaaatcaatttacatcgcttcattgtagaattttcccgcaaccgtgacatggactcttacaactattactcccgtgagattgaagatctttttgcggctcacgttggattccttcgccaccatacccctaaaatgcgtcctgaccacgatccgatatatagccctattacatggcaagcccctatcgatggttacgttgaagggatccggatcatgacgtttaacgcgatgtatggaaacgcgttgatccatatcgcacgtgagaaaagggccgaattccctaacggatggcgtattgatgaagtgattcaaaatcttatgcagttacgacgtgaatacaaagcgggtatgtgtctgcgtaatgaacagtatcagatgtataaaacgtatgcatatatctctaagcacctaattaattccatgttttacatcgttggtaatcatggttccgctatagatatcggttcttatgaaatcgtggcttatgctcgcgaacaaggaaaggccgctgcactgaaaatcattgaatctggtgctatcattcttaaccatcgcgttgatactattgcttactatggtgatcaggttgaggttgaaggcgtacaccatgaacgattcaacaaagccgtatttgctaaaaatggttatgcgtatggtaatgacattataacttctgcggttcctttcgttcgtctaactgttgaaggatttggagaaaggttgtcttatagactgtcagaagctcaaatgtgcgcggctgctgaaagaatagccagaaagcggaaaatgtataccgatgaatacctggcgtatgtcaacaaaacaaaagaagatgtagaccgagaaatttcttgcatggatttatccatttgatataatgtaagcatctttttaagggaggatacatgaaaacgatacattgcagaaatgaaaacgttgtttattatcacggttcgtgtactgctgctggtattgaaagcatgttattgcctccctgtgattctgatactctgtctgaaaaaggcagaaagaaaaatttagaccgtgttttctttaccgctgatatcgggttagctcgtatatatgctggaagggccgcacgttctataggtggggatcctgttctgtacagggttgtgtgtccggttgatgttgtatgcatgaacgaagacaaaggcgcgagcgtttaccatgcagcatgggcgttttgtgaggaattatgaatgataaagtgttggcgtatctcgttttcttgttgggatatcgcttagaagtgatgggcgcgtattcatcaatgtatggtgatttaacggctatctggatggtcgggttaggggttgcttttacattcctttcctttgcaattgttaatgaatcggaaaaggatattgtatgaaactatatcatgtgatctactctggtgttttaggcattgacaaacaaatgttagttgatgtaatgtgtaaaaaactcgatgaacgaattggaactcgatacaaaaatcatgtatcggaaagtattttcatcaacgttgaccatccaaatgacatggaagaaatggttaatactcttgatgatcagcagatcccgtttgttgacaatttcaacatgagcgctggagtgtatacggtagtaacttttgttctaaaaaatgttgacatccgaaacgatagcgtgttgaatgtagttgcaaaaatcgattctaccaaaggaaaataatatgaaaattgtacaccgtagcatttccgaactgtctcaagccgaaaaagtgcaaattcatttcaaattcaatgatttgcgtaaaggttatgccgaaattgcccgtgaacatgggttagataacggcgatatttaccaggtagtacaggaaattgaacgtatccgcgcgttccgttctgcaaatctccctgttaaaaatgcaatgcgccgcgaagcgatcgaaatccatcgtaagcgtgtgtacaatttagaacgtgctaaacgtccgatgaagaaagaaaagaaacctcgcccgtttaaacgcgaacatcttaacacctctatggcgctggcgtttcaagatgcggggattatctgatgcgtaaatctgcgatggatcgttgggctagtattgctacttcaaacgtaaaaccaaatcaagccgctcctgatgtagaagcggttcgtaaagcaaaagaacctgagattgtggcccttagccccgaactcattgagcatcgccgccgtgcgtctgctattgaactggatctgcgtattgcgcgttcatacaatctcaagcatgaacacgccgcaaagaacaaccattcttttgaccttactctggaagattggaaagtattgatgacaactgaacgttgtcagtattcaggcaagatgtttagcaataaacccggtagcccgtatgcccgtacaatggaacgtattaatccacgtctgggatatacacaagaaaatacaatagcggttatcaatgctgctaatgctgaaaaatcaaatctagatgcattcgttaagggtgatgtcattctggatgaagtaaaagtgaagttgctgcgtaaagcactttatcaagtcgaaaaacgtgtgaaaatgaaaggttaaattatgtttaagaaatattcttctcttactaaccattatgaaggtaagttcatcaatggtgtaattatgaacgggcttactggcggtgtgtgggttgcgcgtgaaaagatccacggtgctaactttagttttatcaccgatgacggaattaccgttacccccgcaaagcgtactgatgttgtgaagccagccgaagatttttatggctgttcagcagtagttgcaaagtattcaccagggatccgtaagatgtgggaaaccctcaaaaagaccggaacttatgatgatttggttattcaagtctacggtgaatttgcggggcgcggtgtacagaaagatgttgattacggcgaaaaagatttctacgtattcgatatccgtgtaaatggtgaattccttccggataacctgtgctcgcttatctctcgatctcatggcctgaaaatggccccgctgttgggatacggtacttttgaagagatcaaagaactgccgatcacgtttgaatctgtggtgaataaagcaaatagcggcattggtagcgataatacagtatatggtgaattcgtatatcctatcatggacgttgaagagggcaacattgcagaaggttttgtaatgaaacctgtttcacctgcttttatgccaaacggtgaacgcgttgcaatcaaatgcaaaacaaccaaattcactgagaagaaagcgaagaaagcaacccgctttaatgctccggtttcattgtcagaaaaagacaaaaaccaactcgatgagtttgtttgttaccttacagagaaccgtgtgaaaaacgttctttcgaaactggatctggcttcgatcactgctaaagatttcggtcgcattatgggcttaactgttcaggatgctatcgaagaaatcagccgtaatcacgggcctttcctcgaacagttcgaagacccagcaatggctaagaagctgtttgtaaccgaagcccaaaacatgattcgccctgtatggggcaaaatcctgaaccatgaattttaaactatgaacagtcacggaaactatagaagtatttctgatgaaatagccgcaataagagaactccttcaatacgtttcagttgatattacttctggaaatatcgtatggtcttctccgcgtcaaggtaggagggttggtgattccgctggtactatgaaagatggatattgtgttataaagtttcaaaagaaacaatatcgcagacatcggatcatcttttatgttgctaatgggtatcttcccgctcttgttgaccataagaatggtgttgaatttggtgatggtatagataatttgcaagaggcaacgcaacaagagaacataagaaagcagataaagaaacgaagcaatgcttctggaaaaagaggggttatttttgataaaagaagaaataactatcaagcgcgaatagttgttgatggtaagcagatttttctaggttcatatgataaccctgaaaaggcttatgaagtttacaacgaaaaagcaaaagaattgttcggtaatttttatgtcgaatgattttagtacagtaattaaaactgccaagacagtaacattaattggcagtcgtaaacctcctgaacatatcgcaaacattgctgttaaaatcggacgtgctttgaacgaacgcgggatcagggcttattctggcggcgctcctggtatggatagtcattttctgtttgactataatccggataacagatgtataatccttcctgagaacggttttaacggccttttcgcaaacggaaaggatatcatcgactttcaagatttaaacacacagaaagccgctgacgaagccagaaaggtagcaggtaacttcgatacacagaatgaatacgttcaaagaaggtatgcacgaaacacgattcaagttcttcgtgaaaatcttgacaatccaactgattttgttttattttgggcggaagaacgtgaaggatgtgttaaaggtggaaccgcgatcgctgtaagattggctaggttgtacagggttccatgtttcaatctcttcaaagaaagtgtattgaacgatgtgtgtgatacgttagggatcaatatcaaacccccaacgttggattttttatggtaattgaacatgcgcccttacttcgtgaaacatacgaaagatgggctgttaataacgcaataggtgaaaatatgattcatgtacgtagtatcggtactgacggcgaaactccggtagaaggccgatcacccactctcgcagaacgagcaagagaaattatcaacgatcagaatactaagatgatcgaacatgcgcgggatacaatcacaaaaggtgttctgaaacacgcgacaaaacaaaaccttatctatgatatgaagcacgatatcggctcttgtctgggtattgaatgtactcgctatgcattccaacgagtttctgaatggttggaagaagaagggctaaaattcgatacagaagaaaaacgcaacgccgctaagatcacaaattctctggctagtaagtacaatcaaacgtatcgaaaccaggaagaacgcgaagttttcggtttcaacattcctgaaaggaaaacagatcgccgtgtaagtgaattcactttttacattagttggtaaaaaggtgttgacgggggttggttatagtagtattctaactcccgtagacaagacactaactcagaaggataaacatcatggaaatcgtaatgaaagcaacttatgctggatattgcctggaagcaaaaggtgttgctaacaacggtaaaggcttacgggccaatgttgaagcaatgctggatgaattacatgcaatgtacgaatacgacaacgtagcgggtagcgttcttatccaggcgttggaagttgatggtgttgattgtgctggttggtgggatgcttacattgactacaacgataaccgggtttacctgttgagcaacaaagattatttctaaggaaccactatgagcgatgaagctgaggctttagaagattgggctgattttgatgacgaagaagacggtgaatatttctgcgttaatcgtggtgcttataaagaccgtttagaactccgtaaacttttatcgggttcctctcaaatatcaggatccaaacgaaaaagtagtaaacaaaaagttcagtatagtgatggttctgtacgtgatgaaactgttgttgctgaattccgtggtcgggttatcacaaaagaaagacaaattgatgtaaagaacttgtatgaagtggctaaggctgctaaaataggttctgtgattgtttgccctgtgtgcaaagaaaaacacacaaagacaacgtatcacaaagttttctgttcgaatggcagaaaaaccagtaaggattgtaagtctaaatatcacaatacaatccatcccgaacgactggatcgggtattttaaaataaacctaaaacgtggagtacgtttatgaacaacaaaactttcgaagaactgaacagcatcatcacttccgtagattcctataaggtttctcactggtcgcaatatccaactggctccgaagaggcgctgttttatattgaatctcgtggtggtaaatttgatcaagtagttacggctggctgtaaccgccttgcgcaaatcctatcacgtccggtgactatggaaaacgtagattttgctaatcggttgtacaaaatgcactttgggcgcgaaatcttcaactacaaaggttggaaagaaattgctgaactgggttacatccctcttgaattcagagcgattccggaaggaactccagtagcggttaaaaatccggttgcaactttccacgctgggaaaaatgcgctgtggttagcaggacacgtagaaaccctggcgatcaggggagtatggttcccttcaaccgtagcaactctatcccgcgaatgtaaaaaagtgttgaagaaatatctcaagaaaacctctgatctcgaaggcgaagcatttgatatggtgttacgtacccgtttgcatgacttcggcgcacgtggaacttcttctgctgaatccgctggtattggtggcctcgcgcacctgtataacttcctcggtactgataccgtagaagcgctgattatggctatctctctgtttgaagattgtcagaaagcgtttgatgatggtgaaatggcggctggtatttcaattcctgctcgcgaacattccactaccgtttcttacggcaaagaaaacgaagaccttgcgtacaaaaacagtattgagatcttcggcgaagggatgtatgcatgtgtgtatgattcctgggattttaaagcggcggttcgccgtatcgcagaatataaagattcgattctttctaagggcggtactctggtagttcgtccggattctggtgatatggtagacaatatcatgtacgctcttgaagaactgggtcgtatctttggctatacagtgaactcaaaagggtataaagtactacacccagcagtaaggatcattcaaggcgatgaaattcatggccctgaaacaatcaatcgggtgttgaactggatggagtctaaccgttgggcgtctgaaaacatcgcgtttggtatgggcggcggattgcttcaagaagttacccgcgacactcaaaaatatgcgatgaaaatgtgcgcaatcaaaattaacggtgtgtggactggtgtgtataaatgtccaaaaggcgctgaatggaaaaagagtaaaaaagggttgttgatgactatcactgatggtgttaactttaaaaccattgatactctggaacagaaagtgccggaaggctggaaagatgctatgatcacatactatgtcaacggaaagattacttcccgtgacactttagaggaaattaggaaccgtgccgggatttagtatccgcaaaaacaacaaaggaaccgtgattttctatgacaacattccccttgtagctcgcaaggggctttttgctaaaatcgctgggtattcctttaaactggaagaagtcaacgacgaaacactaaaagagatcgtaagaattgccttacaattaagaggtaagaaagacgaacagaaagctattgacatgatcaataaattgggtgaaactcaatgctttatagtgaatcgtggttacaagtacgataccattgcaaaatttgaaaaagggctttgtgaattatgagttattatggtgtgatcccatacacaggaaacaagcaatcgctattacctgaactattcaagctgttccccgaaagaagttcatacatgcgtttcattgattgtttttgcggtggccttagtgtgtcgctaaacgtccctaaacccgttctaagcaacgattatgataagacgctgattgatatgtatgagcgtcttaaaacgcttcctgacctgtctccggtgcgagaattgatttcatcgaaggggctggggaaagacaagaaagaagagtatctgaaattccgtgatgaatacaaccagaacaaagatcctttatggctctatgtcctgatcctgcattcattcagcaacgttaaccggacaaacgacaaaggcgattttaacgctgctgtaggaaaacgaaccctcaactttatgacagaaaaacgtttcgaacatttcaaaaagaatgtgacaggaattgaatttcgttctggttcatactctgatattgaaatcaacgataacgattttgtttattgcgatcctccgtatctgatcactgatgcggtgtataacaaattctggaacgcagatcacgaacgcgagttatatgctttccttgactccctgcatgagcggggtatcaagtttggtttatcaaacgtgacacatcatgcaggaaagcaaaatgatatcctgatcgagtggatgcaaaaatataatgtgcataacctcgataaaaagtatctgttaggccagcatactgattcttacgaacaaaataaaacgcaagaagtctacgtgtgtaactaccagaaacgcgacgtaaatacataccctgaaacactggatgacttaatgtaaggtaacatatgtttaagatttttggttatatcccttctgtttataattgcgctccatgcctgaattctaaacgtctcctggacgcaaaacgaaaagaatatgagtttgtttctgtagccgatgaaaaagacgcagacggcaaaccgatcctgaatgaaacggtcatttctgaactcgaaagcctgttaggtactcgtagactgaccatgccccaaattttccacgatggtaagcacatcggcggctttgaccaactgcgtgagtacgttcgcacgttgggataaatattaacacctttatttgattggtgttattatgctcactaaacgtattactaagaaagattatccatccattaaacaagctctttttgaacagcaaaacggcttgtgcgcgttatgtggtcgccctttagagggtgaccttgaaaaacatcaccttgaccatgatcatgctctatctggctctaatgccggacgtgtgcgcggcctcctatgtaacctatgcaacggtacagaaggtattgtaaagcacaaatttaatcgttctggtctggtttcccgtgatgttgattatatcgaatggctagaaagcctggtagcatacctcaaacgcgactattcacaaaaccgtatgcacgacaaatttatacccgataaggttaaatggtttacacgccttactaaatcggatatgatagccgaaatgatttctatgggctttgagtacgccgacaaagacgaacgcaaagccttaaccgcaaaatatagaaagcaattaatgaaggcaacgaaatgaaatatctaaacgctcgattatcaacgcaacagaagaaaaagctgatgatgttgatatcctccactgacaaaaagatcatatctctacatgattggatgcttggaaggggtgactctgatttgtgttatgtcaaaccgaaagaccgaacgatgtttgatgatcgcggtcgcacattgactaatttttctcctatcaccgttattgatatgtgggaactccttgagattgtaggacgggatatacctgttgacggggttgaactgatcaaatatcttaacgagattggacacaatttagatattatccataaggcaacgaaatgaaagtagaaaaacgcgacggcaaaaccgtcgatttcgatcaagaaaaaattcgcaatgctgtgtataaagctggcggtacgatgacggatgctgactccgcgatcatgcttgtgttgcgtagtcagatccgcaacggtaaagcaatgaagatttcacaaattcaagaacttgttgaagaatctttaatgaagacaaatccgactgttgcccgtgcatatatcgaatatcgtcatgatcgtgatatcgcccgtgaacaaaacggaaaattattccgtgatatcaagggtttgatgactcttagtaacaaagaattaaccaacgaaaacgcaaacaaagattctcgcgtattcccgactaaacgcgatcttctggctggtatcgtttctaaacatatggcgcgtaaccatattctaccgaaacatattgttgcggcgcatgattccggtgatattcattatcacgatctggattacagcccgttcacgccatacacaaactgctgtctggtggatttgaaaggtatgctggctaatggcttcaagatgggtaacgcagacatcgaacccccgaaatcaatcggtgttgcgacggctctcatggcacagatcaccgcacagattgcttctcaccagtacggcggaactacctttgctaacgtcgatttagtattggctccttatgtggagaagacattcgctaaacatgtacgtgatgctcgcaaatatcaagtagcattagtaaaagattatgctatttcaaaaacagaaaaagacgtatttgatgctttccaatcgtatgaatacgaagttaacacgctgcatactgccaacggacaaacacctttcgttactattactttcggtactggtacgggaatgtttgaacgcatgatccagaaagcgattctgaaaaaccgtattcgtggactgggtaaaaagggcattacccctgtattcccgaaactggttatgtttatggaaaaaggaattaaccttgatccagaggatcaaaactatgacatcaaacaacttgccctggaatgttcttcaaagcgtatgtatccggatattattagcgcggctaataaccgtcgtattactggttctagcgttcctgtatctcctatgggttgtcgtagtttccttagcgtgtggaatgatgagcacggtaatgaaattcttgatggacgtaataacctgggcgttgtgacgatcaaccttcctcgtattgcgattgaagccgaagcacaggaagatgaagacgcgcatgatgcattttggcgtatccttgatgaacgtctggaactgtgttttgaagccctgatgactcgtattgatagtctcagaggtgttaaagccagtgtagccccgatcctttatacagaaggtgcgtttggtgtacggttgaaacccgatgatgaaattctggaactgttcaaaaatgggcgtagttctatcagtctgggatacatcggattgcatgaaactctgatgcttttcggatctggacaacacccattcgaccggatcggttctcagaacatgggtagactgattctggaatatctacgcgctgcgaccgaagcatggaaaaagaaaaccggatttgggtttagtctgtattcaacccctgctgaatctctatgtcatcgtttctgcaaactggactatgagaaattcggaagtatcaaagggatcacagataaaggctggtacactaacagttttcatctggacgttgaccgcaaggtaacaccgttcgagaaaatcgactatgaagccgattatcattacatcgctactgcgggtcatatcagttacgttgaattccctgatatgaaaaacaacctgcaagccctggaaaaagtctgggattatgcgatggaaaaactggactacttcggaactaaccttccggtcgataagtgctttgtatgtggctctgatgacgagttcacgcctacagaagaaggtttccactgtaagcactgcggtaatcacgatccggctaaaatgaatgtaactcgtcgtacttgcggatatctgggcgctgctgaacgtccgatgaacaaaggtaaacaaaacgaaatcattcaccgtgtgaaacataactaagaacacctagtattagcgccttcaataaataaagaaaaattgagggcgctaatatgttttacacaatctacaaaataaccaacactatcaatgggcgtgaatatatcggcgctcataaaactgataatctcgatgatcgatacatgggttctggaaagaacatcaaacatgctattgatttctatggcattgaatctttcgtaaaggaaatattgtatgtttttgatacggaagaggaaatgtatctaaaagaagctgaactcgtaacagacgagtatatttcgcttcctcacacatacaacatcaaacccggtggtaaaggcggaacggcctacgaacaaagcgaagaacatcgacgcaaaaacagtaatgcgctaaaaggaagagaaatcactccattacatcgcgatcggatctcccgtgcattgaaaaatcatgtccgtagtgaagaacatcaacggaaactgagtgaagcatcaaagattgctgttagtacacccgaacataaagaaaagatgtctgctcattttacagaactgtataaatctcgtcctgaattgaaacagcaaatatcatcttctgtcaaagcacattatgctaatgaaacagaagaagagaaaaatcaacgtcgattgcgtcatacagggaaggttcggtcggaagaaaccaaacaaaaactatccattgctcataaaggaaaacatacaggagagaaaaatcctatgttcggcaaacctgcatcgaatcgccgtatggtttctggtgatggtgttgtgtatggttccgtcaaagaagctgcggaaacactggggttgtcgcaaggaacaatcgttgctcgatgcaaatcacagaaaaatgtaaattggttctatgtaggtgttgacttgccgaatcaaatcgattagtattttctacatcgaagcaaatcaatttgaaatcaaataaggcaaaattatgttcaagaaactcgtatcgttcgtgactggtaaagttgaaactgcaatcgaacaaaacacttccccagaagaagcatggcgcagtgctgcacgtatcctgatcaaagagatcgaccgtctgcaacatactcgcgtttctgctgttcaggaaatcgcgaagctgaaaaagaaagttaccgaacacaaaaaccttcacactggtaaagaatcagagatcaaaaaactgctggcggcggggcaggaagtgtccaacagtcattatgtgctggcgctgcaacatcgtaacatctggcagggcttgcagacgaagatcgaagaactggaagggatgaacaaagagattgatctctctgtcgttgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgagaattctcgtagatgggaatgttccacagcgagtttttcaggaaatggttgatcatgcgtgttctgaatgggataaaaagtattgcgaagaactgacgcatgatagtatagtaaacagcaaccttaaagacgcttacgaacgaagaagtgtatatgacatttacgaaaaagagaggaaagaaatgatgttcgaagacggcaacagtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcgtgtgatatcgttgaagatattcgtattccttcaatcaacgtttctcggtatagttctcctggtaacatccgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaattttctgctacacgaactgattgaaaacggtatcagatttgaattcgttgatccgattaacggtgatgatcgtcatctgctccgctgggtgtctggtagcaatcctctggattcagtctcccaggttgtagagtctgcacttaaacatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaactctttgcaacgaaattgcagaaatgtactggagtaaaggtcacttagaggctatgaaagagtttcaaaagtggtgtgatacccaaaagttagctaaatgggaatacatcgttattgttgaacggatcaaagaactgatcctcgtgaagaaaggtaatatgaaatgattcaactgaaattagacacaaatgcggtgttaagcctgtttccggaaggttcaaccgcccgcgtagacctccaatctgctatcatcaaaaacgtggtgaatagcgtagttggtaagcgtgttagcgaagaaatcaacaaacggatccaggaacagttagctgttctaatgccgaactcatccgaaattacacagatcatcaaatctgaattctcggattacgtcgaaaaacgttatggttattcgaatgttttcgatgtcaactatggcaatgttcgcgaactgtctggtaaaatcaaagaatcggtaaaacagcaatgccaaaccattcttaaagatatcgagaaagaggcgattgctcatgcaacagaaaacattattgcagacgaagccgcgtttatcgctcgcgtctcgaataacctggaagttactgtacgcaaagcagtaatgcaacgggttaacactcagttcccagacattattgacgaagcgatcagagaacgtctgtttggtgaaaaagcatgaattacgaccgcatctataatatggatgtggtcaacggaaaagggatccgtgttgttttgtttgtgactggttgcaatcataaatgcgaaggttgttataacaaatcgacgtggaatccttgcaacggaacaccgtacacggaagagacagaaaaccatctgatttctctgttgagtaatccgcatgttgatggacttacattaactggcggcgatccgctttaccgtgacaactatcctactatcctaaaactgcttgagcgcgtttctaaggaacttccaaagaaaaacgtatggttatggacaggatataccctggaggctttacaggccgacccagaacgttctaagctacttccttacattgatgttctgattgatggtaagtatgaaaaagatttgccaacgaaaaagccgtttcgcggttcagataatcaacgtatgatcgaattcgctaaaaattcgatagaaattaaaaatattgcttgacctaatgtgtaactatggtaatcttaccacatcgtaaatgacgattaactttaattgagagataatatcatgatcctgaatttcaaaacccgtaaagaagcacgtaactattgctggaagtggaacattcccctgaaaaccatccgtaatacagggcgcggttcttgcccgtggacagttcaagcaaatgaactgaaaacgttcgtggttggtaaaacttacaaactggttgaccgtgaagggtttactaccaattcacatggcggatctaacatagcaaacactatccaggcgaagcagatcgaaaaattcctgaataacgaggtaaaaattatctcgaaaccccattcagatactttcaaaattgatcatcctcctgaaatgacttatatctctctgcgttcgtgggaagctcgttatttcgtcgaagttggcgcggctccagctaagaaaaagaaagccaaaccgaaaaaagccaacgttgcggcttcggttgcgcctgttgcaccagcaaccgaagatcttgatcaaatgcttgatggtggttcggcaatgtcggttgaactggatccgactaaatttgttgaaggccgttcgtatgttctggttaaaccgcagcaatttaaaaatcgttgtggcgctaaccctgggatcaaatcatataccgatgaacacagtaatggtgtatacaccgtttaccatacgaattctctcggtcatcatcaattgagcaaaacggtagaaaccattgattccccaaccggaattgttggttactatctgcttgattctgaacgttcgttcttccgtgaactggcgaccggaactgttgatgaacctgttagcgtttccggtaatagcgctatcgctatcaatgtagacgaagcggctaagaaagaagaaatcgcaaaagcaatggtacagcttgaagaagcggttaaagcccatgaggacgcgcttcaaaatctgcgtactgcttccgacctggttcgcaaagctgctcgaaaagtagcagaagtaagcaagtaaattaaactgggtgctccggcacccttttttatgaggtgacacatggaattattagaaggtaaatcttataccctgaacatcgacgctaaagaatttgcagaaaaaacctggcgaaatgctttagctgaattgatcaaaaacaacggctatattacaatcgatcgtattgcgattggggatactgaggacattgcttatgttctgcaagatgatttcgaatatgagatccctagccatatctggaaatacttcaaaccatatgatttaccggaagaagaaccgaagattgctactaaagaagaaatcgccgcgcctgatttaaatttcgtatcttccgatcctaaaatgtggatgactgtaaaacctgttcaacaagatatcaatgatctgcgatttgattatccttttgtcaagcggatcacttcgatttctgtactatcagcgccgacggattcacaggcacttgaatttgcattacagcatgttttcggtgataataagctgtacgcgattgacaaggaagctgctattgatgaacagaaaaaggaaatcatcaaccttctttctctgcatcaacaacttgaagcggtggaattgattgagcgtatgctttctgatacaaagaaagatatcattagcaaaatcactccggcacgaaggaaagcaattgatgaaaatcgagatttacggtattcccgaatcgcttcataaatgttatggttgtattgaagctcggaaattacttgatgagcatggattagaatacgaattttattctgttctaaagccagcaaataacagtgtggggtttgattacgatagaccacgcattgaagagttagcgaaacgtgttcgtagtcgaagcatggcatttacttaccctcggatctttgtagatggtaattttattggcggttatatgcaattgaaagagtatttgggtgaagcatgaataaagaatacattcgcaaagtagcaaacgctattcacgcaacaacgattgattttctggaagggtttgatcatattatccatcctgaaacgctggatagttgggaagccaaactgtttaaaagtatcaatgaacagtttccggaaaaggttaagcgctggtttatcagacaggaaatcgtagcaacgatccttaatgaacgtggtgttgaggcgttcggtgtaacccctctatataagcgaaaccagattacagacgaaacaatcaagaaatataaaaagatggttcggaagtaataaataatcagttaaatggccttcgggccattttttgtatataaatattggtattgaatacaatataggaaaaaagataatggtagctaaatcattccgcgcacgaagtggccttgatgctgctggtgaaaaagttatcaacgttgggaaggctgatcgtaatacgctgagtgacggcgttaacgttgactttttcaatgaatttaacggaatccagcagtatgacccgacccgtggctattctcaagacatggcgatcatttatgcgcgtcgtatctggtacgcaaaacagaatattgcttcccctgctggggctttcgacgaatccaaatggatcgcaactcgtaatgacccgaaatgggtttatagtaacgtaaccactccagacggtagcattattgaatctggtagttacattatggctgatggacgctttactgaacttctgtacctgctgccggacaacccgacagagggcgacgtaatcacgtttaaagattgcggtggtttagtaggtgtgaacagtatccttgttaagtctaacacccgtcagatccgtttacgtactgtacaatcggcacagtatcgactgacccacccgtacatgatcgcaacgtttatctataacggtaacgtatggcgtgttgctgaaactctggataaccgcgattctgagatcgtaaacgcaaccggaacaggttcattccagttacaatctggcatgacagttttccgtaacagtgctacaggtaaaatcactctccagttgccgaaatatgcaaatgatggtgatgtgatcacaacctatgacgctgataaaatgaactctatcaacgtagccgttttgcagatttatccaggtagtggacacactatttctgacggcgcaattactggtgttacttctgtaactagccagaaatccggctttggtatgttcatctttgatgcacagaatagccaatggaaagtatatgatgctgataaccgtgttcgtctgcgtcgtatctatagtgatttaaacgcagttcctaacgattacgtttttgttactgcaaacccttctgggactataccaaacgttacagttacccttccaactgatgttgctgatggtgatcgcgtttacgtatccctttatatgatgggtaaaaaccagaactgcacaatcaaagttaaagatggtacaacggacaagatccgcaccaacaaaaatatgatgcagttcccgcagcgcaaagactatccgcctgatgattggtttagtgtaacttcattagcatttaatgctgctagtgattacctcccgtatatcgagttttcttacatgaaagctacgaaagaatgggttgttgctaattatcgtccgatcgttgaacgtgttgacgcaactaacagatcgcgtactggtgttattgctctggctgcacaggcagaagtaaacaaaaacttggaagacaacccgaacgacgaaactgctattactccgatgacgttagcaaataaaactgctacagaaacccgtcgtggtattgcacggttagcaacaactgctgaggttaacaaactttcaaccgatacctatctggatgatgtgattgttacccctaagaagctgaacgaaagaacagcgactgaaacccgtcgtggattggcagaaatcgcaactcaggcagaaacaaacggaagcaccgatgatattacgattgtaaccccgaaaaagttgcataaccgtattgcatcgccgaccttaactggtatccttgcccttgttgctacaggtggtgctcctaacaccaacacggatcgtgctcaggctggtactggggtttatgatcattcagattatcagaaagcggtaacgcctaaaactcttcgtgagtataaagcgactcagttacaatctggcgctgtatggctggcttctgaaaccgaagttattaatggtactgttgcaagtgcaaacattccgaccgtagttactccggaaatgctgcacaagaaaacctctactgatggtcgtattggtttgatcgagattgcaactcaggcagaaacaaacgctggtactgattacacgcgagcggtaacgcctaaaacgcttaacgatcgtgctgcaacggaaacgctgacaggtatcattgcaattgcaaccactgccgaagtatcagcgggtactgtaactaataaagcgatcgtaccgtctaaactgaaaggttatctggacgatacaagccatattactgttgctactgctgacgggttaactcaatctgggactatctggactacggttaacatcggtattcaatcagcaactgaaacacaacgtggtactttacgcgtagctacacagtctgaaacgaacgcagggacattagatacagtatttgtcacccctaagaagttacacgctaagaaagcgactgagagcgcagaaggtatcattcaggtggctacggctgctgaaactactgctggcaccgtcacaaacaaggctgtttctcctaagaacttgaaaaatacaattcaggttgatacttcatggcaagctaccgatctggtacgcggtactgtgaaactgtctaaggggcttggtacttggtctggtaatgatgtggctggttctactcttccggatgatggttatgccgctgtaggtgttgctgtttctccttatgaattgaacctgacgctgaaacattatctgccgatcggggctaaagcggttgatgctgataaactggataacctggattcttcccagttcattcgtcgtgatgttgatcagacggtcaacggggcgttgactctaacgagaacaaccactgtacaggccaacattgattcaagcgctgatgcaacattccgcgtaatgaatgttaatggagatctgaacgttggtgatggttcgtcaatgggtaaacttcgtttgaatggtggttcatctaacgactggtcaattcaagcaagttcagcctctgggcgtattgcaatgatctcgacgggtaacactagcacagttcatctttctgtgtataatgatactcgtggcgttgtagctaacgttaaattccaggctcctgaaattcaggcgattagcaaagtgactctgggtaatgataccgtgatcactgctgctggttctgttctatctatgggtacgaacaacaagacaactaagatcctgacctctgatgctggcaacatcgtagcggaagaatctgcgaactcttataaagtctttactgagaagaacgcgcaaaccttgctgaatcctacgtatgtacgtaaagcaggtgatacgatgtctgggcgcttgacggtaagcaacagttcaattatcattgcaggtcaagcggcttggtcaacgctggatgcagtaacagaagcatctaggggcaactggacggctgagatcacagcatcggcacaatacaacttgcttcctggttatgcggttccggttcttgaaccagatccgattaatccagaaatcatgattgtgacccgttatacctatgttaaagcacctggtactttaacgcagtttggtaacggaactgcattcacttatcagatttgggcacctcgtccgacctctggtactggtgttgatgcgctggcgcaatccttctggatccgtcaaatgaacccaattacgggtaaatttgatggttggggccgcatgtatactagcaacaacccgcctactgctggtgagattggtgcaacgtctgctgtcggtactacggttaaaaacatgactgttaccgattggatcaaagttggtaacgttaagatttacccagatccggttactcagacagttaaatttgagtgggtggcataatgtcaaacttaatggcggggttcggccccgattttgtagaaacgcaaattctatcggaaacaaacagcgtaacttacagaataaccgcaaaggcaacacatcccaatgcggttcctaatcagtatgagtttacactaaatcaaaaggcggtagggacaccgcctagtgttgggatcaacgtatggagaattaacaatgctgtagttgatccaattaaaaccttcacattatcgaatgataattcagcaactgcaaataaagcgtttgttgaatatatggatgctcaaccttctgggctgtatttgataatgactaacggtgaatacaaaacaagccaaatcgttgatgattggtttgctaaaaacagatccgttatgtggcaaggcgctgatttcgctcagagattcccaaattctgcatatgttgcattgtatggggcatcaaaatctcgtatactgattgaatcgttttacgctaacgatggaattttaaaagaagattcacgcgcatcaatcgatcttgtctatgataacgttggtgatgttggtcgaactggtgtacctttcaggtctgttgaagatacggaagaatacaattcaaccaatggatctgaatataaagtgtatcctgttgcaaacccagtgatctctaaactagctgattacggtatggctcctggattggctatgatgattactggtgatttttacgccagtaaagaactattggatgctggatcaacaacaagggttactgttcgatggtttacgggtactgctcaaacttcatcatcggtgattgaagttcctgcaaataaacctgatgagtggttacgatttgaacagttctatacgatccccagtggttgtgatggatttaacgttgctgtatctcgttatcctaaacccgctacggatagtttatctgcgatccgtaacttcgtgatggttcaggtatctgctgccgaagctggtcaaaactttgctgcacagtttggggttaacggtatcagaatgaacagcatgatcgatggtggaacaccgtatatatttgaattgccgaatactaaggtttatcctggtggcgattattctgcttccgaattccgtgaagttgatgcataaacaaaggctcggatcatcgggccttataaatatgtaaaaaggggttattatggcagatttaaaagctggttctacagtcgggggtttacctatttggcactccggcacatttccgctggttccggttggtaatactctaacctatcgcggatataaggtttatactgaaaacgataaaccgcaagcatcaaataacgacttcgtttctaaagcaagcggtggtcaatatttgggtgtagttgcctttaaacaggggctacaaattaacgctactttcacaggcggaagtgaccagaacggtttatattctggtgatggtgatggcgcgggattatcaaaagccaacatggatcttgtatcatggtatggtattggtattcgttcatcttccggtactaatggtcgcgtattagtcatcaacgctcgaaatggtgatttaatcactcagggtaatattacggttgaaaagcaaatcagtattacaaccgctaaccctactgacgcaagtcatgcaacacgaaaaagttatgttgatggacagataaataatgtcacaacaaatgctaatagcagggtattacgcgctggcgatacaatgacagggctgttaactgccccgcaattcgcgagcacaggcgcggcttcccgtcccgaacacgtaccacggctcgaccaggtaattactaaagggactatcatagattttggatcttattaaggtgaaacatggctgatttagaaaaaattcaattcctacgtagcacagttgcggggaaaacacctactacaagtcagcttgcagatggtgaactggcgatcaacatggctgattatgccatttacacgaaaaatggttcttcgatcgttcagttagcgggtaaaggtatcccagaaacaaataccaaaaaattaacagttgatgggcctagtgctcttaatgataccgttaccgtagcggaaggtaaaactattactttcaccaacgagaatttaagtggtgaaataactcgtcatatcgtcggtaaatgtgccagcaatgatggatggtacatcggttccggtggtacaagcaataacggcattcttgaaatcggtactattgacgatggtactgaaacaatccagtttgtacaacgcggtgctggtaacgtagaagccagaaaattagtcttacttgatagctctggtaatactactcttcctggggatttaagattatccactaataaaaccgttaaaattagtaatggaagcactcttacgttagaaatgggtgtaggagctaacgatgtctatattaaaaacttgagaggctcgggtgttcttcaattaactaatgatggtaatctgtcgttcagaaattaccaggtttattatgccatgagtggaaaaggccctggtaaagatggtactcttctgactaatgtagaaaacgcgcgtcagcttgagcaagataatttccctatatcttcaggcaccgaagctcggtggactaaagttgctcttttaaaagatcctggatcaaaccagagtcgcctgcaattaatggtgactaacggcggtaactatggttctacgcgtggatctatcgactttatcgattgtagcgctagaaactttccatccactttaacaagcgctaatattcgtaatcatctacaggttcgtcgaatcggtgatcctggaattgataacactaaccaaatgcgttatagtctggttcgtacctctgagggtttagaactgtggtttatgcaacgcgcattcattagtagtgttaaagttgctctgctgtctattgctggcggtactgaatattatctgcctaacggttacacgactacttcaactgcgcccgaaggtttagttgagagtgtggctattcgtatctatgacgaaattaataaacctaaccttgacaatggtactgatggtattctgtctattgctaaaggtggtacaggtgcaagtacagcggatgctgctcgtacaaacttaggggctgttgctcgtgctggcgataccatgaccggtaacttgactattaacgctaacttaaaagtcgaaaaccctaatggaacgatggttgatttaggttcagagaactcagacaagtacagcagattaacccttgctcgtaaagttggtagcggtgctaccgtagcaatgcttaaagttactcctgaaggacacgtgcaatttggttatcaagatgcagttgctactccagctcctagtaaatatattctagttaaatccagcggtcttgaggtagaaggggatttagtttttaatcagacctatcgcggcaccgaagaggcagttgatattactgataagactgttgaccttaatggtcttgtcattaaaggaaccgacccaggtactcgtcagatgtataaatgcttctcatctggtggtggttctaatatagctaataaacctacctctgatggcaactttgttcttgaagttttatctttgcgtaaaatttctgatactgattggacgtgtaagcagacctttactacaaagaacggcggcgttgaaggtacgtatgttcgctacggacaaaacggctcatggtctgcatggaaagaagttgttgctggcgtccaaccaattaatttaggtggtactggtgcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcacaaggtggtagtctcggtgcgttaatcctgtcagcttctgcttctgctacagattcggctaaatatattgcttttcgacccttcggtgattcgtctggtactgagattagagtaaaagccaacgggtacaacgagccttcgcttgaatggtcttatggcgctggcgttcgttcatccgctgtaggtgcttttgtgatttatgcaaaaacaggtcaggcactccatttaagaccgaacggtgataattccggccaatctacagttattgatcaaaacggtaaaatgacagtcggtggtgagttcgaggcgcagaactcgaaaatcacaggcaacttgagcgtttccgaagataacagaatgattgttcttggcaaaaactctgatattggtttagtcaagaaaagtggtatgtcaggaaaaatggctattagtaaatctaactcgtttactattatggtatcaacaaataccaacaaccaaattaatcctgctgatacgtttaatgatatattcaaagtagatgctgatggaaaccagactgtttacggaaatgcccagattaacagacagctaacagtttctagtgcagcgactgttaatggtgttattaatgctaatggcggtatcattgttcctactaccaagtatgtacaaattgccgatgctcctacgcagaataaccaagccaccaacaagaaatatgttgatgataaggttgcttctgctattagtaatgctggcgacacgtatcttccgttagcaggtggtactgtaactgggcggttaacaattacaggcgatcagttaaaaactacatcactttgggttacgggagatgctgctgttaatggtgttttaactgttgatggaagggctaggtttaatcaagagttcagtgtatcaacctcagttaacgttcagaacaatggcaacagtcatgtgttcttccgtaaagcggatggtacagaaaaaggacttctttgggttgatgaccctggtaacgttagtataagagcaggtggtggttctgggccagtatggaatttctggaacagtggttcttgccaattcccaggtgctattagtaactttaatggtgttaatagtactactaattatcctggcggcggtattggcgcgtatttaaataccgctggcctaacaagtagatttagtaatggtgcttatgtttccttatacttccaagaatatgtaggaaattatcaccaggctattcttaatgttaatggatttggtcgagatgacaatttctatttcagagctggaggtgacttcttctgtactcgtaatggttcatttgataacgttgagattcgttctgaccgtagagccaaatcggatatcaaagttattgaaaatgctttggaaaaagtagaaaaactaacaggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatacaaggggcttcggccccttttaggagaaataattatggcagtaacagggccgtgggtcggaagttcggcaaaggctgaaactggcgaagcatggatggtgcaagctggggccaaattaagaatagggacaccgttttggatgtctaatatgattggacaaagcgtattccatttaattttcagaattaactatgcacagggttcttctggtgatccatctagatatagaggattctttaaaagagggttagcagtaaacataggagactctgcaaaccaaccgacgctgaatgcgttccctggtggagatgtgggttcactagtagctattacaaatatcaaaggcgacccttattgcctttctatttggaatggtcaagataggcgagttaaagtgtctatatttaatgcatccggtggagaccagtatgatgtttatttcagcggaactactatgagtgatggttggagaagatatagatgtgaaaacgctggcggtctcaatgggtattttgaggctagaatggataaccagtttggtgctttattagaatacgtttgatagataaaccaacaaattcacctcataatattaaatagattaaaaggctacctatatggtagccttttgttgtatcctaaatatacgtatagtaacctaagaagagtcttataaaaatggctgagagaaatcccgtggataaactagccttatttgatcgggtaatctcgtttgtgatgggtgtgaaaacatggaaacaattgctgataaaaataattctaataatggttatgtttcttatggtagtaacttggtacaaatggactgatatattcccgatgataaaaggtgcccttgtagtcgatacaagggctatcgaaatggaaagaactgaaaagtttaatcaatccgcgttggaacagttgagcatagttcatcttacttccaacgcggatttttcagcggtattggcattcagaccaaagaatataaactattttgttgacattgtagaatatcagggaaaactaccatcccagatcgatcctaaaaacctcggcggttatccgatcgataaaacatccgaagagtacacgaatcatataaatggcttgtattattcatccactaaagcaagttcctacctaccgacgcgtgattttgtgccagtagcttatacttttagttgcccttattttaatcttgataactactattctggatcggttttgatggaatggtacgcaaagcggcctaatataccagatatgaagctaaacatcatatgtggacaggccgcgcgtattttaggtcgagtgaggtgattaacgtaatgctggtgttaaattgtgtgttcttccaatagcccgtttgattgctttaaagaagttcatcaccgggctatttttctcgtaaatatcccaaactttcaatttgtcccacggatccggaacataatcttcattccttgccgaaacccccaacgtaacccgcctgtatccagcgctgtcgtgataatacacgaagaatggcctacctattggcgcaactttacaacctctcttagcggctctcatagcctcatcgaacgtcattgatacccccaaaaatttctatgcatgaatggtcgaattccgatagtttcactcaaaatgaatatcggatgatctagctcatcgtggttttcttcgtcaatgacgatatcccaatcagtagccttttgttcttctaccgtggcaatgaatacctggtttacttcacacttgcggtgtgtacgtctgatgattgtatccccttcacgaaacacaatcatatcagggttggtagtgcggtacgcggttttacccgcgcacacttcattaagcatatcttcgtatgtcattataaaacctttacacgttgaacgatggtttgtttaacgtctttgtattctccgtgctctttaacggttgctttgaacgtgatttcatcaccttcgtttgcaatgttattaccgaagtaaacaacaacattaccatcaacattaattttggtcatgaacctttctacagaagtgtagtaagaaacttgagtatatcccagtgaaatcactttctcaacggttccggtcatttccagacgttgtttgatttcaccgatgtggttagctttagaaatgcgttcctggcgctcttgttcccactgttcgcggatttcttcgcgtttggcgatataatccttctccagtgcaacacccatgcagtaagcgcacacggcgtcaaatacagggctgtttttgttgtcttctttagactggtcagcccaccaaagaacagtaaacattggcatttctgcaattacttcgcctttacgcttgccaatcggcatgatccctttttccagcagttccagtttttcagtatcgaacactgacagtttaccgcgacgttcgaacagatcgaaatctgcaaagccctggaataccattttgaaagtatcagtttcagttaaacgggctgaaacacggtcgaaatactcacgcgctttcgcttccgctttctccggatcggtagataagttgcagatatagttatcagaagtataaccgccacctctacgctcaacacgcaaggtgtacattgcatttttacgaccagaagaaatgaagtaagtggtagtaactacggttgcgttagtcatggtatttctccttaaagggtatctcgtttcgatatggctaatatagcaaaagcccctgaccgaagtcaagggctttttcatcattcattcgaatctttcattgttttatgaagatgaatatcaaaaattttccagtacgcctttccgcgaggataaatttttgctttgtcaatatcgttgttgcttccccatgtgttgtttgggccacgacatcgattttttatataatctgtatgccagaataagcgctgaaccgatgattccgtacctaatggatcttctttactgaacagaatttgtatactcataagaagaaccctgttctaactactaaatcgatctgtttttccggtatcagtggcacatctgcatcaacgttgcactgataatacatcccgacatactcatgaggaatgttggattcactcgcccatgccaggttgtcgtctgtacgcggccctaacatgaggttaacgatatcgacagcgcgatcctgttctggggtgttgttgcatccgttcacataatgcccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttaatccatgcatgtttcgctaccagattgttcatcgaggatataatggcacatgatgttgaatactgacttcaccatacatttttacgatagttaagctatcagatcctttaacaattctgtatttttctggaacaacgcggtcgatttcttttttgacgaagttaagcaatccgaagtcatctatatcttttggtgctttggaaatagaagacagtgatactcgttgacgcgaatcatagtacgaagaaattacaaacatatattattttccttattggggcttttcagccccattttagagaattaatccagcaatttgcggatcttgtctgcgatacgtccggcacgggttgcgctttcggtatgattgctttctttggtagccagttcagccagcttacgctgatgttcttcttctgctgcttggcgatctgctgcaacctgtgcaacctgctcattatcgtgagcaatacgcgcttccagttcagacagggttttgtcgaaagttgctacgatttcatctacagaacgaattttattaaacagtttcataatttatctcaattggttagttttaatcagtatacatcaatacggctggaattcaaaatcataaatgtcattcagtgcgcggttccactcggtgtagttttcaccagcaccataacgcatttgaatagcactttcgaacgttgatccgttgaggttcgggaaaccgaacaggtttttgattttgtcatgtgctacatagtacagagaagcactttccagcatcgcaaccatcgcagacggttcgtgttcgcggcgcttgatacgtaacagagtacgactagcaccagttttacggcgttgatttggtgctacgtagaaacggaatactacgcgccctgttttatcatcaactaccaggtaaaacccgttttctttcagatccacgccttcgaatttcttgaaggttccgcgtttcatgtcaccaattttaattgcgtatttgtgaatgtcaagtcttgtcagaattcttttcatattttttagataccagtttgcctaattttgtaatttcgcctgtttttacgttaacaaacaaggcgatgctcagaaatgggatgctaatcactacgctgatcaatgtaaacagaaaacgtatcacaaaaagaacagcacgttcaagatatcgttgcatccacgcgattcctaaacaactataccctactataaaggtggttgcaacataaaatgcaccaaatcctttacgaaatacgtaacctttcccggattctacccggtcgtcggcccacatttcacgggcagttttcagaatagattcaccactagcgcgagtttcgttagccgaaggcatgtttttaaatttcatgatagtctcctatgcgcccagaactctccaggcgcggttgtttagttagtaatggctaaaaccatatgtaacatcaatcatgactttataacggcatacacgcatttttgcgttattgtaatccactgggatcgctaccacgtcagcaggatccacctttacctgaatgactctaccaacaccgcccccgtagtgtggaaggtatgatttagccgcaacgtgtaggccagtagaacaggtgcgcgttttatcttcgtctaccatgtttcgaggcatggagacagtcacaccaggactattatcaaatttgccagtagcgagatctttatagttatcgcgtacacgtttccaggcaagaaaacaaccatcatcggtcagttcaatgtcattatgtacaaggaacccataaagctggtatacagcatcgcgtgaagggtttcgcatcaaccgttcaaagaagttcaccagatgttcatacggacgatcgttatacatttcgcgaatgattcgttgagtgatatcagaatcaaacactacatctttatatagaagctgatgaccaatgattttaatgttgcctttgctataggttcggatcgcttcttgagtatccaaacaagttacagcacctttgacatcaccagctttcagcatttcatgcgctttcttaaagttcggatgtgtttcacccgccatgaaaacgcgcccttcgtatacaaccgtaatgaacgattcagatccgatcatacgcggtacagtgtctgatactttaggcttttgttttacatcccttttcttagggaattccgctaacttgcggttgataacgcgcccaatggttcgggcgcttacgttgaactgttgggccagtgctgttttacttgcccccgtcaaccatccattatagatagctttctgttgtacttcgtcaagaattttgaccattatttccaccgtattaatttcttaaactcactgagattcttttcgttgttgtaaatcggacgaattgaataagaatcgctatgttcaacaagtgaagccagtaacgggtttagtgatttaaagatttcccatgcctgatcaacacgttttttcatattgctgcgtttaacgcgcattgatgctacagattcacgcagaatcggacaacgcgccctggaaagatttttaccatctttctcatacccttccagacacactataagttcgagggtatcaacaatcttatacagtttttcattatatcggtttttcacaatccgatcaagcgatacaccaaaacggctatgcaatgcgtttgtttctgttgagtgttccttgccaatccatccaggcaagcaattatctttcaatgccttttcggatttaacatactgcttgcacagcatatcatcaaagcataccagatttgaatccgggatccacttccagaggctgttacggatagcaaacacaacagggatcccagtatggcgcatgatacgcgataaagtagattctttcattgctgaatccatagacaacctggaattttcaccatctaagcggctatattcatcaataccatacaaccgaacacctggggctttatccagtgataaaaactctgattttgtcataaacagagaagtttttgccagattgccgttactatccaactcataacgatatacggtcggggtttttgggcgcggttctgaatttttcggtgcatatagcgcttttgatttttcgcgatctgcatcatagatctctttttcttttgtcatttcactggtacggagatacacaatttccgattcatcaaaatgacctttccgaacgatatcattaacaatctcacgctttgaatcactatcgtaatatgcaacaaagctaacacggcttaggttatgcattttagcatacccgacgatatacggtttaaccgtgttggtatccacttttaacagaatgagtttcttctgtttccacggataataaatgcgtgtgatgtcctggcgtttggttgtttctggcttatacttgctccagcggcctccgctacccgttacctgataccatgcatctttaccgtcgtattcgttcgcccaatacccagcaatataatcatcattatatttgtttggtttgactagttcgctatggatccagccaatagaatcaccgttgatgcgaaaattagcatctttaccaacaaagttttgtaccattgaaggcagagaatggaaccacgtcagtttatcacgaacggtttgtaacttatcgaattctgatttaactcgattgaaatacacccggctgatttgtttcagacgttctttaataatccctactgtcattttatccatactcaactcttcgcgagaaggcatgaaatcaagttcaccgatcgggaagtcaataatatacgtatactggctttctgtatagcaatagaacatcgaggtatcatacaaatctttatccagaggataaatgatgttacccatgcgagcatatacaccgctagtgtatgctgatttatgacggatcaccccgctatcgttggttgcttctttcggctgatagttgattttgagaatagaagcaccaacaaagttaggacgaatatcagtaaatgattcgtatacccttgctgcttcgttttcccattctttgatatcttcaactttaaccggaacagtgatagtaaccccgttaggttcatcactttcaatctcatacagaggatcgcagaacggttccccatcatccatatagattgtgtaaccgcatttgataccgtcttttacagattcaactgtgaacgcatcggcatagcaaagcggagatttgcaacccagacccatagaaccgatcaggtcgtttgaatcatttttagttgattcgaagtaaacggtaaacgcatcactaacgaaatcaggagacataccgatcccgtagtcacgaataacaaaacgaggatcaacagcagttggcaactggacatcaaacgggttctgatttcccgcttctttgtgtccatcgatcgcattacaagacagttcgcgaatgattgcgcggatcttgtatttgtatactgtcgaagaaaggatcttatacgctttcttgtttgcgcgtagagatagtttgtttcgtcccttgctggtatctgtaccaactcggtagattgtttgcggtgtatcttcgcgtaatttcattgtttatttctcacttaacattaaaaataacttggtcacaagagtacttcgttggctttttgttcaggccatattctactacttcgcaataagtgtcaaggaattttaccaatttttcttcctcgacctgctgtttcttcatatcaagtataccccacacgatagccccgataatgatagaaaagaacgcacaaaatccgaatatggtcagatattttcccaacttaggcgcattacaacgtgtcataccttacccctctttgcgaatgtatgcaagttcttcatgggttactggacggatatacagacggccttttgtatatgccttgcgcccactgatccaaatgtttttcatatccttaacaccgttcatcacatcgttgtaaaacttcttatcagctttagcctgatagacttcacggccttgataatctttcatgaacaaacagtaaaggatctcattcttatcaaccagattagcatcctttgtagttgttttactcggtgaaggtttagcacccaggcgcaaggccatagcttgccacactttaccatgttcataaccgcgcccgacaagagcatgagcgatttcgtgtaaaagagtgtctaaaatatcctcgtagatatcttccgcaacatgacgaccagatagttcgatcaattttttggtataactgcaacggcccagagtttttgtaatgcgtccattgatccggaatgtccaaccattactgatcaaaccgtgtttttccatcatggtgcgcgcccagtgggttacttccattgcactacgagttttcaacattttagaatctcctttgcttggtacaaaaccaatatagcaaaaagccccctgcattgcaagaggctttgttattatttcaacttcttagaaagttcttttaaatcattgagatactcaattttaggggttgtttcttcccagtatttcaactgtttacgcaattcttcggcttcgtcttccagctttttgctttcgtccgtggttagatggtagatgttcatagccactaacatttcggcatgattctcgcaacctatccacgtagacacgaatttaaccgcttcgctgcgactaaggccacgcagagaatcaggagattctaccatttgagcaataaacgcaacctttgccagtgctttatctaacgcttccttagtttcctggatacgcttattgatacgctgttgatatacattcatacgaatatcaacgaaatcctttagaagcgtttcagggcgttcatatgagtatagtttgccctcaaagataacgttaatgtttgggtttgaattttcaatcaacccgaaatctttcaggatcttttcgcgggttaacccattggcatactctcgcttgagcgttacttcataacgaaaatcttctttcgatagatccttgtagctaacgataacgcctttttcttccagcttgtcaaggattgcaatgtatttcacacggtcatacttcactgggatctcggtgatcaccaatttggttttaccttgcaattcatacgtgccgtaaattgtcccgtctgtgatttcacctttaaagtaagggtatttcagatccagtgtgaaatctttatcattcagatatgcaatgcacccgttaacaaccgatttaggatcatgaggcggaatgtttgttgcatatgcttttgcaatcccgctaaacccgttaaccagtaccatcgggatgatcgggagatagtaagctggcggtacatgttccggatcttcatgaactggcgttaaatcaccatccatataaattgctttgaatattggcgatagtttacacttgatgtaacgaggtgcgccaggtttcttaaccaaacgggaaccaaagaacccatcacggtcgaataacggaatgttattgcaccagtgcgccgccataagggataacgcttcttctacagaggtttccccgtggtgatacccatacatagcaacaccgccagcgatagaagctactttctgaaatcccgttccgccctgcatagcagagtgaataaagaaacggtgaacgggtttaaacccgtctaccaggtgcgggatcgcacgtgaataaatcgtgtaaagggcaaacgttagtccttccacctgtacaacatctttaatacttctttccattagtcaaccttagaaaatttgtgttttccattaacccaatctttacgcggatcagattcgtcgccgaagcatagttctaacacttctttgtattcgtcgtcaagtacgatgacatcatacttcaactgatcacccagaacacgatcgtaatcttctttgcgtaaagaacccagccccttgatatatcgtacatcttttgctttatcgcggaacggtgcaaactcatcaagagaatagaaccatttttcctcgcgcccaactttagcgataacgatcggggttcgaatatatcggatccgtttctctgtgaacaaagaaggccaacgactaaagaatgcaagcaacagggttaaaatgtcgccgccgtcaacgtcagcatcgaccatgataccgatattatcataagtcattccggaagtatcaccaggatgaatattgaggatagccattagctcaaacagttctttgtttttgataatgtctgtaaaactcataccccatgtattcagaggcttaccacgtagcgggaaagcgccttgtgtttcttcattacggcattcgatgaactgaccaacagcggaatcgccttctgtcagaaacaatgttgtttctaccccaggggtatcaataccggaagccggaacgtgtttagcaatttttgcctttttcgctttctttttcgctttggtgatcgcggcggcttctgctgcttgtttacgaatcaatgcggattcaatgatcggagtaatgatttctggggtatccataatcatttttgcgatctttttgtagttcaaattcgcatgattgttaaactcacctgctgtatttgctaatcgctcttttgtttggctatcgaatgcaggtgcattaaagttatgcaggaataccacaagagttaagcattcttttacacgtgctttcgggatctcgatactatgctttttcttgatcatcggttcaagttcagaatagataccatcaatcatacactcaacatgaacaccgccgtttttcgtatccagaccgttaacaaaggatttctgtttaaacccgtcctcagtgctcgccagaatgaagctgaggcgattatttgtctggacaatggttttatccccatacatggaagcgtacagcgggaagcgattagagagcgtttcgccgttatatgtgaatttcacagacgggaaagcaacggcaagggccattaagcgatccttaatcacttctttggtttcttcatcgataccagttacaccaaacatagagaagtctggagtaaacttaacagtagtaccctgttctttactggggctggttcggtaatcgatgttctgtgcgccgtccgtacagttaatggttactttgcgtttcccgtttgcagtctcgccaataaaaatcgagctataacagtttgtcaggaaagaaccaacaccattcatacccatcgttacgcggtttttatcatcgaagttagaacccgattttgccatagtccatgccgcaactggtttaggaactattttcccatctggggtttttacatcatcctggggaataccgcgcccgttatcagagattttaaccagattatgatcaatggttacatcaatcttattagcatgtttgaattcagttcggatcgcttcatcaatcgagttatcaaggatttcgttgatgattttaaccaacccttccacgtactcaaccttgcgatattggcccattatgaaacgttcatgcgcttctttgttaaccgatccgacgtacatatttggacgcaaccgaatatgatcgcgatcgctcatacaaaatgattcgtcaacctttgcgccttttttggctggttgtggtttctgttctggttcatcatctgccagaagaaaatctaaactcatattcacctctttgtttaatcactgacattatatagggttctatgaaaaagaaaacccctttcggggtttacttgttataagggaaaccatcacgaaccatttgaggtttatcaaccgttcgttttgcttcgcctccgcaatcgcaatctttcggtgcatcacgggtagcaatgcttgccatttttggaaattctttattacacttggtgcatttataggtataggtaggcattaataaatctcttttaaacttaacatcttaactaaacgggctttgtctatgtcaaaaacacattgacgtgcgcccggatacaacttttcaacttcgtataccatgcagacgaaaccaacattgtgcatgtactcgcgttcatatgcattgaaccaacgagaaaggcgctgtattgactgaaaaccaaagtataacccagccgcttgaaagtctatgttatctttttcaaggttgcgcatcaatcgattatcgtcatccggcgctggatgtcggttatcatccatatcaatatagatatcaggattcatacagaattgatccaaccattcagcagtatccattgacacataacgattgacatatgggccgctttttgtttgccatttttctgtacaatcattccagaaagaacaagaaaattccacacgatatacgaacatgatataatcctcacaagtaaactcaaggtttacaagtacgataccacttatctaatttttctgcaagcatttcgttgataatttttgcaatttcgtaccgtccgtgagtagtacccagttccaggtaaatcacatcaagtgcgcacacaatcgcatcaacactttcttcaacgatattaccgccgcgttgaggctgaatgaggcattcgctgatctcgccaacttccgctgataggtgatgaaccacatcactcttcgtgcgtttcttcactttatgagcgatttcgaaaaacttatcaagtacgatcgccgtttcttctcgcgttgcagtattctcggatgtcgtctccgtttgttgaacaacgtattttgtaaaatagttttcaaacacgttgaaagggatcacatgaggaacaccattcaaaaacaccccttctttacaaacataatggatttggcgcggaatagacaacccgccgctgcgttccaaatgtcgtttaacgcttgctacaaaatcgaactctttcccgtatccagccgacatactgtgatacgtgagtaggccaaatgcagaaacatagagatcattttctttatacagattcatttacaatacctttatggtagccaaaaatataacaatcaattgaaggacgttcaccagggaagtgaatgcattgcatgatgcgttcagccattagatcttctcccatgtataccgaagtagtttcttcgttgtaatgggtatcatacgacgttttaagcgtcatgcccggaagccctgcaatgtgcatgaatttagaattggtgcaaggttttcctacttcaccgttaatcatcaacactgcattagttttacgtgcttttctcatttgaatttcaccccgatttgcgatacgttccattcttttacttcatcaacaatatcataatggttgatgtatggtaaagcaatttttaaattactcgcgtcttgaatgttgcgtaagaaacgagtaggagaaagaagacacaaccgctcggatccgttgtttcctttagcggcaaatgatagggtttctcccccgtcaatcttcatatcaacagaaatcgttttgaattctggtgcgtatgacgtgattttgccgttgtctctcggcgtactatagaaacatacactttgtgggacattataacgatctgtttcaatgtacatgtaatcgccgtcagtcattccccacgcggtataaagggatccggtatagtcaccaaaggaatttttaaaatcttccttcgtggtatatcccagcgagcgcaattgcataagctggctatgctgttcgattgcgtcggctttttgttgttcctgtacttgcgcatcaatcgtttcttgccaggaattatacgcatagtaacccacaacagcgattacagccataacccctacagctttccagattttagcgtcttcgtttttgttactcatgctatattccttttaagaaaaagggccgaagcccctttgttaacgaagataaaccacataaccgctttggtcaatcgcgcggtctgcgtcattgaagatattaccacgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactataccaaagctatcccgtgaagtctttagcaaaaagtgctatttgttaaacccgtttcccttgataccatttcgggaaagtaaccctctcgataaaatttctccccaggttgaaactatcaccgaacaggagaacaccaaacagcggatcacgcttgatgtcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccatcgctactgcgtctttttcattgaacccgttcttaaccaggactttaactactttggcttctaagtttttcatgatgcgttccttttgtctgtttcgtttcgatgtgtgtaatatacaaaaaagcctcctgcattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattatttgcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgttttatcctcttttgtttcagtccctacaaaataacaaagcccttgcacgaatgcaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaagggccaaccgtttcataatcccatacgtaatctacgggtaaatgactcatgaagttctccgcttataatcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcaatttcttttgcaataggactccatgaataacttggcccgttcggagaatacagaacatcgttagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccttgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagtgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtcagtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacctcagaaagtgcaagctgtccaccagtgatagcgccagcattatcaacaaacaggctatctaatggcccctcaagaagataaaccgtttttagcggatctatcgtatcctgtccgtaaatcttggttgattcttcacaggctttgattgtgatatatttcgactttgccccgtcgcgtaaagcacgaccctggaaagattcaattttccctttcttatcgaagatagggatcactaatctcggttctggttttgcgatcggataggtatccggattcaccgtattaaccagttgttgccattcgcgagtaaaccacaaccgatcccacttgtcacgggggatacaacgattctgcacatattttatgatcggatgttcatccggcaaggtatctaacctttcgcagaattgaagagtaggaataaatttcttctcttccttcggttgttctgtatgcgttggctttaacgaattgcgatccttaaacgattccatgagataatcacggtaatcgtctggataatattctttcaggaatacgctaaacggtacaccataaccacagttaaaacaaccacaattcatatgatcaccctttttagaagggtagatccaaaatcgttttttgtacttgtctttcattgagtcgccgcaaataggacaacgcgcattgatgcttaatgcccccgatttacgaacgatttcgctttgaggcagtgatcccatgattcgggttgcaaattctatatcaagatacatttcttacctcagttgactatctttagatcctcgtcgattataccccgcgctgatcatttcgtcatgttctttttggcattcaatacaataacggcaacccttcacgatagccctacgtttttcgggtatcggatccccacaatcaaaacaatgcgttaatgattctccgtttctgatttgagaacgtgcaaaatctatcgcattgtctattgttgcctgaatggtatcttgaacaccgtcagcagggccaaatccaaccgccattgtaaatcctcctaatcaaatgatttcaatatcatagactaagaggatttttctgtcaagaacttacttgcttttctgttccgtcaagcattaacttccaaccacgaaatgcctgtttaaacgaataatttattgcaatatcaattttatcagaaccttttcgacgattctgataaacggtcgcgttgtcactcatatacatgatacaaattggaaaccatgtataatcgttagcagtagcccagatagtgatattcagcggaggaattatcatttctttttccttttccctgcacgggtaacgcctaatactttcggcccgatgttggttactgctccagtagtcacaccagaagcaatcttttctatatcgccgccagaatcaccagcgaccatatcctctaacatacgccccttatcataatattctttgaggcgcggaacgttcatcatgatttcttcatgctcttgttctgtcagattgtagcgattgcgtagggtatcatatgaacttgttaagttcataaacccagtcatatacggaacagaattcattctacgcttgatatggcgtactgaacgatgaaaaggagaatacgcttctaactcttcttttgttttggggttacgaattacttcgccttgtccatcaaggatccccagtttataagcagtccattcagtccagggctttttgagtagccggatcatccggacgctatatgttaaatccatatttttaactaattgatcactcatgattattactctattgtgaaagtgaataaatcagatttggtttcaggttcaaactccatacaaacaacctcgcatagtggtttaacccctttccaatcctccaggtaatacccagtatctataccgcatccaggattcataacgaggccagtttcatcaagaaactttttgcatttacttgatgtggtgctgtcatcttgtcggaaacagtgtgttttcgaataccggaaatttgcagacatttgagggattatgaaagttccctgacgagcgatctgtgatgcacgttcgattactttatactcaaattctgcccctgtatacttacccttaaaatcagatgttttgattttaccaaaaggcggattactgatcgccatatcaaacacctgattaaattcagttgttaaggcgtctccatgcacccaggaggcttctggtacgatacgcttacctaactcatagtatgtgtgatttaactcaacacagacgatttcacgcggcgtattgtacatcatgtaatgaaccatagcgaaagataacccaccgataccagcacacaggtcaataacacttccacctgtgcaagcatcgattgtgaaatcgcgagcaagtccaataggggtaaagaacgcccctaattcagaattgtttgtaaacgcgccttcatgaaagttttcaataatgaacaacttctcttcgtaagttagcgctttgtcagagtgaaccagatccattatctgattgtgtttcttggtttccgctttcgttaactttgccattttcccagctatacaataatgttgattcgttagggtagaattcccatccgtctacatatccggtttcccagtcagtagtttgttcaaaaccacagatccattcatatacaccaggaggcatttcgacagaatcaggaagcccgatatcttccgcgctgcgtccacattcaaagaatgcatcatgaatgaatggtcgagataataccgtaacataaccttcatcgtcaacagctacgatccagcgcgaactgtgaggactatcgaacttcggttcttcttcgtctgcgtcagcttgcatttcggccttacaaaaatctaaatttatcatttcaaaccctctttaacaccctctttcatggctttccaggtagaacctgcttcaccattcagggcggcgaatacaaatagtaagatagcaaggacaagattcacaccagcaatcaccatgattttgctatacacgaaaatgtaaggcattgccaccacccaccaactaaaagaattaccagttacgatgttgagtgctgcaagtaagaaagtgataacgaatgcgattttcataatgtcctcctttgttatgattaaggtatcatcttttgcgaaagaatgcaatacctacagatacaaaaaagcccctttcggggcttaatttttatgcgttattgatgagataccgaagaacgtttttcgcttgttcctcattacaaccaactttgaaaccaggttcgatagggaggaagttccagaggaaatcaacacttccttcaacgtcatctttgcctttttccagcatcgctaacagtaaacctttgtttttgatgctgtttacgattgcgtcaaaataaccatcgctgaaatcaacattcgggttcagcatttcgttgtaagggttgttgaatacgttcattttgaatctcctttgtttaactcagtatcttgtctacgtgagttatattaccacaatggagattcaggtcaatacctttttacgattttttgaaaaatttttcgtatttggcttttacccagcgatacatatcttcggccttgtcactggcaatcagtgagaacagcagatagatcgcaacacccaccaacacaacgcctactacaatgtagacgggtaatagaactgggaagagaacccagaaccatgacatatgcgagaagccaaatactttagccgctgcaaaaatcagtgtcagtccagtcagaagtttgatagccggaatcggaatcgttatagtcttagtcatttcattaccttacattctttatggggctattcgccccagtcaattaaaattgaatgtcagattttgcaatctgtgccattttttcacgtcgggtagattcagcctgtttaatcatcgggccttgtgtctgttctactgttttaggcatagtgttgccgtggtagtcagatttaaacccgtattcgctgttgtcggtatccatccagcgctgattaccttttcgaacttccaacttgaacttgttgaaagtgttcttatcgccataacgggatttgatttgcttgaacagttgcataccctgatcagctaactcttccgtctcgattacagctaacataaaatcagccgtagcaggtaaaccagcggattccgcaacatcacccatactcacatccgaactatcccatgcagaacgcccaacctgtgcgcctgtccacattacggtattagtttcaacagcaagaccgcgtagttcttcggcaattgctttaaccagaatataggtattttcagcacctttaacgcgggttgaagtacagatccccaggtaatcgacaatgatcacatccggcacaaactgtttcttcaatttaagctctttcacaagcgctctaaagtggtttgcacctgcacccgatgtagggtactgcttgaccaccaaacgcccaaccttacccgctttaaggcgctccattttgttcttatagtctgcgtatgtaatgttcccttcgtcgatgtcatccatagtcacatcaagaaggttagcatcgatacgcttagagcaaacatgctctgccatttccatagaaatgtaaagaacgtttttaccctgttgcagataatcagccgcaagagaacataagcccagtgatttaccaacgttaacaccagccatgatgatattcagtgtaccacgttccgcgccgcctttggtgattgcgttcaggatcgggataccaaacggaattttcatcgccttcgattggtaaagcatccaccgtttttcataatcttcgaaatagtcatgacctactgaactatcgaatgaaattgctaatgcttcctccatgatttcagggatagccccaacaccaggaagtttcttgttctgttctgccagtggtttttctgcgttagcctggatctcgattgcgcgagaaagagcacgatacattgctttgtctttgcaatatgtttccgtttccttcattagccaatctaaatcttctggcgcatttttcagcgactgaatcgcctttttcgtgtcttcgtagactacatcacttagatttcgtttgtcaagcgcaacctctaaagcagtttttgacggaataccgttgaattcctgtacatgtttatcaatgaggtcaaacaaaacttgtgcattgccttcaaaatattcctttttcagatgaggccatgcttggacaaaatacgtcccgttataaatcaggttagaaaatattgtatcaacgatcattgtattgccttataccaggttgctgaacatcatgaaaaagttgtaaaccttttgtttgaatacatcccataatgtcagcttaggctttgggacaactgaacccttttcaagctctttaatctgtgcataaattgcatcatgcaccagcgggatcaacgcttctttgtcttcgtctggggtactgaattctactttcagaccatgatcccaaaacaccttatgaatataaaccagatgcgcaacacctttttcatcgttaatcagaagttcctgaataacatctttcatcgcttcatcaatataattctttgctttgctctcgatatccatacattgcctcggttatggggccgaagccccatattttataaaatttcgtcgttttcttcgatatcatcaaatgattctgggatatcgtcatcacccagatcaggatctgggatgctatcagtgctgtataaatcttccagcgcggaaccatcactgatttcacgatcagggatcttatacttttcttcgatagctttcaagaatggttgatgagtaaacagaggacgccagaattcaacgctatttgtttctgactcacgccatttcttttcttcaacttcgagttcgccagtctcggtattcaggaaagcacggttgcgccagcctttggttacggtctgtacaaagttcatttccattgccagatccagaaggccagaatacatactaataccgccttcataggtaacatgcagcgggaattttgatttctctttcacgaatcgagatttttcgatgttcatgatgaaatcataacccactacctcagtaccttctttcacctgttgtttacccaggatgatcgcagtatcagcggaatacattaaaccagtaccaccggaaataactttcttgctgtacatttcttgtgtgtcataggtatgacagatacaaaccatcgggatatccaggtcagccagataaggcgtaaccatacggaacataccttttaatgcttttgctcgcgtcatatcctgtttatcgttatcagacagcgcgtcagcaagttcttttttacttgccgtgttgcctactgagtcaacgaatacaatcaccttatcaccgcgttcaagcgcgttaagctggcttacaacgtcattacgcaactgctcgaccgtcgtgatacgagtatacacaacacgatccggatcaacacccattgatttcagataggatttagtaacacctttttctgaatcgtagaacaggcacacagcatcttcatacgttttgagataagccgctacagtcagcaaacctaagttggatttgaagtgtttggacgggccagcgaaaagggtaagaccagaagttaggccaccgttaaacgcaccggacaacgccagattcagaatcggcacacgggttcgcgtgatggtaatattgttgaatacgtcgctttcagaaagtacagatgcagtttggctattcgagtttttgatcagtttttttagtagtgctttgtttgacatttaatttttccgatttattcattctcattctatatatctcactagttaatgaaaggggccgaagcccctagagtttaccagtcaccgaacaggtcgtttaaactggcacgtttttcataatcaattttacatacttccgtgatattagtcaatggactaataacatgtttttcaaacatacccggataatctacccatgccagaatatcactttcgatctctgacggtagtttatttccggattgccacgcgatgcaatcggcttgccacgggtttttatcccttagtggtagaaccattaccttttcaccttccatgattggcgtaacaccatcaataccagcagtgaaacggttaaagaacagcacccctttaatatggtttggtgttccttttattggatatccagccccatcacgatatttcgaaatgttgttggcagatgatacaccagcaatttccctgtagtcaagttccttatattcttcttcgaactttttataatgttcgtgtaaagataattcaccttcttgcaggatacggcggatcgcttctttcaggaatactttcacagaggtcggagtactcgaacgctgtgtttccatacccatgattttcaatttcggtttttcatagcgagttccttcggagtcccacacgttagccgcatatcgttttttagcagtccagaaacttcccaacccttcggaacccaacggaggcccagaaatgatttcacgatccataaacatcaggtgttccacgttgttcatgtattcgcaaagttcacgataccctttatcgatcattggttccattctttctttagcaaagcgatccaggaagtcaacccaatggttattatccttaaatttagcctcaccaccaacttttgcaatcacgttatccatacaaacataaatggagtcagtatcacagtatcgaacatatgcatgatccgtagtaccgcacaggtcgttaagatattcgtttaccttacgttcaatccactggatagccaactgcccgaacatggtgatcgcgctggcgtttcgtagatcgaagtatcggaagtgttcgttacccaacgcaccataaagggagttgatagaaatcttacggttaagctgtgctgtgttcgcttgtgcgatcttcttctcacatacgcgcttaactgctttaagcatttgttttgtaagagttttcagaactgctttcgattcatcactgaaatctgtatagaaatcaaagtcaggatcaatcatttggttatgcgcgtctgttaagtgttcgagttcgtgcttgatgagttcaagatttcgctcacccgccatcattcgttttttccacatcttacgctgatcaaatactttcttgatctctactgggatcacgcctttgatatcacggcggaacatccacccgttaggagaacagctaaattcatcgctagggcgcggcgcggtcttattaatatactcttcaagagcacgtaccgcaaaacttcccataatcgtttcagggcttatattcacctgtcggatgatggaagggtacaggcttgttaagtcaaacgataccatgtatttgtaaggcccaggaactggatccttcacaaatgccccagggtaaggggttttagtatggcgtctgttttccggaataacaaccttatcttcacgcagagagttataaatgatcgcgtcccacgttttcagcggagacataacccctgggaagttaatttttgcatagtacgctacagacagaaccagttcaataaagtttcgtttaccgtcgatatcaagtacgcggataacgtcaacaatgttgtacgtgatgtacagttggtgatcgcgctggcgtagttcagacagggaaccttcatactcaactttatttttaccagtttcgtattccgcgatcgcgtccagacggtaagacggttgcggggtaaagctgaatttcttatacagcgccataccatccatttgagcaacgccgaaaatatcatatcctaattgttcgttgccgtaagcgtcagtagtggttctggcggttactttaccaaatgggctaaaatgccttaccacgttttgaccgaaaatgttcaggtatcgcgtgatgatatatgcaatatcgaatttgtcagagttccatcctgttacaataacaggggttcgctctttccaatctttgatatacgcagacaataacgacttctcggtctggaaagaccgataaacaattttgtttaaatcttcttcgctaatgtctttgcgatcaacgttttccgcgcaccattccgcaaggccaccctcaaccagatcgtatacatagaatttatcttcaatgctatcgtaatgggtaatcgcatcgattggatattttgcttcacgcggatccggaaattctggggcggtcacctcgatatcgatagaagcaatgcgaatgtgttcgcggttgtattcgatttcattccggtacatgtcagaaatgtaagccagtcgataatcgtccatacctagcgcttccatcccaacatcgcgcatacgctgcatccagtttttagcttctttgatgctgtcaaactgttttttgaggcaaggcttgccataaatgtctttgtatggggtttctacgccgttcatagcgtgttgatacattacgggcgcatatttcgtcttacgtacctgttcggtgccgttagagtcaacgaagcgctcgtaaatggtatctcccatttgttcaactgataggtaaaattcattcattggatcttgtcttctccattaatataatgttccattgtaacaccacctacagcaaattcaagtttactcgatgttctaaaaccaacaacccttctgctaacaagtcacggatctttctcagttgaacaagctggcgttcaagtttaaacccgtcgaataacatgctaaaaatactggaattgatactatgatattttgcttctgcaatgccctgattaaccatcatgatagctttgttaaccagtagtttcctttccgttactgtatgttcatccagttgacaggttgcaagggaaaccagatcatcataagcacgttgatcaataacgttatccatacgggccgcgaaaattttattcatgtaagtgcggatcattgcgcgacctccattcttttcataaagacttcttttgcttgttggatcaattccagagattttttaatacgctcatagaaatgagtggtttcaacttgattgcataacaatgtgtactctgaaatgttacgatcgtaaaatccaggaaagtagtgttgtgcatagctataagtgcgggtatctgacagattgcaagttaacgataacaagatgtcatcttttacaatcgggatgatcaaagtttcgttggatttgattgaatccatgatttcgttaatagtcataatatatccctctcaatggtgtacacccaatataacaaagcccctgcacgaatgcaagggctttttgattagtgaccgatccggtacttgtacttgaggatccaatctgctttttgcgagtgagtcagtacgcggaagttgttttcttctgcaaacttcaacccaggggttacgatcttaaccatgccccactcttcgagaagtcgcgcaatgttgttccggcgtagttcgtcttcttccgtcatatcgacttgacgaccatcgagtttcaacagttctttaaaatgcacgataaaatacttaccttgctttttcagaatgtggcacgattgccagagcattttctttttgttgtttgcaataccaatacgggttagcgtttcacggatctttaaaaaagaatcgtcgctgattagttgaatttctaacatacatcaccattgtttaatcaatttttccaatttcttttgttcagctttgtttttcacaatacccaacaaagacagagcgacctttgcgtgttttcttttccaatcctcgaacattccgaggtctttaagttcctgcaaatattccatcgctgtacgtgtatttacactgtatttttcgcgaaggatttcgataataattttctcttcaaaatcttccgatagtttagcccatgcaccgaagcgtttagccttcctaacagagttgagataatagttatagtgcatttggtcagagatactaccgcctaccagattcatcacatacgcgttgtatatcgtgtctatgtgctggctcattgcgttgtctacaaagtacttatcatacacttcatcgataaccaacggcgttttgccgttgttgatttcgtctatgatgttaaacaaggtgttttctttatccttgccgtactctttgaccagttcttcaaccttatcccaatctttagaaagccaagcggattcatgcggggataactcttcttcatccagaaattccgccaggctcatgattacgcctcccagaccatagaaagcatcaggttcatcaacagatattgcagatgaatttctttattcatcgccagcccgtattgcgcgttgttttcgcctacaatctgaatcagtgcgattttagaatcctgattcacgataggataaatcgtatcagtcaattttccgataaaggtatcgtattctgacgcatatttaataacctcagagcgcaaccctttatagttcttttctttcaacagggtaatgatatgagacacatcagaaccaacgatctcatttaggatccccgcatcaatttcaccacgtttcgagtagaacccaatcgctttgataatagaacgcgcatccggataatgctctttaacaaacgctgcaatgactttaggatcatacttgatattctcgatttcaaggataccgaaacaacgcttgattaactgtttcatcagttcgatacgttcagcatcagacggaacaccgaatttaacaggaggacaacgagaaagcagagcactatgcacaccgttaatgttgttcgctgttacaataacagaaacgtttttactgtatgcttcgataaagctacgcaagtgtttctgtgcttccgccataccagaacgatcgaattcatcaatgatgataatctttccgcctggtttctgcgtcattgatgaagcaaaacgatccagttcattacgaatgaagtttacaccacagttcgaaccgttgacaaagaacacctcagcatcaacctcacgggccaacacaagcgcgagggtcgttttaccagtgccaggggaatcagatacaagggtcatgttctcaacacgcccagatttgattatgccccgcatagcggctttgtcaccagaaggtaaaatacactcttcaatcgttgttgggcgatagcgctgatcccatgcaaattcatcaggagatcgagagattttaccgtatttggtttcgatgatttcaatattttcactaagttccataatataccttcaaaataaatggtgtaaaagaaaggggccgtagccccttaaaactatcttacttgaatgtgctacttgcttcaagtacgacgacgtaagcaacgccgttatcagaagagaattttgcggcccctttggaggaaatctctactttgtaatcgctgttgatgaactgcatgttatcaatcttcatatcaaaattgaaaacattgtcgccttcatactcaccgacttcaacggagaaagttgattgactttctttgcttttcgcggtgatgaccagtttaccatcaatcggttcaacggacaggtcggtcagtttcatcatgcgagacgctttgatcagtttttcgaaatcgttagaggtaatctggaaaatcagatctgctactggcatcaccagacgttttttcggtttcgggatcgttgttgcgtctgctgaacgttcgatgatcttcatcttgtcgccgcgaatcacgatttcaccagttgaaatatcatgagtgatttccgcgtcagtgccgacgatgttcagcatgttcaggaatgagttgagatcgtagataccaacatcttcatcaatcacatcagcaatttcagcttctgcgtatacaacgctgttgattgatttcgtcatgatgaatgaacctttggtcagcatgatcgaagagttgatttgagaaaagtttttcaggatatcaatagtttgtttagagaatttcatattcagcctttagttttcaataagtgttacttaataagtgattttacaacggtttccgctgctgtgtcaagcatatcagccatttctttaacggttgtacgcttcggatcttcgcgtcgttcgctggtaagtttacgatgttccgcaaccactttttcatcaatgtcacgatagtgtttaaaacgttcctcttgaggcatagctttaaacagttcttttgtttcgtccgagagtttagcaacccaggatttacggacgcggttcatgtagtcaacaaaaacattactttcattcatatatttcttctctaacttagaattctttgagtgggggccgaagcccccgcttgtattacatgtctaacagtttatccaggtcatcatcaccggagctatcagaatcatccagatcgaacggtacgccgtcatcttcgcctaccggaaccgatgcaacaccaccagatgatttcacatcagatgtctgattgtcaaacttagccatttcgttatcgaagttgctcagttcgctatcaaggtcagcggaagcgctggaaccagcagaaccgatcgaactacccataactttattgaagcgagtggtcaggtcagccagcggtttaaattcgctttcagcggtaatcgggcggagatcgctcataccttcgaaaattgctttctgaacttcttcatcgtctatgtttttgatcttagccggaacaccaaacgagctatcgtcatagttaggccaatcaccaacttttttcgctttcagggtgaagttagcaccatcaaacggacaggttacagcaatacccggttcatcaagttctggattaccgttaattgcggcggtgatcttgtccatgattttcttaccgaagcggtatttgaacaccttaccttcgttttctggagcgcctgggtctttaacgatcaggacgttagcccagaaactttgtttacgaccgatctggctcagtagcttatcttctggcccgtttttgttggctttagccttctcatacagatcgttttcggaaatgtacttacatgcaggacagccgtcataatcgccgtgggtagaggaacagttctcaatgtaccactggttgtttttcttgaaagagtggctcacgatacggacgaacgccagttcatcatcggaacgtgctgggaggaatcgaataacggcggaaccgtttttctgtgcgtccagggtcagtttccattctttctcatctttctggaagccggaaccacctttcagatttgctacctgtgcctggagtttagcgggatcttgacgtttaaaaatgctgctcatattctgttttctcgtttagtttagtttgattaacgtttgtttcattaagtttcgatattttatgatatctttttcagtaaggtcaaatatttttctgtatgcctttaacttaatgctaaagtcagaccaaataatatcatcagctacttgatcgtgtttatttatgatacctaaaaatgagtcaaaaatcaaaaacgattcgtaagatatcacatttgacaggacaagtttgcttatgtaggacgttgatgatttttcgctgtacttgaacaccagagacacggggatctctttcattttggcgaattcgtacacgtttttaacgtcatccacaaacacgttatctagtctttgtaactttcctatgtactgcctgtaaaagacaatactatcttcatcaacatcgcctacccagaaatccggattggctacgaagttggagaggaatataaaatagatttctttgaatgtaaagcgttgagctaattttacaaagaaatatctatcctttcgcttgttaaaggcgttttcactaactttgatctgccagttgtattgaaggacatcaaaacgcccctggaaatgagttttcatcgccagatataacttgtatacagacaaaggcacaagccgtgaattcgcctcgctatcagcaaacggagctttgaatctcacatgaagccgtccagagtggttgatgaactatgttcaagcgcaaccgatgggcgaagcatgtttcctttgatcgcttcgtcgctaatcttatcaaggatcgcgcgaggaaccgttttattcagcatcgcataatcaatagaattttcatccatccattgtagcgttgcttccatgtaggttgccccctcagaggcaaccagattttcgatatacaaaccgacttcggtcttatttccgatcatgctttacgccttatcgatcatatcatacagttcgatcagttcgttgttttcttcttcgaaagcggtacgggcctgttcgtgatacagtttgaacagtttcccgaaggtttttccatcgataccgaaatcagtttttgctttggatttgatatccttgaacgtaccgttgaagatctcaacttgagttttcacgttggatgcttctttgatcagttcttttacctgttttgctacatcagggtttgtttgtaaaaattctacactcattttgttacctcaaaaatcactcagtttttcgaacatacgggaaagtttgttatccatgaagtaacgttccattttggctttacttccggattttggagtattatacgcttcaataatcgaattttcaatatcttttggtataaattcgaaatcgcgtagttcctcattttctttgtaacgtgcggcccattcaggggtcatcaatgttgtcggatcgtctgcctccagccatgcctctaactcagaggattttaccgctggggcgcgttcaccttcaaccttcgtcacaatataatcatttctaattttaatgcaagcgatactatcttttttatcgcctttgatatttttgtatcgcagatcgttacgtggcgaaccgtacttaggcgttacccattttttctggggaggcgaccattgacgaacaccgttatatttctgtagttgtgtaaagtcgctatcagcagaaaccactaatactcgtctaccttcaccaacagcttttttcgtaacaacagcaattatatcatcagcttccgcgaattcaacctttaatccgagataaggcatattctgacggatttcttcgaacacaggattaaggaagttgttcagacgatcccaatcccattctgattcttcgtgttcgatctgacgacgttttttgtagtaccaggctttttgcctacgccagtaatttctgtcatcgaaggcaatcacgatttctggatactcacctttaaattttacaacgttaaaccgtaaagtgtcaagcaccagatgacgaatcatttcgatcgtgatggatgcttgttcctttggtttgaagttgttcatcagtgtagcgatggaaatgttagagatatcgatgaccatagtatcatcgggttccccttcatcttgcatcagcttgttcaagttaaacatgcttgcaaaactgctcatacatacctcaatttttcaaagaacggggttattgtagtaacttacgaaatgaagtcaatacaaaagaccataaaaattttgatcaataatacttgatctgatcaaatttatgatctataatttattaattaataattattttactacaatgatcattgtaggtcaagtactaaaatcaataaattttatataatttagatctgatctatagatcattagatctactttaaccttaaataatatagaatgaaatttgattttgtctacagttattatataatattcttaacttcaaagaggaaatatgaatactatgactaaagaaacaaccaatatctacgcagacaatgaaaaattataccctatcctctgtgcatggaaaaagcaaatcgccgaaacaggtgatcgcaaaatgcctaatgagttgggggctgctattatggatattgcaaacgggctatcacgtcgttacaacttcaaccgttattccgaagattggaaaatggatatgatcgatgacggaatttccgctgcaatctcaggactgcataacttcgatgaaactcgttataccaacgtttacggttacattaacaaagcatgttggcaagcattcgtaacacgtattctgtacgagaaaaaagagaacgcgaagaaatataaattcttccttgagcacgtttacgactgtgaagattcagatatggttagtattgcagacgaaggtttcattcaagatctacatgacaaactatctcagtacgaggcttccgccaccaaaaccaaagacaaggaagcggaagtattcccaacattggaagattttctatgaaagcaataattgacttaaacaaaatattaactgatatcgattacgaaattgacttgctaccctacttcgtaaaattagagttgcaaaacgtgggaatcccggttatcatcgatccaactgacgtaagaaaccccgatttcgaagtagaagaaggggttttgtcttatatgataaacgccgaaactatgatcatggagatcacttatgattgatgaagagaaagaagtactaaccagtgtggaagaagtggatccagaagaggaaattcaacaaaagatccaggaacgtgtagaagccgacgcattgaagcgagcacaaaaattcattaagaagaaccggactgagatcaaacgcctccgtagacatgcagaggaagccctattcaggggtaataaagttcagtatgtgtatgcggttaagaaacttcgtgatatgctcaaacagccgtatacagaggatttcattgatacgatgtggaacacttcactagcatcaattcgaaatatcgtagcttcacaacagaagcactaacaaacaagtagccccgaaaggggctatgagggtcttatgagaaagtacttaatgatcggggatactcacgctggcttgcgtcaggacaacccctggaatgaagaaaacctatacaatgtattcgtacaaatcgtagaacactgcaaagcaaacggcattaccgaggctttccatgctggtgatttctttgatgtgcgcaaggccaccacacaaaccacgatgaaattcattcgtgaacgtattgtgccactactggaagaagccggattacatatctatgttctggttgggaaccacgattgccagtttaaagacaagatccgccctaactcaccgcgagagattcttgatcagtatgattgcttcacggttgttgatgaaccgatgacagtaaatcttgatacttctccgctgcaatcaatcgatttgatcccgtggatttgtcaagaaaacacacagcagatttttgatttcatcaaaaagtcaaaatctcaatactgcttaggacactttgaactgtccggatactatttctataagaacagtaaagctgaacatgggcttgaacctgatttcttaaagaaatatgatatcgtgtattcaggccactatcatcacgctaacgaaggcgctaacgttttctatatcggtacacctcttaccatgagcgcgaacgatgaggacgaaaccaggggcttctatgagctatcttatggcgacggtaaacgtgaattaactttcattgctaacccagtatgccaccatcgccggatcacctatccggatcaaaaagatgttgatgttgcagattacaaaaattgctctgttcgcttgattgtacgcgaagttgataacgatttgcctaagtttcaaacaaaactggaagaaacagtttatgagttgaacattgtcgatcgtgtgatcactgattcagaagttgatactgactttgaaatcaaaagcgtatctggattgattagtgagtacatcaacaacatgcagatcactccagaagaaaagaccgaagtatctgcaataatgagtgcattgtatgcagaggttacgagcaatggaaatagttgattacgttaatattttaaacgaagaagggcgatataaagccctttataaaatgtttggatttgatgtgattgttgcagtacagcaggattcctataacgagtatgtgtcattggggttcactctgattaaagacaactatcacgaaacaaaggtttggacatttactgtcctgaatagcatggatgaagattccgtgatatactgctttgatagcacgattacaaacatgattagtgatatatcccaaaggataattgatgaaactcaaatttaaaacattgacttatcaaaatatcttgtcggttggtaacgtaccgatcgtcattgattttgattcagcaaagaaaaccctcattacgggtaaaaacggcggtggtaaatccaccatgatcgaagcgcttacatatgctctctttggtaagtcatttcgcgatctgaaagtcggacaactggtgaacagtatcaacaagaaaaaatgtctggttgaactgttgatcgaatacggcaatgatgaatataaaatcatccgtggacaaaagccgaaagtatttgagatctggaagaatggcgaaaaactgccggaagattcagccgctggtgattatcagtcacagcttgaatcaatgttgaatattaacctggtgggctttaaacaggttatcgttctgggtactgctggttatgtacctttcatggaactgaaaacaccagatcgccgtaaactggttgaagatttgttgtctttgtctatcatcagtgaaatggacaaactgaacaaatcatacatccgtggtgttaaccgtgaactggatacgctttcaatgcagattggacacgtacaacagcagatcgcaacacatcaaaagttcattgacgaacaacgggcaaaagcaaatcagaatacggcgcgttaccaggatatctacgattcccacgtagaaacagcaaaacagattaaagcgcaattagttgaacttcaaacccagatcgcagaatgtgtgatcaatggtgaagaccaaacagcaaatattcaaaaactgcgtgatggctatacacgcctctcaatgaacgtagaacagttgcagcgtcttgaggtgatgtatcgcaagggtggtgaatgtccggcctgtaaacagccaattagccccactcctgaacgcatggaagaaattgccgagaacattaaaaacggtactcagaaacttacgctgattaagaacaagcaagatcagctacagaaaatcatggatgatttactaacacaacaacgtacactaaatgggctgaaatccaaatacgaatcactacgcggtacacttcaaaatgaagttgcagcggctaaacgtgttcgggctgtcatggataaagcacaggaagacgtggtgatcgacgaatccccagttgaaaaactccgtgaagatgaaaaggaacttgattctaaacgttctggatttgtcaaggaaaaatatttcagaggtattgttacggatctgctgaaagattccggcgttaaagcgagcatcgttaaacgttatattccttacttcaataaacagattgcgtactatctggatctgttgggtgctgattatcagttcactctggatgacgaatttaacgaatcgattaaatcgctgggtcgtaatgattttagttacgcatcgttcagtcaaggcgaaagagcacgtattaaccttgcgttgcttatgacgtggcgtgatgtaaccagtaaaatttctggtgttgatttatctctcctgattcttgatgaaatttttgatggtgcaatggatcgtgaaggtgggtttgctgtgagaaaattacttgatgatattgaaggtaatgttatagttatcagtcatcaagaactggatccgcaagatttcaacaggcatattactatggctaaagttggtcgatttactaaatgtacgattgtaaacaatgattactaaaaaatgggacgacgaatttcaagccgagattcgtcgtcggttttaccatgtaggcgggattttgtatcataaaacagagagtagaccaacggtgtctgttcctgctggttactattttaaacccggtgatgtggtaaaattcaataaaacgagaaaaaagaatccgtacttacagatttgtatgaggtatgaagggaaatctaactatctgtacgtgcatagagttgtctggtttttagaatacgggtatcaagttgatcttattgaccatattgatatgaatccattcaataacgatccttctaacctacgagaagccacgacgcaacaaaatcactacaataaaaaaggaaaatctaacacatcctcaatatataaaggtgtatcatgggataaaccaacttgtaaatggaaagttggtatacaatacaataggaaaaagatccatttaggatattttgacgatgaaatagaagctgcaaaggcatatgatgctaaagctatagaaatcagcggaaaatacgcgaggttgaacttttcatgaatatgttagaaaaatcttttgaattagaaaccgctccggaaatagagcggttttatctccacaacaattttcttgaagaaaaacatatagttactatgaaagatgttgaggaagcattcaaagataaccctatagagttgacgcgaatcaagaacaacaaaagttctgtttggttcctcgaaaaaatctattgaccgaaatccataaatacagtaaagtagcccatgtaacgaaacgtgggctttgtttttatttgaggaacaataaatgatcactgaatccaaaatgacttatcaggaagcactgaaagttttgggcgcaactggtagcgaaaccagcgctgaaatgtccagactcttcaaacgtgcatccttacgcaatcaccccgaccgtggtggtagcaatgaattaatgcagaaaattaaccaggcttacgacgtagttacaaaaactgggcctagtggcgcacgttctgagactgctggtgatgttcgcgcacgttatgcacgtcaaaagaaagaatgggaagaaaaagttgatgcttactttgtagtggcgaaaaactatttcagcaccaaatttaacgcacaggaatttgcggaatacttcaccaaatacactggattgcctaccactttcaaacaggaagtaacaaaaggtagtcacggtgtttatgcttcgttccgtttcacttctggtgatgcttactttgatttcggtttcaactgcacccctccgaatggacaagggttagccgctccggattcatctgcactgggtaacgtttctgttagtacctttgtactggttggaactaaaaaacataaaatggcaagccgtgattatcaatggggcaaaaacccagataagatcactccggaaagcctgttcccgtctaaaaaactggaaagcattttcagccctgtacagaaaaatatcaaatacaaacgtgctgactacctggcgtcattccgtaagctgttaggcgctgacgttagcggaaacgatatctttgttgaagttggtacactgaaagttcgtttctatcgtcacgtattcatgcgcaaaggtgcttatgtgtttagcgcggtgtatgatcctgctgtatctaagtatcgtccggctgcacaacttcgcggaaccatgttcgaagacgaagacggcgcttgcctggatatgatcgttgatacgttcaaagagttgcagaaactgaaaccgagtgttcaaggcgttgtgaacgctatagataaaatgaacgcagagtttgcagcggggcatcgttcagcatcttttgttaaacgtgtagctgctcaggaagccgcaccaaaaccagaagagaagcctaagcgcacagttaaccgtgtgggtaaagaagaatactacgcagcactcaaagatattggtgctcgtgtaatgcctacaagcggttatgttgaatttgataacggtgctggtgttactatcaacttcaagcgtattgttgtaaaccgtaaagcatactactcattcagtagctttaatttcacgtactctggtcagaaacacattgagtggttgaaaggaatcgatatcgcagaagataccaaaggcgcaagcattagcctactcactgatactctgaaatctttacgtgggatctctgactggaacactgttaagagcgctttagatcaaatgaattctaacttcaaggcgggtaaattctccgcacctcatgtgaagaaggaagcagagcaaaaagcaccgaaacagaaagacgaaatcggcgcacagcctaccaaaccacaggcggctaagaaagatacaccagaagtggaaaaatcacaggctgttcatgcagcacgtgagaaagcgaatatgaacaacactattcgtaaaatgatgactatgttagtcaaagcacagcgcaaagacactccggaagatatcaagaaggaagttgatgcagcaattcaattgtggcgcttgacttattaatcaaatgaactataatgggaactgttaacgcagttccctttttatttgaggaaaatattatgagttgtccaacatggttacgtttggaaaatctgaaagaaggtacacaaaaacggatttatattaatcttggttgggttcctcctaccgattttcaaatggctgagattttaatcaatgctgttaaagaagtaagcgacacttacgaatgggaaaggctctattttcctttgattggtttgtatatgacgcgaaataaatttgaagaaatgaaacttgctgttattcgcgctacgattattaattcccaacaaagatttactttgaaaaatgcatggagttctgaatgattattcaagtatctgtacagggtgacactctgactgtcaccgaatccatcaataccgctcttgctgtatgtcgtgaccatatctcacaaaatcctccagtgactgagatcctggaaattgatgtttgggatcagattgggatgatcgacgcatcatatggatttaccccgcgagatgaagaactatctcgtatcgaatcatggctgaatgaacaggaaacggaatgaaactccctaagaacacaacactactaacccgcgaaaaacttcactctgttgattggtgtcctctggatatcatgatttttgatattgaatctcgcgtgatcaatgcaaaatatcaggggtgtagtattttctctgttgaattcgagaagattcgcgggtatgatgagaagtacaaagaaaaactgaaagttatgattgaagcattgggctatattgtaactgttgaagacaacaaaatgtggatcgcaatatgagcatagtaaaagcggtgtttgcgctggggcatgatatctaccacgatgatttcgcttttggatatcagcaaggcttgccgtggggccactgtaaagaagatttacagaacttcaaagaagaaaccgccgatagcgttctgattatgggtgcaaatacgtttacctctcttccgggtaaactacttggtagaattcattgcgttctgtctggttccggtagttttttgaaaaccaaaaaaggcgaggttgctgattacgtgatccacggtggcgggttgtctgctgctattggtacaatgcaagcaacacacccagataaaaatgtgtgtgtcattggtggtaaggggttgcttttagattcaatcaataataaaatggttgatgaagtagttttgacacacatttacggacatcatgtgtataacgcaccagcgtttaaacgtgatgttgcatttactctttctgaactgggtggcgcattattaaaatatgaattttctgatttaaaaactcagtacataaaagaacatgaacgcattgaaaaaatcgtagttgaacgatataaaaaggtataaaatgaaacaatatctggatattattaaacttgtacttgataacggtgttgaatcaactgatcgcactggtgtaggtactattcgtattttcggcgcacaagcccgatgggatctaaacagaggtttccccgcaactacctgtaaaaaactattcttcaaaccgtgcaagcatgaattgcaatggttcctgtccggttcaaccaacgttgaagaacttcgccggatgacctggggtgaaaatagcgataagcgcacaatctgggatgataactatgaaaaacaagctattgatttaggatatgattctggttatctggggccaatctacggtcatcaatggcgttcgtttggttctctttatggggatgatgatagttattatggcggtagtggtgttgaccagatagcaaaagtcattgaacaactgaaatcaaccccagacgatcgtgggatcatcgtttcggcatggaaccccgttgatcttgatgatatggcattgcgtccgtgtcactgtttctttcagttcgttgtaatcaacggtaaactgtctctacagtggtatcagcgttcagttgatgtcttcttagggttgccgttcaatatcgcctcctatgctctcctgacgcatattatcgctgatatttgcgggtacgaagtgggcgatctggtttggactggtggtgatgtccatatctataaaaatgcggttgaacaagcaaaagaacttttacagcctaaccgttcaccaatgccattaccgattctaaaaatgccgaaggtaaatagcttacttgatttagatcaagaattctttgactcgataaccttagaagggtatcataatcacggctctctaaaagctgaaatggcagtatgaaaaatggggcttcggcccctttcttaacaaggtaagagaatgaatgacattaaagtagtagtaaaatcctctggtgtacgccagccgtttgacaaagaaaaaatatacaaagtgctcaagtgggcctgtgatggtcataatatcgatgttcgtgcattccttgaaaatgtattagaactgatccgcgatggtatgactaccaaacaaattcaacgtatcgctatcaagtatgcagcagatcatatttctgttaaagaaccggattggcaatacgtagcatcgaatcttgaaatgtttgcattgcgtaaagacgtttacggtcagttcgatcctatcccgttctacgatcacatcgttaaaatggttgaagcggggaaatacgataaagagatcctggaaaaatacagcaagcaagatattcaagttttcgaacgtgcaattgatcatgataaggattttgaattttcgtatgctggttcccaacagttaatcgggaaatatctggttcaggatcgcgatactggcgaaatctttgaaacccctcagtatgcgtttatgcttattgcgatgtgtctgcatcaggaagaaactgggttagcacaggttacgcatatcgttgatttttataacgcaatttccgatcgcaaactgtctctaccgactccaattatggcgggtgtacgtactcctacgcgccagttctccagttgtgtagtaattgaatcgggtgattctcttggttctcttaacgctgtaacctctgcgatcgtgaagtatatttcacaacgtgctggtattggggttaacgcgggacatattcgcgcaatgggttctaaaatccgtggtggtgaagctgttcatactggtgtgattcctttctggaaacatattcaaaccgctgttaaatcctgttcacagggtggcgttcgtggtggtgctgcaacactgtattatcctttctggcatctggaagttgaaaaccttctggtgttgaagaacaacaaaggcgtagaagaaaaccgcgttcgtcatcttgattatggtgtacagcttaaccagttgatgtataaacgcttaatgaatcgtgattacattactctgtttagtccggatgttgctaacgatcgtctgtatgatctgttctatgaagctgatcagactgcatttgaagaactgtatgaaagcctggaaaaagatccaactgttcgtaagaaacgcatcaaagcggttgacctgttccaacttttagcacaggaacgcgcacagacaggacgcaaatacattttcaacactcatcacgtcaaccaacagggtagttttacggttcctgttcgtatgtctaacctgtgttgtgagattgcgatcccaacgtcgccgctggatgacgatgataaaatggctggtgaaatcggattgtgtacgctaatggctatcgttctggataacgctgatatcagcgaattcccgaaactcacgcgtattgcagtacgtgcgcttgataacctgctggattaccagaactatcctgtaaaagccgctctgaaagctaaacagcgtcgttctctgggtgttggtatcaccaactatgcatcatggttagcaagcaactattgcgactactcagaagcgtataccgacaaagttcatgagttaatggaagcgtttcagtttaaccttctcgttgcttctatggaactggcgaaagaacgtggtgcgtgtggattgtacaacgataccaaatacgctcgcggattactgcctatcgattggtattgcaaaaccgttgatgaactggtagcacctgtttataattgcgattgggaatggctacgtagtcagattaagaaatacggcttgcgcaactctactctttctgctttaatgccttgtgaaagtagttcacaggttagtaactctaccaacgggatcgaacctccgcgcggtttagtgagtatcaaatcttcgaaagaaggacactataaccaggttgtgcctaaccagaataaccagattgatttctatgatctgctctgggatatggctaaacgcggtaacaaagggtatctgtctcatgtagcagttatgcagaagtttgtcgatcagtctatttctgcaaacaccaactatgacccggcaaactatgaagacgggaaagttaaaacagaagacatcattgatgatctgctgtatgctaactactacggtgttaaaactctgtactatcataatacgcgtgatggtgctggtgatgaagaagaagccgcagaagattgcgcgggttgtaagatttgattaatgccccttcgggggctttttaaaggtaaagacatgttaacagtaatgaatacaaacccagatcataaccacttagaacaacctatgttttttggtgaagatactggtgttgcacgttatgaatcgcagaaacacaaagttttcgaaagcctgacgcaaaaacagctttctttcttctggcgtccggaagaagtcgatctgtctactgaccgtatgcagtatgcaaaacttcctgaacatgaaaaaatcattttcgattctaacctacagtatcaaaccctgttagataccattcagggacgtgggcctaacctcgcatttttgccaattgcatccgatgtgagcatggaaacctggatcgaaacgtgggcgtttagtgaaaccatccacagccgtagttacacgcatattcaacgtaacttgcacattgatccttctgtacagttcgaccaaatccttcgcaatgaagcgattatgaaacgttctgcatcaatgacacggtattatgatactctgattgatgaatgtcataagctgaaaaccatcatgatgctacaggaacaggttagcggttataaaccaaatgatccggctgtcgtgtattataacgagcaatacgctaaacaggccactaagtgcaaagaagcgctgtacctgtgtatgcacgctgtgaacgctctggaagcgatccgtttctatgtgtcgtttagtttcacctttaactttgctgaacagggcaagatggaaggcaacgctaaaattatgcgcctgattgcgcgtgatgaagcattgcatcagaaaggtactcagagtaaaatccgtttgtggcaaatgggtaaagatgatccagaaatggttgaaatctcccgtaggctgaaaaaagaagcaacggctatcttcctggaagtatatgaacaggaaaaagaatgggctgaacatttattctctgttggtgatgtagaaggtgtatcgctgaaaagcactatcgcttatattgaacaccttacagatcagcgtatgcgagcggtagggcttgattcgccattcaccccgatccctaacccgtatccgtggatgaataaatggctcaaaagtgataacgtacaggttgccccgcaagaggttgaagtaagttcttacctcgtcggaaacttgaatactgaaatcagtgatgaagcgtatgcaaaatgggccagcaaatacgcgtgattgtcgggtagtaaacaagtacaaaactgattgggatgtcgatattcaaagaggtacgaagttcggcaacccttatcacacaggaaccaggggagaaaacattttagcgtttatcccctggttccagaatcaggttcgtactggggcgatcacgattgaagaattgaaagaacttgatggaaagaggcttggttgtacctgtgcgcctcttccctgtcacggtgattacatcgcgcatgtggttaatgttttgtgtggtaagaaaagatcacttgactttttggatatataatgtatgaaatctgaattcaacttaacccttgataaatgtggtcgcatcgatcgaagttttgttaagtgtggtgaacttaggcattgtgtttattttattgcaattaacgatgaaatagtatatgttggtaagtgtagggatatgtggaagcgtttagatacatatcgcaatgcaaagtattggagagaagccaaccccagcaacatcttaaaaacgtgtcgattggaaatggctatcaaaaaacgaaaaactgtgaaacttatcgtgactactcacgatgaaaatacatatcatgattatgaaatcaacatgatacgaaaatacaaccctgaatggaataaacagcactatgacaaaggcacaaactaaaattatcaataccctttacaaacaactcatgcagttgtgtggtgaatccgaaacatttttcttcgttgatcaagtaaccgtgatgggtacacctgttcgaatctttaactatcgcatggcctcatatacagactggctaaagcctggtgctctggaatgtcgcggtatcatgtttgaaatggatggagatacccccgtatcaatcatcagccgccctatggagaagttttttaactatgccgaggtaaaggcatgggaagcgcttaacgagtctcctattgaattaggcgaagttttagacgtgatgattaaagaagatggttccttgatctcaactttccttgacggtggatttctggcggtcaagtctaaaggttcggttaaatcagaacaagctatggatgcgcacagcgtgttaatggcaaatcgtgaattgctgacccgcttaactgagatcgctaaagaaaactatacggtgaacatggaatacgtttccccgaaaaaccgtattgtcgttggttatgattctcctgatctgcgtatcctgaacgttcgtcacaacatcacgggtgaatacatcccttatgatgaactctttgctgacgcgctgttacgtgcgtatctggttaagcgtgagaatatcgaagtactggatctggatgcattcgcaaaagaagcatatcagaatgaaggattcgaaggctatgttgttctgacaacgaaagggtttgtaaaaatcaaaacaaactggtatgtcaacctgcatcgcacaaaagatagcatcaccaacaataaggatcttttcctaaatattgttgagaatacggtcgatgacctgaaacagctattcagttcggatctggtctctctgaaaaagattgacgatttcgaaaaacttttccttgatagtctcaatcgtttgagtgcaaaagcattcaaagctattgaagataataaagggaaatcgcgtaaagattttgctatcagtctaagcgcggatttgtcaaacgacggtcggatcatcttcgggcctcttatgaagtacttcgaagaaaccgatccacaaaaactggtcgatcgcatcattgaaatgatggttaaaaattacgatcagttcattcctgaacaatataaatgaggttcataatgcctaagatatcatcttgggtatggcctgtaatcgtggggctatctttgatagcccttttttacattgcagtcgataccaaaattgaaaatgcatcattacgcaaggatataaaatctttgcaagacgatgtgaagaaagtaaaagagacaaatacaagcaatactgtgatctatgtcgaacaaaaaggtaaggatcagcagttggtcaaggatgccggacgtaaagatctgctgtttaaaaaaccaggactgatcgaaatcaagatcaacaaatccttcgaagagtatatggcggaatacgacaaatgaaaattgcaacgttagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtaatgccctatgacggaaatccttatgttgcattatcatatccagattcattgatttttcgtagctggatgaacgacgttaaaagacaaaaggatcagaccgataatgttctgtgtactttgggataccctgagaaatgcaaatcaaaataaccaaaacattttttcgtgacataacagaaggaaaagtttatactgcgaaaaaggataaagaaggtctatggatagaaaacgattggaatcgtgatatatggctcaatctgacgaatgagtataacaaagaactaattgaatatgagatagtgaaatgaatctgtttatgactattggcgttccgggtagtggaaaaactacctgggcgcatgagaaagcccgtgaattgggtaatactgttacgatctctcgcgatgatctgcgtagctctttgtataatgcgggtaaaggtgctggcggatacaaatacaccaaagcgaaagaagacatgattgcagaaatgcaggatcacgttgttatctccactctgaaagatggtaaaaacgtgatcatacacaacacacatctgaaagaaagtgataaaaatcactggcgtgaaattgcgttggaacacaaagctgattttcatattgaatattttgatgtgtctattgttgaactgcttcgccgtaaccacaaacgcggtcgtgatgcattacccgtttcgcgtctttgggaaatgtttaaccagtatcgtaagatccgtgggttcgtaccagcaatggaaattgttaatccccacaatcagaagtgtgtgatctttgatgtcgatggtactctaaccaaagtgggacaacgtagcccgtatgactttaccaaagtgatcaatgatccgccaaatatcccgatccagcaactgtttcacctgtacaaaaatgcagggtataagtgtgttgttgtgtctgggcgtgaaggtaatccgcaatgcgcacatgatacatgggttagcctgttgagttatggcgttgaaccggatgaaatttttatgcgtcaagaaggtgataccaggacagattttgaagtaaaagaagaaattttgtttgacaagattttagataagtattatcctgttattgcagtggacgatagagacactccggtcggaatgtggcgagcaaacgggattccgtgcttacaagtcgattatggtgatttctgattgacatataatgtgggtatgttaaagtacccacacaaaagaggattatattatgaacgttattcgtgaagataaacacatcatggttgaacttggcgatcgcattcgcgtagaaaatctgggcgattttaaccaaaaagttcgtttgttgtgccaaaaaattgctaacaaaattcaggaacagggtaaagctccgggcgggtttgaagttagcgccactccggtttctcagtactcctatattgtgtatattcatgacgtggatactaacagcacccaatctttcgggctggtgttaaatcctattactggctacgttacatgggcggctgtattatgaacgtaaaaattattgatagagcggtaattacggacgaatctgtatacccggatcctcgttattatggcggtgttttcggatacatcaaaggaactgatattgatgtagtaacaagtccgattgcagaatatgatatcaacaaaaatcagacagaagttcgcgttactacaatcaacggttcagaatatatcgttgaagcgactcctgattttatcaaacagctactaaaggtgatgaaagatgcttgatcatcctggctctatgagtatggtgctcctggaagcattaaaagcatatgatatcccttgtcatttcggtgaagtaactgttaatactatcattgacgaaatcgacaacccaaatactttcattgcttgtcttgttcgaaaatttacaagttgttttcgaccgagtccagaaaaagtagtaatcagttctgtttctgctcatcatcgagtgttagatgatggaaagattcaactttactggaaagttctttatcacgtggtgtatcatgaaaattgatgatattatgtttatgcttagagcaataagcgcttctaagttctctcaatgtgtctctgttaatgtcggtgctgcattgagaaatggtaacgggcgtgtgtttgtaggcgcaaataatacggttgatcctagtcatcgttgtacagatcagtgcaatcacttattagatgataacgggaaactgagtgaagaaaagcgccctgaacattcacaatggtcagatcgcaacgaagtacacgcagaaatgcgcgttattatgctggcggcgtctcatgaacaaatcaaagacgcaactttgtatacaactcattccccttgctcacaatgtgcgaaaaatatcgaattttgtgttgcaacaggtatgattaagcgtgtagtatatctacataaatacgatcgtggtggcatcgagtggatatggcgtctacagcaatacggtgccgaagtagtacaacttgaccccgaagaaatgaataaacatttccggatcaaataacaaatgagtaaatgtatgtctgaactgagtgtaaaagcatcctttgaatatgttttgattgaaaccaacgctaaagcggctggaactgaaattgtatcaccttctggtattgtgactggtgttcgtcaacacggcgaggaaccgatctacggcacagtgttatcatgtgggccggatgtaccggaagaatataaaaccctgcttatgggtaagcgcgtaccgcttcctcatgcacaaatggcaaacgtgccggatcctgaactgattgcaggaaaggcaacaaaagaagaagctcgcaagtatccggttaaatatgtaaccgcacactataaagcgattcaagcaatttacgaataagagatccaacatggctaaacaaattcaagcaatcatcgccgataccgtcgcaaaatctaaaaaacttttcgacaaaggcgacatcctcgaagcaccgacccgcatcgatgtaatgacttcaatgatcattgatgctcaccagggaaaactaaattcccgtgcttcggaagtaatggaatacatcgtacagttcgaggatgtatgcaaatacgccaaagctgttgatccggctgttcgcgaaatctaccgcaaacagttctaaaaatatcggccccttagctcaataggtagagctaatcactcataatggttaggttcccggttcaagtcacgggaggggccaccaaacaaggcaaggcacttagagaagcgggaggaacagaatctgattctgttggttgtaggtgcaaatcctacccttgccaccaaattagggtgcgtagcgcaatgccgttaaatggttcggaatatgcaacctttctcacggagaaggctctgttggtatccggtaataggttccccggaatgcggggtgaagtaaagaaactcccagcccactaattttaatgaggtttatatgaaatttcgtgaaactgtgaaataccataacgcggtcgaatatacacagatttttgttgatatgtctcccgcaaaattcaaagaacgttatggcatgacatttaatgaatggaaagatggattgcccgatggggactaccgaaaaaacttcaaattcaatgaatgttatgtggatgatgatccttacgatctggatatttttggtaaaacaacgcctctcattgagaattcgccagaacagctttacgaatcttgtattgactctgcatacgaaatttaaagagataacatgaaaaatttacaaaaactgtttgaaatgtctccggcaattagaaaaatcatcggagaaaatagcaatccaacgaatcgcaataaaaaattgatggaactttttgcaaaagagttcgatgattttgattctgaacttcataaagcgcttgaggcatattctaaacaagggttctttgcatcgccgcaagtaaatagcaagaaagagtatagcgaacgattctttgattgggagattgtcaatctcgttcgtagaacaaatatatctcctagcaatcaccaattgatttctcttgatacttcggtattctttatccagtatcttatcagcggtggtttcaaaaatcctgaaattccgtttacaaatgaagcggttagcagtgaatttgatgaatcatttgtatacatcaacacaaacaaataatcaaatggctatcttcggatagccttatttttggggtgtctatgcgctttttaaagtatgcaagttggatcgtactcgtccctcttgacattattactggagtattagcaattctgtttgccccgtttgttgtaccattctacaacgagaaaacagggcatcttcctaaaggcttccggtggatggaaaccttcgataaccctattgatggtgatggtggacatatccgccgttgggcgtccatacgctatcatctgggggattttggggtgtacatgcaacgtgttggctggttgtggagaaacaaggcttataacttcgcatatcacgttttaggacgtgaagcgacaagcaaattcaactggaaaggcaacccaaaaacagaaggtgggccgaaccctgtaaatcatgggtatctgctcatgtggaacgaatcagcatggggtttgtacgtttacaaaccgtggctacggatccacaaagtgcaattctgtttgcgcgtttatgctggatggaaactgaaacaagaagttagcgacccagttaacctggatcgtgcaatgctggcgtttcatttcaacccgttcaggtattatgtaatcaagtaaaggtaatacaatgaaagcatttcaaattttagaaggtttgcatactggtacgatctatctggaagaaggtaacgacgttcggatcgtagtatcaaaaacattaactatggattctgtgatcggtaaagctcgcgttactccgtttgaaaagcgagagattgagatcgaatatcaaccaactgttaaggtggaaggtggacagcatttaaacgtaaacgtgttgcgccgcgaaactctcctggatgcggttgaacatcctgaaaaatacccacagttaacgatccgtgtttctggttatgcagtgcgttttaactcactgacccctgaacagcaacgcgacgttatcgcccgaacctttacagagagtctataatggcaatttctgatattacgggttataaaccccatactgataaaaaagtagaaacagtaaaccgtatcaaagatgctgaaaatgcattaggtgcaatcctggaagatatcgaacagcgcctatcaaattcagatattgattcgctgatagatgaagaattagatgaggtgcttgaacgtatccatcaaattcaactggcgaaagaccgactgaaagaagcctctatgtgggcgtgtcgtgcggtgtttcagcctgacgaaaagtattaaaaatcaagccgttgccgaaaggtagcggcttttcttttttggtgtaaaaagttgttgactcccttctcacattcccttatagttaatcccgtagacaagaaaacacttttatgaggatgacattatgaaacgctcttacaacatgaatgaactggttttcttcaaaactcgtcgtgaagcacgtgcttacgttctggcggctggtaaaaatacttctgctgctatcgatatgggtactgataaagctgttggtgctcgttgggccgctgttatcgttatcgctgctccggttactccggttaaaactctggtacttggtgcgcgtcacgccgaaactcttaacactgctgcaagcggtaggggccacgaagttaaagtgttcaagaagcgttcttatctttcatgtgcaaggggttaactatggcacgattcatatataaagtggaatacgaaaatactgagttatctgatacctttttgaaaatgattcgtgatcacgggcaacgtctggaaagagtaacgattgatactgcgtttgattgtcctgttgggttggttctaacattatcttgcagccccgcaaaagaatcagcccgtgtcgaaatgttacataaactaaatgcattttatgaaggtggtagtgtatggcgagtattgtaaaatttttcaccgactcagtgaaagaaattaaaagcgctctggaacaatggaacactcgttgtgatgtatccattaaatcagagtacgaaacaacttatgatcgttatgatccggcccgtggtttgcacaataacccccatgaggtggaagtgtgaaatactacggattcaaaacgagtcattttggtaaagcgtatcgtacagaaaacatcgatcgcaaacgtccgtactatgattctttagtacgcgcgggacgcaaacgcgctcgccaggaagggaagaaggaagcagaaaatgaactttgatcaacccattgcaatgataatcggtgctgtcctgggaatgcttcttttgtttggcggaatcccattaactgcatatatcatgaggttattctaaaatggacatcggatcaggtagtcagtatccctcatgcgctttaagcaactttgccccgcatccgtttacgttcgacggggtagaatgcgcatcgatggaggggcttttacaaagcctgaaattcagcaatccagacatgcaagcgcatgtatgtacgctggttggtaaagccgccaagttcaaaggcaagaaaaagaaatggtatcgcgatcagaccttgtactggaaaggtacaccgatccatcgcgaatccgaagcgtaccagattcttattgaaaatgcgtacaatgctcttttcctgaatgacgggttccgccgtgcgctggcagcaaccggaaaaagtaccttgacacattcaatggggaaatctcgtatgaacgaaactattctgacagaacgagaatttattagaaatttgaacaggttgagaaatttgttatgaaaagcgctgataacctaaaaaaagaaattgaaggaatcaagaaattattgcattatatcgatgttgatatagagactggaatatgtacttggaaaagacccagaaaatctataaatgttggtgatgttgctggatgtaagaaagaaaaatatcatgttatttgtttcgattataggttgtatagacgacacaggattgtgttctattttgctaaaggttacttacctcaagtagtagaccacattcatggtgttgaacatggcgacggtattgataatttacaagaggcatcgcaaagacaaaacgttattaaaaagaaaggacagaaaaacaacaaaagtggttatcgaggggtgtgttggtcgtctcgtgctgaaaagtatcgagcaactataggtattgatggaaaacaaatacatttaggatatttcgatactccagaagaagcaagtaaagcatatcatcaaaaagcgaaagaaacttttggtgatttttataatccattggttaaatgagatctgttatgagtgaaaaagaaagagtagaatgcgtgtttctgttcaaaggcgcgattaatccattagcgttactgtatgcgcaacatgcattacgttcaacgttgattcagagtgttatctataaagcaggtgtgtattatgttaccatcggcgcaaataacatggttgttattgaatcctacgttaaggaatgtgcattaaacggcgttgtctttgataaagtcgattttgatgctggggtagatgctgtttatatgtataagggttgatatgagttacgtagtttatttcgattgttcggatctcgatccgttcgtgcttcaacaggcaaagaaatatcatcaagatgtcgttggcattggtgtaacaaatgatgatatgttgtgcatcgaatttgaatattatcggacatttgagcgtgaacaattcctgggtgaattgaatgcattcaaaagtacccttttctttgatcgttatgaggttatatcttgaaacctgttattcttaccgatattgacgggatcgccgtaaaatggcaaagcggcctcccgttctttttgtctaagcacaacatgcctactgatattgcattggaaatggttacggatgaaaaatttcgtgatatgaccgaaatcttcggatgtgatcagcagttggctaaaatccttatggaagaatacaataacagttctttcattcgttatctgaatgcgtatgatgatgcattgattgtgatcaaccgtctgaaaacgcagtatgatttcgttgccgttaccgctctgggaacaaccccaacagcaagccttaaccgaattgctaacctgaatactcttttcccgtctgcgtttaaagaggtgatggtcgtgggccacggtgaaacaaaaactcatcgttacctggaagcaaaagcaaagtatggtaatcgtctggtttgctttgttgatgatctcgcgataaacttaaacgaatgtcataacgtcattagtcaattgccgttattccatatgttacgtggtgaacgtgaagaaacaaatgcacctcaccagttagtaaaatcgtggtttgaaattgaagagaaactaaatgatcttgtcaatccttaatgaacttgcgtctactctgaaaaccaaagagaaagaagcaattttaaaacgtaatgccgataatgaattattgaaagaagttttccgcattacgtatacaaaacagattatgttttatgtgcgtcaatttcctctggtagaagggaaaccaggcacaacaccgctttccgatgcaatcaaagcattactggaagatttagcaagccggaaatatacaggcaatgcagcgcgtgatcgtttactggatattgtatcatcagtgaacattaacgatcgtgaagtgctacgccgtatcattaaccgcgatctggaatgtggtgctggcacaaccttaccaaacagggtatggaagaaactcattcctgaacagcctcaatgcctcgctacgccgtttagtgaaaaggctttacgtcgcatcattttccctgcttactcgcagcttaaagccgatggtgcgcgttgcatggctgatttgctggaagcattaaaccgtaaggtatcgagagcgggtaacgagtacgaagggttaactcagcttgatatcgatctgaaaaagattcgcgattatctgggatatgatgtagttctggatggagaattgatttatgttccttccggaaccgtaccaacattacctgaacctgaaacagacatgcctttttctttatctgctttcatggacgatgatgataacgacattgcgttatttgcggaagaagttcgcaaagtatcgaccccagaagaagaacaggccgaagcaaaacgcgaagaagggaacgggatcgtaaacaaatctctgaaagggacgatcaccgaagaagaacagcgaaacattgtttatgttgtttgggatattattccatatgaggtgtattacggcgaagctgaaagtgttcagacttatgatgagcggtttagcctgttgcgtgatatcctcctggatctttctctgccttctgttcgtttgattcagtctaagctggttaataacattgcagaagcgaagcaggactataacaattaccgcaatgatggtaaagaaggttctattctcaaaaacagaaacttcaaatggaaagattcgcgagtagccgatcaggttaagctgaaaaacaaaaccccgattgaactacggatcattgatatctacgcgcacactaaagaagaccataaggtcggcgggtttgtggtggaagatttatccggaatggctcgaacgaataccggatctgggttaactgataccgattatcgttacgatgatgatggtattacccgtgtatacattccattagatgaacgtggtgaactggatcgcgaatacatcatggcgcataaagatgaatacattggggccattgtagaaatggaagttgacggcctccagaagtcgaaaacgcgtaagaaaggggaaccggaatacagtttcttccttcctattatcaagaagataagacgcgataagaccgaacccgacgatattcatattgtctttgcagatctattttaataaaaagcccttgactccggtcgggggctttgttatattgcatatcgaaacgtaaatcactgagagaatatattatgactagtagttatcagaaacacaaaacccttatggcaaacctgtccggtaaacatatcgacgaagtaaaatctctgctgacagtaaccgaaggttcccgcttcgaaaccaatcacattatcaaaccttctgtgaagaaagtactgaaagtgatttaccgacatccggtgtatcagtgcgttcatatcatgaacagcaacgcatttattttcgtatataacgaatccgatgataagtgtgttggtattttccgaaaacctaactttgaatgcatgagcgaagcggctgttgcaaccccgatcgttgaagaatatccggattatgttcaacgcaacatgcgttatgtgcaatcccgacttgattatgcatacgatttcaattctgacgcggtagaagcgctggcggatatcctttgcaaaaaccagaaagatcgtcaaatgacaaaatatctgactgatccaacaccgccaacaattcgaatttctgttgaagttccgtttgaaaatcatttcatggcagttgaagcgcttgctaaacttggtttagaagtgaaaacagaagccgtttaatagcactttttgttaaagaagcctcttgcaatgcagggggcttttttgtatattgcacacatcgaaacgaaacagacaaaaggaacatcccatgcaaatcactaaagaactcgaaggcaaagtaatcgttctggtaaatgaagaccgtttggcacaactgggtaacggtggtgaaaaactgccagcggacgcactcgaaagcctttctaaaatgcgcgtgatgcgcgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgtgttctgggtaatgtaatggtacattacctacatcgaaacgaaaggagaaacatcatgaaagttatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagacccgaatcttcgctggtgctgtgcgaaaactgggtttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgttctgttcttgttggtaaatgctgcgataatccaaatatagttgtgatggaaaaggaacaagtatcccccgaaacatgggatcagatccaggaaatcattaaaaaccctccagcgccaactaagaaattacgtgaattgatgacaaggaaaatgaaatatgagcaaatttaaattgagtgcaaccgttcgccttattcgttggaatggtgaagagatccgttatgatgaccctgaattcgcccatgaaattctttcgcatcgtttgggattgaaaaacgcgtcattggttcaaactgttaaaacatcagcagagccggaaatttggcgttgtgttattctggatctcgataacaacattgattatgatgatcctaagaactatccgcttctggaagcacaagttgagaatgctccagaagacagacagtgttttttggttgagttgccacgcgaacattacgaaaacatcataaaggcccgtaaaaaggtcaataacaatgttttcgatctccacctcggattgtttgaggattaagtactgctagttgtgttcgtagtagcggcgctggtaggttcccccacctgtatacattcaagtgtttgcaggtggaaatcttttgatacgtctcgaacacattcaacgatcagatattttcctgcatactcttccccaaatacctcaatgattgcccctaccttaacatctaaacgaccctgctttatatcgaatcggatccggcgttcatagctggataacaattgcattttagacgcctggaaaggtttaccttctgaatctgggttctgaaagttggtatcatagattgcattacggtttgtgaagatccatgtattctctgtgtctgtatcagccagtatatcaccgtacatctttttatcagtcaatgacaaactaaagaaactggcgtctttaaacagcgttgtgttatccttatgggtaatgtactgggcttctgtgaatatgacagtatcgccaacaaacacgttatcaacgttaaatttgtatgctgggatcggtgtctgggccagaatgtcagttgaacttttaaggaaaataccggaaccatcttcccacagataacagaaatcagaagaaactacactttgcccgttgtccctgatataatcgaatatatcctgatatgtaccatttagacatccaggagggatacgtatgttaccgccgtcaacttcgggggtaagtagtttcattttgctatacagtgccgtcatacactctgtaatcgtctgtacggcgttgttactaaatgaacgggcaaacttacgtctgaacgttttatgcagcggagagaggttcatacgcagcacagagcggtttttatcgtcagtatctacgttagagtaaagcaatccgtaataatgttgttcctgtgtaccgttatactggaaagatacctgtatgatcggctggataagttgctgatagattaactgtgcgtcgtatatctgcatcagcgtttccgatgagccgttaatcatcgtcttttcactaaacgagacaagagcgggtagcaattcagtatatgcgttatcaatatatttttcgtatgatgtatataatttaatcgatgttattcgattgacgattttttcagccataaaaatccctcctaatatatcctatttactaaatagtaaataatgacccaggttcaatttgaggcaataatgaaaaataaaactcttgataaatttatgactacacggcttgaaatcaagaagactaacgttaaaaccgttcatcttccggatggaacagccattgagatccctaagatgtcgtatcgtcattttgtaaagattaagactctgaaagatgacccagttgcgatcatgcgattcatcattgatgacatcaaaccgcgtgaactgacagcagcggaaattgaatttgtgttgatccatatgtatgcacacaataacgctgattatgccaatacgcttaaagaaattgggctaaatcttgatgacctcaaaatctccgaaccttgctatgattttacgtttgacaatgtgcggttagtctttgacaaacccagcctgttaaatgctcaccttccgttcctcatcaaagaggcatatgttgacggtaagccagtagaattaactgaggataaacgagacgaattaattaattgcctgtaccgattcgaatatgatcaggtatcgcgtggtgtcctccaggaagtatacattattcatgaggggaaaaccatcaaagggcttaacatcattggtgaatgataatggctaactcttatttcaacgaagaacaaaagaaaaagtttctgaacagaaacaacaacaaacaaccagcggtcaccaaagtaacagcctcccttgatgctgaaagcgcccgtgacctaaaggaaatcaacgataacacccttgaaagtgcaatcaatactcttgatatcaaagaggggttgaaatcgttcgaagaaaaattccgtgacaaattcgcggggttcaaagaacaatacgaagaggataaaaaggaatcattagccgaacaactacctgatttcgttggcccgatccgtcctatatccttaaccgatgataactcaaaaactgttgacaatacagtaaacgttaaccaaaatggtcagttcggtaagctggaagaaaacaccgaatctatttttcatgctattaacaaacttgttgatttatatgaaaatactgataagcataagcctcttcctgaaccagtggaagaacctgatccgtatgtagacactaagaaaaaacgcatcattgatgatgaagacaaaagaagcaaaactctggatagcattgctaaaagtctggtttctattaaaggctttacatcgcagatccttagccgtttcattggttactctctggaagcaatggcaaagtttgctaaatggacgctccttattggttcgttaatctttacattcgatgtgttgcgcgtcacaatacgcaaatggttcgaagatatcctgaaagaaggggaatcctcaaaaaaactatttggtacatatctgggtaacgtaaaggctatcgtaacaaagatcgaagaaggtttgaacaactttaatatgaacaacttaggcgaatcacttcgtgacttgttcgttgagcctatgaagttattgggacaaactgtacaaacggcaatcactgagggtatcggtcgtcttattcaatcattgggtgaatcaactggtatagacagcattaccaatgccggacgcggaatgcagatcaccgctttacgtgataaacagaaatttggtcttgaattgactaaagaagatattcttatgatcaagaaacaggaactagaagaccaaaaagcggcattagaaaaagaagataaagctattgcagcacgtcatgcattaacaataactccttctcaaattcctaatggttctatctataaagttgctcctactgattatcaagaaagaaatcagaaaaccgtagatgctgataaagaacggcttgataatatgaagaaagcaacggaagaaatgcagaaacaatacgatttagctaaaagcagcgaagaggaagcacaaaaattagccgatgaggaaaacaaacgcaaccgcgcacgtatagaagaagcaaaaaggttagaacaagcgaggaaggaaggaaaacagccgccagaaggtgaagagaaaaagggtgatgatctgttgggtaaagcaaccaactatgctaactctgaaaatctggatgcagccgatatcaaatacattaacgatgaactgttggatcagcttgaaaaacgtcgtaatgaaggtaatctggacgatgtacagaaggatagaatctctgaccttatcgagcaattgcaaaacaagattgcagcccgtacagaatccagcaccccgatcgacgcacagccaccgttagcagcaaataaaccggatgctgataaagcaagcaacattcaggttaacaacaaaactgttaacaacaacgtaactcattcagtacaacgcacagagcataaaccgctcgtagcgctggcataaggaacatataatgaagttttctattattgatgacagtataaacactctcaaaaatattaaaaatcgcggtatcccctctgggggtgccgcaatcacagaatcagtattaaagcaaactatcgttaccgccgaatttccggcccaacgtgcagcaggtatcgataacgcttataatgcttcgagtctgtataataacggccttctgttcactgcatatgattttaatggtgttggtagtaaagacaactatcgttcattacgtcaggcagcacagaacccaaaacaaatactatcatctgcgacgggtaatgttaagtacaaacaagtgttgaatagttctattggtactatggaacctgtttgccagatcctgctaccgcgaagcctgaacgataacgaagtaaacagccaccgctatcaagatgcaaacgatagtttcttaaccaaagggttgagccgtgttgtttcaaacatggtatggggcgctgtagaatccatttcaggcggtattatggcagaccgaagagaagcccttgatgttggtactaaagccgctttccagggttctgacaagcgaacaaagatgtattacaatacattcgtgatcgaaagccgtaatgatttgctggaactgattaaaatctactatctgtttactgttctgggatatggtacaacttctggcggtactgctaaagaggttgctgcattggttaaacagtattacggtgttctgggtgctaaaaccgctaacgcaattagcccttccagtaacccagtaacagcgtcagattttgataatagtctgggtaatgacgtggttgatttcatttcaaacgtagaggttattaaatcgcctcctgtctggtttattcgtgatttccagtctggggattccttgcgtttacctcattcaacctttgggccagcaggtattaccagtgttcgctttggtcgttctattgataatattgtaaatacattaagagaatcaccaaataccccgatctcacttgaggtcgaaattcaatttatggaactgatcgatatgcgtcaggattctatttttgatacaaattactaaggagatatgatgttttacaacgtagatgaatttttatcaggtatggctaatcgcgattttcagcgtagcaacctgtttagcgttgtatttgcaaccagccctgcatcacgtatccttgacaacacgatcggtagtattcgagatactttgattgatggatctattagttctatcaacgcaaacaacccgaacgaattcattaatgctatcactggcggtgtgagtaaattgtttagttacaccgtcgataaggcgattatgtcgctgaacaaaacaggatttagcaaaatcatcggggcaattagcccccgtttgattacttccctgtttggtgataacatgtatggacaactgctatctgaattccgtgatgaaatgatgtataatatgggtttaagcattatgggagttaacctccctggtaaatccattgggtacgaatacgtttataatggtggcgtacctcaaatcagattcactcgccctgagaatggggaattgtcattgacgttccgcaccgattcagaagcccgtaacctgaaaatctttaacgaatggatttccgctattcgcgatgatgtaacaggacaatacgccttcattgatgaagtgacaagtactattcaggttaacttacacgatcgtgatggttcaccgcatacaacatacgtatttcagaagtgcttgcccgtcaaaatcagtaacagtgaattgagctatgagaacaacaacgaaatctggacatttactgttgattttgcctataaaacatcatgggttgttgaggctgataaagaaggctgggaagggttcaaacaatccgtagaggaaggtttagccattgcagcacgtaccgcaattacaggacaataaaggggctacggccccttttgaggatcttatgtttgatattattcgagtaacattaccatcagggatcaaacgattccctatgtttacagttaaagatcagtttaaattaatgctgacccgtattgatatggaaggtcggccccttaaagagcaacaggaaatactggatgaagtgctggatctgctttatcctgggtattccaaaacagaacaggaatacattttcagccgggtgtattgtggttcgttcggtaaaaacgttatcaaggttgtgataggcggtaaaggtgggggccactccgaagccttcatggtgattaatgatattcaactggaaaacgaatacaagctgaatgatgaaatcacattagggtttaacttcccccgtacacgcaatacaagcgaagagttgtttcttgaatgtatcagttatgtaatatacaacgaacagcgctatgaatggacatcactaaccgaagaaacgaaagagaatattcttgatatagtcgaacttgatgatgtcgaaaaaatagttactatgctaacgaaatcggttgatgtgtctatgcgcggtaaatcatttagtggtatgttaaccctgttcaagatcctgtttagtcgcggggatctggatgaatttgtgaagaccaactatctgctaaataaaaacggcctgaacctggaacctatcatgaatagtagcccaatggaaaggcaaatttatactgcattgcttgcagaagacttgaaaaaacaaggtgttgttaaatgagaaagcatgaatataaacacgttgagaaatataatgttgattatcgtcctctgacacatacagagtttacccccaatgcagattttatcaaaggggatgtttacctgtatcaaagagaatatcttttcattctggcacttctggaaagtaaaaatattgatacccgtcaactgttcatcaactgtgaagaatgtcaggaaagaattgaattccagcttaaacgcaatcaaataatggttgaagatttcgacgataaactatacgggaatgacgggatcgcgttatctgttcaccctcgtaagactggcgatgaagagatccccgatcttatcgattacgtaatgatagacggcgaacagatcatgtggagtgattgcagcgacaaagataaagaaatggtgttggatgcaatcgactatgcaacctataaatcgatttctaccgccctggataagccagcagtggtcgcaaacattccggtaaggtgttcgtgtggacatagccatatcgtctctctgagaggcttacagcaatttttaaaggtggtctaaatgggtgtaaatctgaggttgctatatagcgatatagaacctaacatgcaacgagattggaataatgacgtagcggcttcaaaaggggccgcagcagtaagaaatagtttgattggtatcgtaaccacgatcaagggtacacgtccatttgatagtaactttggttgtgctattagtgatatgctgtttgagaacatgaaccctctgacagcggaatcaattagaacttctatcgtatctgcgatccggacatatgagcctagagtatataatctttctgttgaagttattccacagtatgatgataactcagtaacagtaaccatctattacagcatcattgatgacccggatgacgtagagcaaatcaaactacagctttccgcatcataacaaaaagccccttcctttcggttggggctttctcttagaattcaatgaatcccattagtgtttgatatcgcaattcaaacggggagatataactttgcatctggttttgatcggatacgatgtaataatacacctcatcattatcatcgtatagtgcttctttgatgatgcaatatcgatcggtttccacgttcacataaagagtatccatgtactttgtaactttggaaccctgtgaactgatctcgtgaatagcgttatctatgaacagtgacaatgcttgcatgaagttatcaaactcaccatattcacagcccataatagaaattgcagtgtattggtgccagcctttgattgtatctccacggcggatccatccgatttgtctacccccgatagatacacaccacactttaccaatagggctatagaaccgcacaacttcttttaataacagggacatgaccccgcattttgtataaggattcattttaacctcatttcatatcaagtagccatgaagggctagtttcaagagaaatcgcagtatattcgtattttacagtataacctttgaaaccgaaaggaataattgcattttcattgagatattttactttatgctttgcttcttcttcattcagagcagcacagactgttgtttgttcaacgttaccagcaggagaagtaaatttttcaatgatgatatatacgcagttcatcctattgtcctctttccattttttcaagtttcatcgtatccacttgcagttgaagtttaagaatacaacctttcgatatgttatacaagtagtcactaacgatttttgactttacctgatcgtaatcagaagataacgtaatccaatcatacatcgtttggtatgatggaagatacgtacattgttcttcttttgataacgctttaaatgattggtaatcggttggaggttccgaagcaattgcggttgtggtcataagactaagtgcaagtagtagatatttcataatgtattcctcattgttttcgatagaaccaatatagcaaaaagccccgaccgaagtcaagggctttttcatcaatgcaagaaagatttcacgtactgttcgatcttttcacgacatgtatcaactgaggtgctttccgcaattacggcatgacataacgcctcgcctccgacccagaaactcatcatgtactgaatatcacgaccttccatttctttttgatgcgctttgattcgatcgaaagcgttttcgattgtttcagtagcagtaagcatttcggattccccgtcaacctccgccagttccccatcgatcatttcgctttcgacttcttcccagtatactatcgttatcatgcattaccccagtggttaaccgtcgtaatccccgccacaattcacatcgccttcaatgaacagttcgcggttatcacgtaataaattatactttctttcgagttcaggcccgaacgcgtcggcgtcgtcataccagtcatagttatagcatccggtttcatcgtcgtattctggttcatcaccgcgctcgttgaagtgaacaattttaatatcgtccatccccagttctttcagcttatcccagatatacgaaatctcaacgctatgggaaccgaacgcttccagtgagatcgtaccgtcgctatcgacttgaggaacaccccacttcgaacgagtatcatcggtgatcatatctattaatgactcaatattattctcaccgtagatatcagcaacttccttttctttaccaggacgaacaagcccgatcccgataataaagctactgcttgagctattgctcacaaacccagaacgaattttcatcgcatcaccatattaccaatcatgaatagagggattaacgcgaagacaataccccatagaatgaccttatcttcacgacggtcgcacccatgatagataacacctccagcgaaaatcaatacaacaactgaaacgaacgcgaataaagaaatcatttgcgggtatccattctcatagaaacttctttcaggatcttattcagatcgtgaagcgcatcttttacgttaccttcattataggtaagcatatcctggtacagccctttcaagcaacgattgataacatatgctttttcggaaggtaacattgtcccagaacgattataatctctgaaaatgtccatcatcgtgccggtgttgccaggtaatgacgggttgaagttaaccataccggacatcaaactatcaacatacacaacggttgtgttatcagaacgatacgcgccaccaactttaaaccagttgctgaacacatacggagattcccgcacttcgctcaaatcggttccgatttcatcgatgtttacacgaatgttgttaaaatacaccgattcatcaatagaaccaggacgccataagatagcaccgttgttatttttgaatccgactacatcaacctgccagccgttatctgttaaccggacatcatcaacgacgatgaaatcaggtagctgtgaatgaaagccgatgttttcaggacgggaattacgaaacccatcacgattggagaaataaaggatgtcgccttgattcagtttgcatatattcataagatttttaaagtccaattcaagtaattccacaagtcacctcaaagccccctttcgggggcgagatctcattagagtttaacttctttttcttccagaacgattgtgcaatcaaatttcacatctttccagaattccgctgcaacgatatctgttgcggtaacgcttacgctggtttcttcaaaatccagatccgcaaaccatgcgtgtccgacgacaataccgtacattacacgactcaggcgattattaagggcgcgaacctctttaatagtttcctttgtctgcttatcaagatactcgatcaggtcattcttgtcaagcgcttcgatctctttagatacagtatcataagcccacagaatgatcaggtcgccattgttgagtttcttcttaccttcggcgcgttttgcaacggtagcagcaacagccggaagtgatgaaacgcctttgattttcacgttcagttctttcgacatgtaaacatcagtcgattctgtgcgctcaaccttcggagaaaagccgtaatcacggatcccttgctcagacaaccattcaccagccgcctcaccaaagcgctgtttaagcccttctgcgttgcgtaaaccaatcgcgttatcacggaagaacttcattaccttctgacggcctttcaggatttccagacggacgttatcagcaacaaattccttaccagaaataccgcgagtcatcgaacggttaaccagaggcagagaggtaaagtcaaccagtacagacatacggtcttcaccaattttagccagcggtttgatagtcagaccagaagcacgtaagtttttcagagtcgggatatcggtttccagcggaagtaccttaacgttaacgataccatctttaacaatggtaaagttacgcacttgtttggtttctactttttccggcaatccaaactctttttgtttgctttccggaatggttacgtaaccttgtagatccgtattgatagaaatgttcggacgggaactgttaccaaccaggtgtttcactgcaactttcgttgtggtttgggtaaattccggtttccatacttcatgcgctaccagttgcgccgccagtgctttacgttcttccggagtagaagcgtttgcaatctgttctgacagtttatccagtgtatcatcatctttctggacagtctgacggcctgtacgattgtacgcccagtgttcagaagacaggtcgatcactgtgtcggtttctgccagcagttcgagagcatcaaccagagtaaacgcgttttcatcaggaaccatgttgtaatcaacaccatccatcagacgtttagccggatcaacaaccgcttcggagatcatatctttagcgttggaataatcctgtttggtaaagcagttatcgtatgctttaatcagacgcacatcacccagctttttcagaactttccatgccagatctggattcatggtatgaagcgcatgatacagaaccacatacagaacctgttcaccttctgctgttgccggatcgaagccgtcaacgtcattgatcgcgttttcacccagcgcccaaatgtttttgatatgttccggaaccagaacaacaccatttgcagcattcaggacatacacacggccttcatccaggtagatcgcatgagttgcatcgccaactttgacttcaacacgtgcggaggtttgcgcggtaatgatttcatcaaatgcaggtacatacgcatcaaacccttcaacgaatttgtgtaatgcgttggttgcttccgccattttttccagcagaggacggtttacataataaccatattccaggaaagcaatgttgttaaacgtcaacggcagagtagaacacgctttcaggatgtcatcagtacgccagcagttatcataaccatcagtcaggaagatcagactgttcagattgccattatccgcttgcagatcggtagcgacttcaaccgccagttgcagaggttcaacgaagccagtacatccggtcggacgcagataacgatcgatagcatcattgattttgctcaggtcggatacagagctaaccttttcgcccacgaatacagaaccgaactgaccacggctggagaaatacagaatagatacggtatcatcctgcttaaccagcgttgccaggttgtttttcaggtgctgacgaatgcgcgggagttcgttatacatcgatccggatacgtcacaaacaaaaacgtggttagtcggggttggtttggctacggcgtttttgaattcaatgttagtgatcataattttctcatttataggtaaatttgattaaaatttcgtttacttttttgctaattatatctaatgcatcatcgcatccaaacttactactcaacaatgaaacaaaatcatccatcgttgttgtttgagactcgccaacgtcaaaagacagagcgtaggcaacaggatttttaatccttacgatttgaatagtatactcattcaggtcaaaccgttcaagatattttcgcaaagaaaataaatcaatcggtactggtagagtttgactaaacgttatttcttcccccagttgataggggggcatttttacacagatttcgtattccatcagtgatgactcttcatagtgtgttccagattacggaaaatttgcccgtgttcaagctgggattggaattctccgcattcatcagagtaagtaaattcataaatgaatacaccgtcctgattgccaaatttagagttgtactcttcatacaaccacatcttgatcagagcgtctttctcttctgtttccagatcataccagtcacgcccatcataagcaagcgcaatttgaggattagaccgatatcgagtttcggcgctatcttcggtttcccattcataacgcttatcatcatagtatgattcgaagctatttcccatatgaccgcccaggtcgcggtgtacctgctgtacaacttcttccgctgtcgggcaagtcatccagctataaccacagttaggaacacagtcacccatcatttcgcggagattgttgatatcagtcggatccttcgggaaccggacgatgaaactacttgatgaactattgctcacaaaaccagatcggattttcattataatttctcccaacgttcagcatttttaaccttcatctttcacttccttcatgtttttcataacttcttcaaaagttacagggatctcgttgtactgttgcgattcttcatcccatacatcgcgatgcccgaatgttgaactttttgcaatgattttttcattttcccatacatcaatagtaacatgatcaccaagataagggaaattaggaactttgttcagcgcatcaacgcagttttgcaatgattcagaaacatgggcaatttcagtgaattcataatcagcactataagaagctacgtaaatcatcaccaccccctaacgatgctaaccagcagtaaacccaggatccagaacacagcaaccgcacaaatacgggccattactacatttccgcgactagtccactccgcactaagaaacaagaggacaaaagttaacgcgtataaaaccatttcaataacttcggtaatcatataaacctcacgaaaaagcccctttcggggcttgtttaattaatgcccgaacacaccacgaatagactctgcgaatgcatacagttcaggatttttagctttcactgtttcgatttgctccagaatgtaatctggtttatatttcgcaccgaaccagcagtaagagaaagaacgatcccacatgaacacgttatagtattcaccgttgcgaacttcaaccatcacataaccaggattagaacccagcggataatctttcagaagattgaatttcgcgccagcaccagtacatccgttaaacaggtcattaaaagtcatggtatgttccttttgtcagtttcgtttcaacaaggacactatactattcttctttagcctgtgcaagcgcttttttgatttgttttgctatggcttcaatcactgggatggaaactgaattcccagcctgtttgtaagcctgtattttgctttcagggatgataaacgaatccggaaatccttgtaacctaaaacattctcgcgggcttaatcttctagggttcttaccttcctgcaataccagacattgaacaccatccttatagtattgggctgttatcgtcccagtacacacagaatcaactgtaacggcctgatagccaaaccccttgccgtttgccttgtttcgttctttacgctctctaaagcccttccaggcacgatctgatatggtgtattgatcattatccggttcgagaatgtcaccgacccttgttggggtacgtggaggaacaggaaagctaaagaacaccggatcgcgaaagcagacaataaacacacgctctcttcgttgaggcaatccaaaatcttttgtattcattacctgataatggatatcgtatccttcgtcctgtaacagcctgtagatggttttaaacgtgttgcccttgtcatgggttaatagctggggaacattctcaaagaacagcacagagggctttttagcccgtataatgcggagtatttcaaagatgatagtaccgcgaggatctaacatgccctgttttaaccctgctttactgaacgcctgacaaggaaaccccgccaacaggatatcgtgatcgggtacatcgttttcatcaatggtgaatatatcaccctgaatattttcatcaccccagttatcagcatatgtttgttgtgcatgtttatcgatttcagacgttaaaaggcattcgaccccgccgaatgccttatcgaaaccgagcctcacgccaccaacaccagcgcaaaggtcaattattttcatacgtcgaaatcaacctcatcgattttgtatgattcttcgccaatatcagcccatagctgaatattcacactttttgcatcacgataaagagattgaccacaaagcccacctgtataacaagtttctgtaatctcgttaacttccaggcggaggctattgcgcataattttaacaacagccttttccattgccgaatctagggttttagtatcacccaatactacatctttaacgttcaaaataacatcactcattatcgccactccgtttcaattccgtgtttgtatgcgtcaacgcccagaggggtgatcactaaacacatatcagtatttttcgttggtgaactaaacgccatagatgcataacctttttgaatcagggcatcacgccccgatttactgggaacatcgttgaaatctaaatccaacatttttgacgagtatctgtaaagtttacacagaacatcaatttcagcgccggataatttcgggtatgtcatttgtagtacctcacaacatgttcagaatacacacgttcaatgaaatcattccagaaatcgcgatcaacttctttcggataaccagatacagccgccagcttttcaacttcacacatcgttgattctagcgcctcttgtacggttgcgaaaggaacaccgccagctttaaccattttcaaaaatgcgctatccggaagaggatacacaatatcaccttctttgaaaatctggatcaactgcataccaccgcgcaacgcatgagaaagagctttccagtcgatcccgttgttggcttctgcttgccgtgcgcgttccccgtattcatcccagagtttatacacagacttacgcatttcatcggctttgatcgtgaactggaatttacgccccagcacttcatagaagtcctgacaaccagatttcattgtcgtgtcggtaacgaatcgacagaactcgtttgtagggaaacgatccttgatgtcagacactttcacttcacgcgtatagcgtttcatatctggtgtgaattcctgaataccaccgatcgtttcggtttctttcagtacatcgacaacttcgcgcagtgcagccagtcgggaacccttcacgccatatttcgcggcttgcttacgaacataaccgaacaggccagttagttcagtggtatagaaccgccagcggttagcgcggatatactgccagatttcagagttagcgatcagcttatcatccgaagcgtgaagcatatcgagcgctacggtatcaccatcacacgcaaggctgataaacttagtcagactatacaactgacgatcaacgtcgtctacggtgtttttagagcttttatcgcccgtgctggtgtcgatagtcttcggggctttacccaggagaatatcgcgcgggtgcgggagaaagatccctttatagtctttgtcgcttgtcggtgtgttcagtccgtacaggtgagaaccaaataccatctcaacaattgttttcattatacaaatctccaataaaaccctttatgagtttttcttttaccgttacaacatgaacttacatgccctttgttataccccatttcaacggcttccgcaataccaccatttaaaatagtttctctttctgttttgatacatttcataatcaaaggttttatcaattctgttttcttttgtgaaatattagctaatgcaattgcatttctgatatcagattcactcattaaatcagaaatcttctttcttaaccatacatagccttgacttttggcaagtttgccggagcaacattcatgaatatgactagggttaaatccacgcaatttcatttcttgccgaccgcctaatatgataatctcgtctcctgtttcaaggttgaatccgacaactggaattatttgccgttccgacattttctttctcgcttctttcgtgaatattgtaagagattttaattttctcgcgtcgctcatttgcgaagatgtcgttttgtatttcttagtattatgagacatacggaaaaaagcatatctcattttatcaccagcatacttagcaagtagatgatgagcaagataatgctctttatatgttaaatatactaaattttcgggttcatcagtaccacctaatgacttagcaacgatatggtgtatatcataaccgcgctttctatactttttcgagtaacctttaggtatatctcttctttttgccaatgtaattagttggtcgtaaatacgcttatagttcatacactctcctttaggcgtatttatcacttaaaatccgaacacggtttccattacagttttcaaaattcaacctttaatgtttttgcgatcccgcgcaattcagcggtagtaataacagggatcataatcatttcctcacagtttcaaattcttcatcagatttccaatatacgttaaaattacgacaatcgtgttcggatgtcaacgtgtatttttcatttgttttttcgtcagtgataaccatagtttcattctcgatcgagttaacaccgtaaacgaaaacattctcaccacgtttgtttaaaaacgcatcacccttttcaatcaactgccaacaggtaacaggcaaaccacccggactaaccgggcgggtaacaagacaatagggatgtttaatcatttaaattcttccattgcataggaagtaagatctttgaaataccttgcggtgttgccttctgggttgtttgtaatctccatcaggataacagcactatcaactcctgctttcttagccatgaatgaaagggcttcggtagcaataatcgttgctttcataacatcagctttagaaacgttgattgtattcatttttcttccttttcattaatcacttggtatgtgtgtataatacaaaagccctcacgagaacgcaagggcttttttattaaatttcgtataaatctggattcacaataaccgcacataaaagatcatctatatgtgcggcttcttgttctaaggtttgcttagatgaatgtgctttcaagcaacccccgtaaaggcgtttactatctggaaatgatcatcgaagaattccccttgtcgttgtacgacctcatgcataggtagccagaacgcgtctgctgcatcatcagcaccgcccatgatacgaggcaatgaaccatcgttattaggttctagcttgatatactgtgctacagtcggttttgagaagtacaccgaacgtttcggatgatcgaacagcatcgaattacggatagaaccacgaataaccttttcaggtactttaattcgtacttcttccagtaattcacggatcgcacaatcaaggaacgtttcgttaccgtttttgtgtccacccggaagcgctaacgcatctttaccaggcgcaaacttacgacggattactaacacgtggttattacatacgaccactgaatcagccgtgcaacagttcagagaatccggatacggatattttttgaacttgtcaatctctcgttgccagtgtgcatcttcatgggacaaacgctggaattcttttgtttgtgtccattcatcgataaaggaaaccgtagtgctaggcgcatattttaacaaatcttcgtcccagccttcatggtgttcccagataattttgcgtaaattggtcgaggacagatcctggtctccaaccttcacagattcaaccggaatatgattccatccgaatgctttaagccagtaagaatctttgtctttttcgtacccgacgatcgcaattcggtcatttcgagtttcatcgattgccatacgaacacgggatttccatttttcctcgttatagagataatccggaatgtgagcgaatttgattctggctgcatcttcaacatcaagtttgcagatagaccagcgagtgatcattgcttgacgctgtttagcggtcaatgggtttaatgtgttcggatatgcataagcagaaccgatcagaatgtaaaccgtatcagcaacagcaagggcttcccttaccattttctcatgaccatagtgaaaaggttgaaaacgtccaattactacagctttatcatatttgtgtttcataacgtgctccacgtttaaaggttaatcataaaacagacgcaattattaaaacaccaaacaatccaccaatgaaaccaaagaatagtgaaatgagtattgtcaatacgatctgttttatgttcattatagtattctcgttttagatgtcaagcccccaaagagggggctttaaaacattatttacgagaatcgaaaatcactttacccgcataatccgaacccattacagtttgaggtacgccacctttatagcgggtagagtagttcatctgtacatccagttctttccagcggatcatttccggtgtaatggtgcgttgcagggcggcgttggcttctgcttctttcttcgctgcatacagacgggcatcagcatcacgttcgttagcgattgcagcgttttcacgcgcctggcgatcggcttccgcttgttttactgcttgtaatgaagtctgttctactttttgcagttcagctttagcagcgttaacctgttcttcgcggatcttcgtgttagttacctgttccatgataacttccggcagggtgatatcctgcaagaatacctgtttcacagtgtaaccgtaaggccgtgcataatcttctacttcctgctgaattgcgatttgcagttggttttggatcttcgcatcaaacaggtcttgcgcttttggtacggatttaccaaattcgcgaacagtggaaagcagtttttcagttacatacttatccagtgcctgatcctgattacccgcgttgatacggttgatcggtgctttgctaccgtcgaattgcagcattacggtcatatccacagtggatttaaatttatcctgggacggaacctgtaatttgtcgaacttcatcgcgatgtctttggtgctgaacgtgtcaaacgtcgccagcgggtttacaatgtggaaaccaggcagtacgggtttcggtgatactttacccatgaaggtttcagttttaaccgtaccgtcttgcacaatggtatacatgttaggcactaaccacagtgctgcgactacgcccagagcgatcagagaggttttcttcgggttgttcacgatagtgtttaagttcatcataatttccataagttgttgttcaattcgatagttattctatcatcacatttcacgctgtcaaactatttttaagaaagttttgtcagcttgtagattgtttgatagcacaagcccttaatctcgtccaggatgttcttcaaagaactatctactgattcgtagatctcgtttgcttcgttggctattttacggagatacgccaccgtgtcaagcacattttcggtttttagcacaggtttgtatcttcccgtgattcctatgtggatttcggtgaatttatcaaccaaatcctgcatatcttcgtaaaaaccctcatatgctttatgttgtgagtatgaacctgttgcaaaatgtgcgctatgcatataggtaacggacataaggcacatgccaataaaggcatctatcttgcttgagttctcagattctgtaatttgtttaaatgattgcatgatgatccctttatgaacgatggatacttgcaaactcatacgcgaccctaatccctagctttgcgcattcggattcagatcggcattgtttttggcgccattttcgttccatgtagttgtagaatagttcgcttgtatttacgctgggagggatcgttgtgatgtatacttgaagggccgcattgatataatcgtcaaattctttctgaaccggacggtcggcggcgtgtgttgtgggtgtcatcatcaacaatccgaacagcacagccattgatatgcgtttaatgttcataacaattactcttttactcatagacccactataggtctactcctgtatatatttatagcaaaaacgaggccgaagcctcgttataatatttttgctgtaaagtcaatcaagtaatgtcataccaacacaaacttctttcgaaagcgcgtattttgttcacgttttctacgttttcatcccaaccgatcacaccagctttcatacgtttcagttcctgacgtaaacgggtacgtacttttgaatcaattttctttactgcaatagaaagcattgcgttcagatcgccatgagctttgttaccgtcgcgacacaaattattatcaaatcgaatgtatgcacatcctgatttgtgtttccagttggttgagtaccaacgtaacccatccggatcaataccatgttgagcataataacgagaatactcttttacttcttcgatcttttcgttagatgaacggtcacgaagaggattgtatttcttacggtaagtgcgactcataatgatctccttttgtttatgcttccactgtatcagggttgttctttagttgcaagtagtgttttcgacaaagtgaaacatatttgtcttctgccccgatctcaatctggtcgccattagcaacaaatttgccatttgcatcaatacgggcaacggtagttgctttctttccacaatgacaaacccctcgcaactccctgatctcatcagccagcgccagcaacatataagaaccttcgaacaagttcaactgaaaatcggttcttagtccataagtcattacgggtatatctaattcgtcaacaacccgacacagatccatgacatttttcctggaaaggaattgcgcttcatccacaaacacacaagaaaccagattcgggctgtctctataaaaatgattgttgtgaacatcataatacaagtccatatcaggcgtgatcatagtgcatgttgcttccaacccaatgcgcgaagagatactctgtttaccttctcgcgtatcaattgctggtttgtacatcaggatccgcataccgcgttcctggtagttgtatgcatcagtgagtaaacgagcactcttgccagcattcattgatgcataatgaaaatacagtttagccatttatcctctcaacaaaatctggggtattctggaattttccttccccttcatggtttttgcatgttttgtttgaacagtagatccaccaatcccactcatcataagggggtttggtaatgttcattacgcaaattaaagggaaatgacaatcccgacaacgaactttttctataatgtgtgcgttagccaattgaaaaccatcctttacccatgagtttttcattatgtcgcgcaagatactctttgatttctggcatccggatcgcagtgtcatattcttctttcgtcatggtatgatttgcgcaacccatacacccgcacacctgcgcgttacaccaacggagtgttccatatgtcgcaatcaccttcattgctttagctttgattttgtcagtcatgattataaccactcatttcgttatcttgtgcttgatgtatatcaagataccacatattgattttacttttcagttcgtccatttccttactcagacaattgtcaacgatacatagaacattaacagtttctttacgctgcataatgttgatgttattcgctttcatcgcttgcgccaatgcattacaggttttaaccagtgcggcgcgttgtcctttgattacggcgatccgcttgtttgctttcttaatctcccgacctgctttgataggatccatcatgattaattcgccttacgaggatcgaaatgaacgacaatgatcgggtaatcaccagtcacctcattaataatgcgcttaatgagttcccagtcgcccccagcgaggccagcaccgattaaaggtgtgatgataggctttccagtcttaacggcgtcagcaagccctacagcctgtttaaaagcattgccgattgcgtcataatcgacacgcggcccaggtgtccagaaatcatattgagtatatgcattgaaaacaatgttgcctttttcgccaatgtaaacagaacaagttccgagcttatcacgggaaccttttaacgtattggcatcaacttgaaatgcaccaggaatacgatcgcggatttcgcgagcaataccagcgcccatattgcaatagcagttgcatccgtggatcaaatggccttcaccgttcagatacatattgacagcattacctttcacttctttaatgatcatttttatttttccgatatagtagggccacaacaaggcccatcaaaatcacaaggatccacaatacagtgaattgaacccctacgctcattttctcgctttccgttcacggcggcgatcttcttgatgacacatatataaaacaccaccaaaaattataaaaccgataacaacgcctataaagtatccagcactaaacatagtcatcatccccgcaatagtaacaaggcccagtgctctcatgcttaccagcattgtacgccaagaacaccacaaccgccgccataataataaaaatccagatagccattagtaaagtcctatgccagcattgaattcgtcaaccaaataagtacggaacttttcgcaccgttccttatttggcgcttgtttgcatagattcatcattggttcagactgcaaaaactctttttgtttcagcaacttaccgcgtttatacaggtgagcattttcctctccccacatataagcaacatctaactgttctgcgatcacttgcttacatactgcgacatctttgatatcacgattgttgcataactcatccaggcgagcatcacccgcgtgagcaaatccagcaaccagagttaaaagcagtgctaactttttcatgatgattccttattcatcctcttcgataggggtataataatgcgcattgcagatatacgcaagaacttttttcagagacatatccgagaacgtcggatcctgatttcgtctcatcccactaccagtttcaacagcccaacgtttgttagctggattgtatgtcagccagtaacaatcccattcagacagagtatgttcgaacagatcgaaacgcttacgcccatttgcttgcggcctgacaaaaggttcaaccatttctaaagcggttaaaactcgattaaggtttgaaccgtcttcatccatcgcgatccgcaaacagtattggttaatgtccggatccataccatcgatacccagaccgatagattcgaaaaattttgttgccgcgtgataagacacactggaagaacgatattccaacatcacggggatcttttccccgtccttgacgttgttaatgatatcctgatcgatgagttcaatcaggtctcttttctctttaatcaacgtggaaatttcttcttgcagtggggctatctgtgcatgaagttcttttatccgttgatcaattacggtcacttcgaacgctaagtttctcattgtacccattccccgtttttgtcaatgtacatgatccaatcagcaaccgcccaatgggaagtattgcctttcggagtcgccacgatgtaggaaccagctttaaacagtacgcgtttagtttcgttcaggatcaggtcgctcataatgtattcctcatttaaccaaagtgaatcgtgattcataagcatcgttcgggcgctcatacacagtatccgaacttgtaatgacagtgtacacggtttctttcacaagatccatgattttctgtgattctccccagacattgatactaaaataaatcccatttttaggaataggattgtattccatatcataatacatatccatgagttcacaaatgaacaggcggcgctgttcgttatcatatgtgaaataaatgttaaaacaatcgagagatttactcaaagtaatctctttgataacgatgttgtcttgtttgctaaaatgatcgcggattgcttgcacacaacgcaacaggttagggtaatcatatttttgtgaaacaatgacttgatgtgaaacgctcataatgtattcctctcaattagatgcactcataataaaaaagcccccgaccgaagtcaagggctttttgtcaaatgatttgtttttcttctaacagcttcgcggttgtattaaccatacgagcataatcacgggcttctttctttgtatacttgaaaccagcgttatagctcgcaagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaaccattttaaatggttttcgcatcgctcagtttgttctcgatgaattcagcaagattatagttcgaaattgatacgttcggatcgtatagtgcaacgatttcatcgaacgacaccataacagcccgtttaaagtaaacgctccagctagtcgtaaagatttcgctgtgatcaaatccacaattaggactgaacaaggcgcggtattggtatccgctgtatttggtcagacggcttgtgctgtgcgcgttactggtgatcaggaatttccctgtgtgagtctcaaccacgaagaaataacccagacgttctttattgtccagcatcgtttcaaacttacgattgttttcttcgcggtcaacacgggtttcgatcatcttccagacctgttcatattcaggccaatcatgctcgacaacaaccccttttatgggttctttgccttgctctttacgatagcgatcaattttattcactaccgcagagagaagcagtttgtcgctatcacttaacgcggcatcaatatccgcatatttaaacactgcataacgttcttcgcgtttcatactactacatccttatcacagaccggacaacggatcacacgatacacatcacgaccgccagtgtaatcggttgataccttttctttaacatcctgtgccgtgtatgacagaacagcaccacaacgacaggtagtttgttttggggtaatgcttacaacttgaaccataataacctcacaagaatagtttcacttcgctaccgcatttcgggcagacgatatgttttttcacgatgtaatcagcagcacggaagaaaccattataaaacgcttcggttctcttctgtacatcagacagttcatactctaacccacttttgcagttagcgcaaacggtaattagctttggactaacaataacggtgatcatgtatacctcacgaaaaagggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtgtttcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacatatttgtcaacttccggttgatccttaaacagaatgttcaggcttgtaatacatggttctacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacgagttcaccatccgacagaatgtattggttcgggtaataatcgccgtcaggaagcgaggaatagcttatttgggctacttcgccaacatatcctaacacctcgacatcatcccagaatccagggatatcgacatagccagaatacaacacatcgctatctttcagcgagtcatcgcccgtgtattgttcaacaggacagcccttagacatcgcgatcaacagcatgttaatatcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttacttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacgtagatattcagtgtccctttagactgcttgatgatatcgaaagccgctttggttttacccgacatccgacccatatccagcgcagtttcgaagatagacaccccgccgcattcttgcccccagcgcccatcaatgattcgcgccaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcacccgtgatgtgttttgagttcattgtttgagatacacccttacggacgttctcgcgctgttgttctacagtacgcagaccttcacgtacaccaaaatcaacaggagacagttgcagagcgcgttctacaactttcaccagttgaggtttaacacctttaaggttgttaaggcttttttgactgaatttaaacataaatcacctcttgtaaaaataccctgtttgggtacacagggtatttatggtttaagaggttcgataattaataatcgtaaagatcaccgaagcattcttcaaattcacgtttacgtttcatctgttcttcttttcgctctttcatatcaggaggaagacggtcttcattgacttcatcaatgtaagcctgtgcatcctctttggtcaggaagaaagcatggaagttatatccgttgcgcccattcatactacggtcttcaagagagaactctgtgtgacagtcccagtctttgtacatggtgatgcatttagcaaacagcccgataccgcgatgcatatacgggaatccagtaacaatcatcttgctacccatttcagccttttcgccattcacacaaaatacttcatacatgatcgcaccaggtttcacatctttcttgagagcacgtttttcaaaagcacttttcataatgtattcctcacaattagttttcatatacagattaccacaatctgttttgatgtcaacaaggtctatcgtttttatttgggaaagttaacgtgaacaggcgatcgtgtaatccctcgatccgctcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgtagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagagcacaacaacgacaaccataaaaatacacgcaacaattttccacataatttatactcgtttaaggttagttttgcaggcttcgatccagcctgaatagaaaggggagaagtcctccgctacacccaaacaaacggtagtatgtccgaatgggttcggtgttgttactttactatcgggattgatcggaagttcactagccccaacactggtcgcaaacaccataccaccagttacgtaaatggtttgaatatgcccgtaagcatcgccaggccacttgaaacggtattcagtgttccataccttgacgttgtacacatcatattcatcgaacagaggatcgttgccctttgtcgcttcgtaaagcgcaccgcgccattcatacagctttgcttcgatgtcgctaacgttgatctcttcacccgcgctcaaatcatcaagcactttctcaagggtgcggattgctccgcttaattcacgatcgagtttcatgatttaatctctttaatagaatcaagttttaaccgagcatcgtaaggcccgaaagcgttgccgttatggtcgaacttatgttcttcactcttccagtatttgccggacttcatcaaaggaattcgtctacgccctgttttattagaatcaaccattcctgtatgtgtgaaaatcatacaataccctcttcttcgagcacttcccagatcaaacgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacggcgcgttttaaacgcgctcattaattcatcgactacggcggtacacttcatatgcttcatccttttcctgtacagacatccgattatagcggatctcttcgcgctgttcaacttctctcacggcttcggctttcttttcagcggtcagtatgtgatgtactacagcgtttcggatttcccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgttggaatgtcaatagataccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtcttttcccttcaacaacgattgttgcatcatcttcgatccaggttacgtgatccagattcaccggatagtttcttacggtaacagtttcaccaaccataggcgacacatccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccaacgttcggtaaacgagcaagggaagaactgaccacgttcgttgatgtaagagctaaacatcgttgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcccttttgtttcagtcccaggaacacgatcgcgtttacttgtttcaggcgcggatcattcttcacggcatcaaccacgttaaacgcgtcatcataggttttcgagctaaccatgaaatgcaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcatacgccatcatatcgaacatatcagggtttgtttgcccctgtgcatcagcaccgagtgcgcattgagtcagccagggcattttgtcgatgatttttttgaagttggcaagatccatgttgaacccgttcgggttattggacttgtagcagaacccgcagagtttaccagcagggccattgcatttagttgtgatctcgatgtcgagaataaaaggaaaatgactataaataggatcgtcagcaggagtttttccccaagtcatcatatgacctgttttcatatcaaaattaaaattaacctcttcggaacgatagattttctttcctttcgcttccagtagaagtccaacaggcgttttgatatgtttggcgtttactttaacgtgtctcataggaacctcataatgtattacgtttatagaatcacaaatgttgtagagaacaagcactattatggttcaagaaaacccaaaaagtcaatacttgcttccgacgatttagggaaacactatttcagcagttcccgtgatagtcatttcatccaggatcagaaggaaaatccaggacactacaaatataaaataatcgtatctgggttgtcaagggaaaaagcgatgaaacttgagaaaaggttacacgaaatctacaaggtggacaagaacccacatttttataacaaacacatacacaacagcattgatttttcatgtacgccagaaacaggaaagaagatttctcaaacacatcagaaatacgcagcaaagaaaatctcagaatcccataaaaggcgattcaaggaaggtattgcatcacacaaaggagagaacaacccacgatacaacgaccatcggtcttatgaagagatacacggagaggaaagagcggaagctatacgtaaagcgcaatctgaatcaagaagtggaaaaggcaattcccgcgcggttatgtggaaatttacttcccctactggagaagaatttttagttgaaggagaatgtaaaaagttttgcaaagacagaaatatttccatgcgcaaactgaaaacatatctgggtgaagtcatcacaacatgtgataaaccctacgatatctctaagaataccgtaggatggaaattagaaaagattatttgaatcttcttttacgttcgtcagccagttcttttttgtacaccttgatgtattcaccgttcaaggcacggagatttgaaaatacacgattgaaaagatttttcttttctttgtatgccggagacatacggatcgattcaatagtcatacccatttcatttttaggatatgctcttaactctgcgccgatctcatcaatccatttttggtactgatcgcgctgtgctttgtactgttcaaaagtcaacatgtccattttttatccccgtttcgtttcggtatgggtgtaagataacatcatcctacacccagcgcaagagttatttgtattccatgaagaattttattgcttcttctggcgtcataccgtcagagaaaaatccaaagaaagtacagtgatggtcgttgtatgaaatattcaaaggagatagtaaacttcgaacatgttcagcccacaaacgatattttttgctgaatggttgatctctcattcttcgtccccttgcgcgtagtattcacacactgcatcttctggggtgcaaccgtccgagtaaagagcatacatcagatcttcgtcataatcagaagaacccagcatatgttgaacagagcgtttccatttgttgtaatctttttcgccctgggtttcgctgttttctgatttaagcatttcgtacatgttcatagaaatctcccgtagtcggttgcagcatcttccggatccgcatcaagttcgtacagttcgcgagctagtgcgctgggtttaatatcgcgccctaagtgggcgctaacattacgtagccatttcatatagggttcgaatttgttcattttatacgtaccgcgttaaaagcctggttccggagatcatacgctttttcaagctgttctgtagtgaacagagaactatccgagtttaccgtgaaactgcaaatggttttgttgtcggcgttgacttcttcaacaacgatttcgtaaccccagatcccgctatactcacatttcacgttccggtacttgatgtaaaccgcagcaacatcttcttttttgtagttccggcttttgtagataatttccatgatatcctccttcgtttcgatgtgtgtacaataacagattggggttatagagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttatctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttgccaatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaatctgaaccagccacatttcgatgttcggcgcgtaagtaacgtttaccttatgcatagtgcggtatttgtaagcggctttgtacgcatcgagttcagtcggaacacagaaagagaaaccgttatcatagcgttctgcgttagaaacttcacaaccaactacagcggcaatgtttttattcatgttcatgatattttcctttctctgtttcgtttcgatgtgtgtaatataacaaagcccctgcactaatgcaagggctttttgattattttggtaatttttcgattgttgctttcaactcattgattttattaaagagttcatcgctatatttcatcaactcactacggcgtttttcggcccacttgatcaggaattcaggagaatctacaccatacgtgtaaccttctgcactcagttgaatacgagcacgggaaccataatcaacagaactttgttcaatgagaaacttgaccgcatcaagcagggctaaatcttcatgacttaccatgattccttctgcctttggaagatccacaacttcatcctgaatgagttcacggcgggttgtttcttccagtgtttcatgattctggatcatcgtttcgaccggatcctttgccacggctggtttgttttcacctacttcttccaaaaacatcaacatccatccaggaattttagtccggaaagaactttgtacttcactggtgcatgaatttcccagaatgtggatcgcgttaccatgcatatcagctttattgatatagataacgttctgctgttcctgtcggttgctaccataagaaaggaagcggcgtaacgatgtgttatgaccatacttccctaaatcgatttcagccaggcaatcaatgatcccacggttagaaaccttgtaacgtttaccctgtttgaaaaataacgattcttccaggtgagtaggggtaaactcttcataaagaacatagaattctttaggaattttgcgctgaaccagactcagtttacaattattagaaggaacaataacagcgtgaatgtttccttctgcgtcacacatagcttgcattacttgcggatagtaaagatggtctttcttgcaagtatagctatggatacgactctgccgttttttgaagtaccatttaccagtttcaaaaggcgctgttgtaaaattcattttgcattctcatacatagttaaaattgcttgcatatgttccggtgattgtggaacccctgcaaagttcactttcaaaaagaaattcaaccgatcttttatgttgcactcatcgagtccaagcgctggtaatgaaatgttttcaaaagcacgttgttcatgtctttccatttcaccccaaaacaaacgggaaccgttaggcatcggtattccaatttcattgttccagaatttcatgatagttgtcaagcgttgttttccgtcgatgacttctacccatcgagattcgttgaattcactatcaaccgcgatcgcgatgataccgcaaggaaacccagtaatcaaagtcttcatgaaagcatcttgctctttctgcttccacacgtagggccgctgataggacggattcagatccagatcgttgttcttgaaccagtgaatgtaactaccaaccatgatcgcatgatcgcgactttggaaagtttttaactcacgaatacggtttcttacaatttcgtctgtcattataaaatcaccatccagtatataatcgtaatcataaccgctacagtgaaacacattgcagcgtacacccgcgcattatgaacctgtgttttcaattctgcgatctcttgatccttttcgctttcaaactcttcgcgagtaccataatacccaggatcgttagcagttgccaatctaaccgcatctttttcaaccagcgttgcataaccgctttttatttgtgtcgccccgtaccatccaccccgatcgttgttaatgatcagatgatcgcctttttcgttatgctttgattcaccaacgacaataacccgcttaccattcataatatgatcctcaaaggggccgaagcccctattttgcgttcttctgtagataatctaacagatttccgctttgatgtaaatccaaaactttagaaaacttctctgcgtttctttcgtttgtgagttcgtcgaaatgccatacaccatcatcagctattaacgcgccaggtgatgaacctgtttctacatcacgggaaagcgcaagccccagagggtgtaagatttcgcggttaatgcgccaaacaaggcccatttcagatagagtattaaaatcgacgtatttcatattatgcctttggtttcacaccgtaggccaacataccaaaacgatgatcattatctgcatctttaaacagaacttcgttaccatcaatgcagatgacctttgcttccggatcgatgtatggaagcaaccacaaagggatcaggcgtaggccgctatgttcatcccagcgactgaaattgagttcttccagttcatcaagggaaagctcattaggatcgatataacggaaccatttggtatttttgaggcggtcggggaagtttacaatttcttcatagccgaattcagcactccatgaagagtaaatagtgacttcggatgctttggttaaaacagcatcgcgaattgatttgcagatatcgattaaagtcagttgattttccatgatatatttctcatcttgctaaaattttaggcagtagttgccccatcgttttacgtgcatgtgacggaatctgtgagatcgggacatatttaaaatcatccatttcacgtatagtccgtccgttcttaacgaaagttgatgcacaatagcattcttccgctactgggtaatcttgccctacatagaggaataaagcaaggttttttgttttcgtgtaatcgagaacacccaggctaaccaattcctccgcgaacacttcaaatcctgtttcttcgaagcattcgcggatcgccgcgtcaatatgagtttcgcccttttcaacatgccccttcggaatatcccaatggggcgtttcagtggcatggcccatcaacacggcaccatctttaacaaagataatacccgctgatagttccatttattcacctgcaaaagcgttatcaaatgcttcaagtgcgttgttagcgcgagcactggcttttgtcacaccagcctggagattttcaaagaaagtacgtttccacacttcgcggcgaatagattcatgttccagactgtttttgtgatcactgcgaatctgttcttccatgttgtagcggtacagatcgagttctgcgtttaatttctgttctaatgcctgtgcaaatacatgttcaatattcatttcgtatagcctatttcagatttaaggttttcgagggtggagtgataaacaacactcccttcgtgtcgagtataccatacttttccgttctggttacactcattcattacattttcatctaaaccagggatcggcttcatgctgggagaaaacgcgatagacatcatttgttctgcgctatcagcaaacccacaagggaaaacagatccagttggtttatcaagatacatcaactctactttagccatagatttcttcgaaatcctcacaatcaggcaaatacgtttcacagaaggtgcaaagcgtaaagaatgcaggttgacgaataccaggattatccggtagatacatccagaaggtgttagcaaacacgatgaatgttttcaggttttcggtggtaatttcgctaacaccatcatacccggattgattgatcgcgcgttgcagtggcacctcgtactgttcgcaatagtcggcataatgatcgcttgttacaaggccattagccattttaatcaaatcgacgattttcatgattttacatattccactttaacaggttttgcaacaaatttatctttggtgcgcccatgaccattacacaggtcacattctttgttgaaatctttcatatcttcgacccatccagaatctggcaacccagacggatatgcgttataacgaatggtttcataaccttttccgttgcatttcgggcaaacatgaggacgttcttttttagcagactctgccagttcgcgaagggtggtagaactaccataagcccgacacatgttttcaaagtcttttaaagtcattctataaacatcaatgacgttatattttttgccggatggtttagccataatatatttctcacttaaagaatttttttgatgaaagagatagcaaggccgataccaaagaaaattaagtaaccttttccgtcaccgtgcgccaaaacatagagtgagctgccgtatgcgatgagttctgcgatgttcattaagtttctcatgatatcctcctttttctatattaagtatcttaccataatataaaccaaagtcaacaacaaagttttatcaacccacttatcaccagtcattagtaatcccctacaggttgagacgccgcaacactcaggatcttgaaagtgcaattgttccactcacaatacgtttttgcacagtgaacacttcctttcataacaaacccgtttgagaaaattaaccagtaaagtttcatgatagcctcctttgtttcgacaaggccaatataacaaagcccctgcacgaatgcaagggcttttttcaatttttcagcatccaaagttgcggaggacaatctttagaagcgattagacgatccaggcgggacataacccgacgataaccgtcgtattcaaaattaatttttggtggaacgtagttgacctggattgtttttctgttagctaaagaaacatactcagggatcaccgttcgtaaccgtatagcgatcactggcttctcttcgccttcgttaaagaacatttgaacagttataggacaagcaaagattttaccatttacccgacgataaacaataacttcctgtgtcccttctgttttggccttcacagcgtaggttagaacataacacgaataatgatttgctagactcatcatgatatcgcgataagtttcaatatcttttttaatcgatactgaacggtctttaaagcgatctgaaatgtggtcagcagtagccgctaccttgattgtataccagtcacctaacgcgctagtaaacgcctcgctaacttcttttcgtacaccgttaacaagatacattaaacgtgttctgttcatataatcctcactgatttttgaagtattcgatctgacgcaaacgcttttcagcggcggctttcgaattgtattcaccaagttcttttgtgcgatcgtgattcaaaacaacccacttatcgccacgctgttcaatgtgttctgtaatatcttttaacgacttatccagatccagtgattcagcctcttcacagataatagtcaaatccacgggcagtgtcaacaaccttttcactccgctgatatcatcaagcatcgaatcgtatgcaagggttacgtgcggcttgtaatccggataatcgtatgttgcgccagcatcaatagaatctttgaaacggctatgcaggtattcagattccaggatccctacaatagtgctaccgtattttgtgtcccacttttcaacatcaaccagtttagcaggttctgtgatgtcctgttgcgggaacaaatcaaccgttttccggctgtatacgatcgttgtatgcatcttttcggctgaaacagcattctttgtgatacctaatgtcttttgaacatttttcaaagcctcacatgaagcctgatcgaatttagcacacatgtagataccaggatctacaacaggttttgtgatttcaagaaatgatttcataaaacaccccaataaaaaaggggccgtagcccctttgtaataaatttgtttttacgcttcttcgccaaaggcggcttcatcttccgcgactttttcgacttcaacggaagggatcagagcggataccgcgccaattaccgcttctggggttactggctggcttgcgtcaatacccagtaccgaacacaggtcggacagaagttgacgatgaacagagagttcactttctttttgcgcgataacttcgttcagatcgaatgcgcggcctttcagtaccagtacttcattttgcagtttttgaatatcagacattttattacccattgttaaaatttaaaagtatcgagcactttgctctttagttgtttcaaagtaccttcgttagtgatgatactatctccaggttgaggtgtcaaacctttttccgtggaatgttcatcaacaattccggtatcctttacaataaacacaaacttagcacctaagcgttttaggtatttgtattcgtgttcttgacgacagtcagtgaccagaagatggttgtattcgtcaccagtatatttattgacgaatctttccaacgtgtaacgaacccaaaccgtgttatcatacttgcatacgatatcagttccaaacacttgcatcaagcgtctgatactccagggagtatcgttactcataatcaggttatcaatatcatcaggactataaacaatattgtatccacgttctttgaggatttcaagcccgattttgaaaatatttagaacatcttcattagacatcacaagaggtttctctcgatcgcctttgtaaaaaatagcatccggatcagaatattgtccttcaatcatattgcgaatgtatggtttatcgtaaccatatcgctgcattgctattcttagcgttcttttgataccaaatgccagtgcttcacactgaacatcattgtacgcctcttgaataaatttagcaaccgtatctttaccagttcgcttttttccactaatcacataaatcattagctcattctcttttgagaagtgactacttttccgtcaatttcaacttccatatgaaggaagccaaaagttgccatacacgtaaccgcttcatcactatcgttagtataacccaattcaacctcacccaagtttgttgggaaggcaccataaaatctaaatgtggcgatcgttttcatctgggagttatccaggatatgcacagcgaatgattgcttaggatcatcccacgcaacagagttaaactcattgtaatcgtttgtgctcaacatccatatgtaaatcccaagatacgatctcatttcctcatcgactacaaagcggatcatcaaaggatcaaactcaaaagccgaaccaggtactttacctcgaaccatcatatttgcaggaatatcaactgctgggaggttcattgatggtagtgtaaccccttgaacttgtaaagtcaaacctttcatgtaactgttatcaggaatatcaacccgaaagtttgtaggtgagatttggtttaaaatcatttctgtagacataggatctcctttcctctatttagcggggaacgggatcaaagcggcctgacggggtaatataaaaatttgaagaaaatgcttgaccttttaaaatctttgatctataataattattaattaaaattttatcaaaaagatctaacaagatcaagtaaaatttaataaataatttatcaaaaaattttagatctgatcttgaattcataaattttatgatctataatatattaatattttattttatcataaatttttatgaagatcaatacttagatctaataaattttatgctttttctgaaaacttttcctttaccccgtcactaaatactggtactatgttcccatattggaaatcaggaaaaacaaaatgactcacttgaaaaaattcaaagaatttctgaccgaaggtaaaaccctcgctcgtaccgtagcacgtggtcaacgcgctaaaacttccgataaacattcaatcggttttcttcacttcaaacatggttctgatttcgaagttttagcaccggattctcacgatctggcatacttcggtaaaaacattgtacgtttgaaaggtatgactactggtaaagttcaagcggcttatgtcgattgggctaaaggtactgtttctttctacagtggcaatccggatgatgatctggatttcgacaaaccagaaaaattcaaagctgctactctgtatgaagaggcggaagaaaatctggatctgtataaccagttagcagaagatttcgaaatcgagatccctatggatgaagctctggtgaaaggtaaagtttacaaactcccaagcaacgatatgcgtcttctgtacactgggcgttctaaaactaaagcaagcggtgaatatgcagtgtttaccgtagtcgatgcttccggcaaacctcgcctggtatctggtaaaaaattcacccaggaatataaaggcgatatggtttctaaactagttctggttgaatccgaagatctgaatgaagcggctaaaggcattcgcgaaaaagttattgctgtgatggtgaaacgcgggtttaacgaaaaagatgcagaaaagatggttgacaaaaacctgaaagatgctatgaaagttagacctggtgcgacccctggcaaacttgcagaaatagttagcatcctgtaaaaataaagccccttcctttcggttggggctttttgattagtatttgctccagacttttttcgcgccgtaaggtttccctttggacataaattgctgagtcggtagccaaacagctttcgcccaatctttaggggcaatctctgctaatggtgatttgaggtgtgatggtagatatgctttgatcatttctgttgcgcctcgcatacctttcacgttaccccagttaattttgagtacagtcttgttagagaggcgtttagtggatccgtaccctcgcttcaataactcttctaaaaactcctgtcgtgctctgggtggcgcatagtgcaagttcaaaccatagaacactaagttacccgctttcgatcttccggatcctaagaaaatgatcagtggaaatctatcccaatacggcagggtgtctttatattttgcatcatatgcaaacgtgtacaggcgacccgttgctggttttgccacacggtgtgttttgatactggttttgatgaaattaccaaaccattctgttgaatctttctgtcgctttgccgctgatacaccaacagtgatctttttcagactattacggaaatcgttgatgatctcgatcccgtgttttttacggtagtcattacgttttttacgggcttctgtctctgcggaacgtcgttcaatctcatcatcaatctgttttttgtaacgatgcattgactttgtgaacgttgcgtagtttaatccctcagaatcggcaaaacgtttagcagaaacacctttcgttcttgccttacggaatttgatccccagttcaacccaatcactcaatttgcgtttgggtggtgctttgggtttatcctcttccgcgatgatctcaaactcaaaaataaaactcatgtttccctccagggattactgacctcgccacccaaaaacttttttgagtgattcttctgttacgattttgaactgccagcctttttgacggcatagctcatttgcggctttccacttatcaatattaactgtataggtgtaaagagcatcaataaatttctttttattgtgtacgttgttgtttactggcttcggtggaggcatggtttctttaaggggcttaacctcccaaagatatgtagtaccattttccatttccacatagaaatccatgtaatagcgtcttctcttaccgtctgcattgcagaaatacgggatcactatacattcagaattccaacgttttacgtgtgggtttttatccagccacttcataacgtagcgctcccacgatgacctatacgtaatctttcgcggatcgcctttatacttctgtatgttttcgggtacaaacgaccctttatacgtctgtcttccagccattgcgtaaatcctaaatagaataatataacgtttagataggggaacttatcgtgctattttcatacttcccgcctgttgattacaaaggcacccagacaactgatattttccgagactatcgattttattttaatcgtgtgattggaaaatataaaacccgtagttaccagataacaggcacactacgacctgaacaacttgcagaatcattatatggaaaccagcaatactactggatcctgttgatgcttaactctgtttatgaccctttctatggttggatctccgatcaggaagccgcgtatcagtgcgctatacagcgttattctgaggttggcggtgaacaggttctgtatcacgtagatgaaaacaacaacaagtattataaccttgtcgaagaccccaataaccctggtcattggtatgacaaaggtgacaaaccaatgctgtatttacagtatcaaggtgtattagctcctgtagatatttatgaagatgcagtgttgcaaaatgaagcaaaacgaacaataaaaatcattagtccgtctgacatccaggcgtttctgaatgattttattaaagaaatggaaaaggctaactcatgaaattaggcggaaatttacactcacctttctttgatggggtggttgaaaacgttgatgatccgcgcgggttgggccgtgttcaagtccgtgtatttggacaacacccagcccaaaaacaaaaatccgatgcaatcggtgttcctgttgaagatttaccctggatgatgcctattcaggatattagaagcgctgcgatctctggtgtgggcttctctccaactggtatcactcgcggatcctttgttgttggttattggcgtgacaaatggcaccaagatggtatgataatcggtactgtcgctggtgaatatgtcgaacaaccagacacacagaaaggtttttgcgatcctatgggtgaataccctcgctatgttggtaacgatgttaactcccttgcattaggtggtttgaaaggcaaaggatcatcaagtgtcatcattcgtgattcaaacacaagcatagcagtaaacccagacgatcgcccactggatgagataccagaagataaccgccctgatacgggtggatttacgatcgaaaagatgctcaagcaggatgaggggatccgtacacgctggtatacagacagtgaaggatatccgacaatcgggatcgggcatttgcttatccgcgaaaagactcgcgacactgcaaaaattaacgctgcgatcagtaaagcggtaggtcgagaagtaacaaacgggacaatcacggcagaagaggtatcaaccttatttgctcaagatttagccaaagtaagatctgatattcagagaaccactaacgtccgtgaagtgtatgtgaacctaaaccgtcctcgtcaaatggcgatcgaaaacatgtcgtttcaaatgggcgtcggcggtgttgctaaattcaccaataccctaaaagcgatgaaaaatgaagattggcaagcggcttataatggtcttcgaaattcactgtgggctagtcaaactccaggccgttcttctcgcgtgtctaaaatcgtcctcacgggcaaccttgaatcatatggggtgcaagtaccagatccggaagggcgctctctgagtgctgcttacgctgcgtataacggtgctacattgtcggctactagtccggaagatccgtttactcctggtgatacccgtgtgatgtttgaagaaccagcatcatcttataatgcggaatatccgtataacatggtgtttgaatcgagatccggacacattcaggaattcgatgataccccaggatacgaacgatataaccgtgttcacccagcagggagttacgaagaaattcgcccggatggaacccgcgttgttaaaatcgtaggggatgattatcagatcgtgatgcagggacggaaactcaacgttaaaggcaacttacaggtagttattgaaggcgatgcgttcatttacaacatgggtaacgttcaacaaacggttgatggtaacgtaactgaatttgttcgtggaaacgttcaacaaacggttgaaggtgagtacgttggcctgattaaaggcaatgctgaactaactgtaaacaaagatgcaacagttaacgttgatcagaatcttaccgcaaatgtgaaacagaatgcaaccgttgctgtaacagaagacgcaacggtcactgcaaaaaatgcgaaaattgagattgaagaaacgatggatatcggtgctaaagatatcaatatcaaagcaacgaataacacgtttattgattctggcgcattaacaaaaatcactggcggcacagtacaggtaggctaacatgattatggattatgaatcaataattgatggaattatgcaaaattatcagcatccttgtgatgctgagatccccgctggctattatcggcgggttatctggcaagggcatacagaaaattatccggctgttggggttgagtgggataccgagataatcaaaatcggtactcatctttatactcaagaaccattcggacatagaagcacggatctacctgttgtcaattcaccaggaacagatccaaataccggacaatcaacagggatccttgttccgaagattggctattatttcaacactcaagcagaaattgatgcttacattacatctattggtgcaactaaaatcaatggtggtaatgattggtatggcgcggatctgtcaaaatcaaacctatacaaaaaccctggcgaactggctatgtataaggtcgaaaacagtggtgggtatctttccggaacaaaccctgtatgtgatgctcgcatacgtcagacgtataatcaggacactggcgcattcaccaatattgattattattggaatggtaatcgtatagcctatatgaagcatgatgaaacaggggcgcatcaatgcaaatatacgggtatgcaggttaacaccaacgcagatacaagcattcctcctgttcctcctgcaatgccttccacttatggggcattaccgagtgaattaagccgtgctgatatttcgtgcattccggcaactgttggtttcgcatatacaaatatcagtgatgctatgttacaggcatggaacgaaacccgtaatacgttcaagctacagtttaacatgttaacgggtgctgtacagaatggattcgggatcgcgacaatgtttgatggtttatccgtatcgatggaagaagtaatggcgggggcgctcgcattgtcacagcaagcatggcaaactgctatgaaagttttcagacaagtgattagcgctgcatttaacattatcggtggtgcatggggattgattaatcagttcttgcctcaagtaaccatcttaggtgttgcgatcaacatttacgatctggtgtttggtgataattctgttcagactttgaaagatgcgtttaatgcaatcatcaaatccggacaacaaacatatgaaaccgtcataaacgcaatatacggggccataggaagcgcatacaattactctgtggaatatgtcaaagctggcgctcgcgaccttgtggatgcttgtagcgcgttatttgattggtgtttaacgatgttccaaaacggttgcgttgcattaatcgacttatacggtcggatcatgcaaacatgggctatccctccggaagtcccaaacccgttatggtctgcggtgctggctatccgtaacatcatgatgcaaatcaaaccacttgatataattctgggcggtaacttccctggattcactgcaatggatttgtatcaacaagcacaggaaaaagtcaaggcttttgttgatgagtcatacgaacagatccgagggctttatgaacaggggcaggaactttacaaaacgttaaaaagtcagattttcgaacgtgatgcaattcagagaaaattcaaccagtacttaaactggatgtggggcgctgtaacagacgaagcaacagcggcttatcaatctgcattggatgctgcaaacgctgctgtagctgcaacacaggccgcgtatgacgctatacaggaacagattggatctctacaagacgcaatgaaagatacatacagcatggcgatggaagaattaaagaaattgcctttgatgagtacaataaacgagtttttaggcttctgtggtgtcgcatttgacgatcttctcaagtcatatgaaaatgcgattactggtgctcagtctctgtacaaaaatttcattgatagttcgcgctcgtttaaagatcactgcaaagtaatctataaccaaatttgtacgttggcgttgagtaaagtcacacaatatgtgaataaattgctgtctctcataggattagcaatcaacttcggttcgattagtgtatgtgttccagtactgaaatactaaatagtcgaatgatcaagaggaatttataataatggctactgctaagactaagactgtcaaaaaacagattaaccaaatccccgatatctttatcgggggtactttcgaagaaattaaaacagatctgattgattggctgggtggacaagaagagtttaaggattacgatttttccggctcgcgaatgaacgtactgatcgaccttctgtcgtatgctactctttatattcagcagatgggtaacacagctctatttgaatcgtttattcgcacggctgcattgcgtagttctgttgtacagtctgctcaagaactgggatatatgccagattcgcgcacggctgcaagtacagcagttatgattacggctgctaacccactgaccccaacatcgatccgtatcccgcgcggtacaaaattcatcggtactgtaaagaatacagacagttattcttttgttgtatcagatgacgttgttatcgttcgtgatagtaataacaactatacatcaatgctgaacctggtgcaaggccgtttagttcgtactgaactaatttatgacggttcgagtatcctgatccgagatccaaacattgaccgtagtcaggtacgtttaactgtaaacggcgcacaatgggacgactggacaaacgaaagcattgtaaacgcaacaggcgcaagcacgatttactacatgcgtgaaactgttgatggacataccgaagtttatttcggtgaaggtgaagcaagtcaacaagtggcgggtggcgcactaaccgccgaatatatcgggggcttgaaacctgctaatggttcgactatcgttattgaatatctgtcaaccgatggggaagcggctaacggtgcaaaagattttatctatgtcgatacattaaccaatattagcatcacggcgattaaagagaacccaaccaacacccctgattatgtcggtgctgatggtggtggtgacccggaagatatcgagcgtattcgagaactagcccctgttatgcgtgaaacacaacgccgttgtgtaactgcatcggattatgaatccttcctgtctcacaggtttggatctatcatccaggcggtacagtgctttactgataacgaaaaacctggttatgctttcatttctgttaaaccaaagtcaggtttacgcctaacatcggtacagaaagaagatatgcaaacgtatctttcgaaatataacctcgcgacgatcaccccgtcgattatggatcctaactatctgtatattgtgcaatctgtaaaagtaacgtatgatatcagtaagttgacggaatcagaggaatggttacgcggtcaggttatttcgtcgatcgactcttactatactgacaacgttgaaattttcaacaaatcgttcagtgtatctaagatgttgacttatgtcgatcagtctgatacttctattatcggttcggaagcagatattaaattgctccgtgaaattgacaactattacagtgctcctatgtctgggatccatttcttgaaccaggtggaatcgaaatcaatcatttccagtacgttcaagttcaccaacgaagaagacgaaagttatgttgttcgttatgcttctacggaaatggatcaggatggtaacgcaaaaattgtaataggcccgttcaaggatggggatatttcgatcgctgcttatacaggtgatgactttgaaaaattaacagatgcaggaacccgtaataaatattacgaagtaggatcggtgtctcattataccgatttcattagctttgatctgggcgttctgaacgtatccgccgatagtttcagtgctgcttatatcgagctaaccgcaaagcctctcgaagaaaccatttttactcgcgatggatcgttgatcgtgtttgaaaatgacctacgtcctcaatacaccacattgactatgaatcctatcagtcaataatcgttaacccctgtcttcggataggggtttttctttttataaatacgtgatatacataaccgcaaatttggagaaatataatgattaaagcgccttcgattacgagtttgcgcgttgataagctggctgctaacttcgtttaccttaaatgggatgatgttggcatggatttctattatgtggttgaattggcccgtagccgtgatatggacggaactattattccagacgaagagttaatctggacgcagttgggttatagctacgaaaacgaatggtttagcgatcaggttgccccaaatacacgttataaattccgtattcaaacaactcatgaagggtttgaaccttctgattgggtgatcagcgatgaattatggacgtttgatgagaacgcctacgcatatacaaccatgcgtgaattcacccctgctgattcgtttatcaatgaaaaattcgccaaaaacaatcgtgattacgtcgattttaacgatgatgttattatggcttctctgatggttgaggattttgtatactctcccctgtattctgatgtaagccagatcagcgataagatcctgaaacaagaaagctaccatgaaattcaagatcacatcgaacacgtttgtaatgatatagatcgcacgttcctggtatactcaaacggattgctttacctgtttgaacgttttcagaatatggctaaagtgtcaaatgacaaaggccaaacgtggtattactacaaagcattaaacgatcgtgtaggcaatccggtttcccgtaccgttgcttatcagagcgctaacactacgtatgtgttaggatacgatcgcatattttacgggcgcacgtcaacagatattcgttggtcttctgatgaagttcgtttttcttctgatgatgtaacgtttgcgaagctggggaaccagtcagggttagattttgatgttgattcatacaacacatatgcgcgtctaccgggaggagtgtcgaagtatgccgaagctatagcttgttctaatgaatggctctacgtggctgctaagaacgttatgcgccgtattgcgttacgtaacacaccaattgatactgatcctggttcgccgacctttggtgaacgtatttttgatgaagtttcatataccatcgtaccaggaaatgataaaattgttgttaaaaaaatggacgtgctgaatgaccgtctatacgttctggtaactggtgaagttaaaacggcgatgatggatccgactgtcaaagctaacgtgatcccatcaaacgatgctggcgtttatctgtgggatgagaatgcaaagacgtttacccgtgtttatggtaaaaccgaagatgaacgtttttatatcactcatgaatataccaatatgtcaaccaatggcgatgaagtttacatttctgttggtaactacaaatatccaggcactttgccagatccagatctggttgaaaagtatccggaagatgtgcattcagcggtgaaatacgatcttgttcctggttatactgcgagcatttcgattaactttgctacagttcgtgcaaatcagaacgatcctacagtatggaactttgggccgcaagagtactacaatgaagcaaactttagctggcatttccgcgataaggttagcacatggatcaccaatgataaccgtcctctggtggtttatccggaaaccctgtatactctggttactgatagcgcgtctcctgcgtcaacgattcgtgtaaaccatgaagtttgggacaaaggaacagttactatctacttgaataatatcaagtttactggttttacgaagtacacaaacggtgttctgttgtatcgctcaggtggtaggataattggattctatgaactgtcataccgcgcaagggatgaactcactattttctggaaacccgataacactttaatggtggcaagtctggttaatcaggaacgtgaaaacccatatacgccggatattgaacctggattaatcgaccctgatctgagtcacatgatcactcgttttgctccgcaaagctatctggacaaccaacagttcgaaaaatttggtgaatactatctgcaatacatttcgttgggaagcaacagttactataacaaattgctgaacctcatccggaacaagtatccgagagagaaaaacaacgttgaatatttgtggtctgaaatcaaccgccgtaacatttacctggataaaaccaaacgtgaggcagtggttagatttttcgaatcacgtgcaagtgatttctattcaacaaaagggatcgaagcaagttatacgttcctgtttaaattgctgtataacgaagatgtttccgttgagatcgaaagctccaacagtctcgaatatgatattttggttagttcaacaaatatcagtcaggatatcgtaggccggacgatctatacaccaactggacgcgctaacgttacatacatcgaacgtgactatgaaaatggtcaattgcgttggtcaatgactctgcataatgctcaaggtaactttatcgaagggcaggttgtcaagtcagaaaaaaccaatttcaccggaatggtaattcgtggtgttcgcggtaaacaaatggctaacaactcgatcgactatatcaaccgtggacgatcttactatgtgatgaaaattcgttcaaatctaccgacttcccgttataaggatgacgtattgaggtttgttcatccggtaggattcggctttatgggtattacgatgttaacagtattcatcaactctggtttgtcaatgactcataacgagacaatcattgatattctgagaaactaccgcttcgatagtggttatcctaagttctggcctgatcgcattgcgagtatggacggtaacggaaaccaacaattcgacctggttactggtgaacctctgtacaccgtacacccgcgagcgggggaaccttttgatgtacctccggaatatgacattgaagaaaaaccgcttaacggtgttcttccttctgcgcgacggttcgatcaaagtccgttgttcgattgctcaggcgttaaatattcacagttccgtaatttggtggataaacgactgaaagatgatgcaggaaacccacgtgatccaaatcctccatcacagattaaggtaggaaattaaatggcacaacaaaacttgtatcggtcggtaattactgcaaaattccgaaccgaaaacttgatgaacttcaaagatatgatcggcgatgccgccgatctaaacacgatttacatgtctattggacgaactgaatcgtggtcggataacgaatccgaccctaacttcgccccgccatatccaaatgatagcaccgatggtgttagtgatatgtggacgcatatgatcggggctactaaagttcctggtgatatgatagatgcaattttaccacgtaaagactggggtgatactcgttatccaaacccgaaaatcttttactttaacgatattgttgttgtaaacaccgcaccttataaccgtactgatccgggtaaaggttggatggtttatcgtgtggttgatgttcctgatatcggttcttgctccatttcgagcattaccggaaaacttgaatgtatcaggatcggcggtatctggagtccgtctcatgaatctagtgaacctccacgcggagaagctaacgggatcgacatgggagacggttataaatgggaatacctctacacaatcccgccagatgtcgtgatcaaccgctgtacaaatgaacatatcgtagttcctttccctggcgaactggaagaggatccggtacgttggggttatgataacgtgattcaatggtatccaggacaatacgatctagtgtatcggttgaaggtgaattcaatgcgttttcgtgcatacatggattctcttttcttcccgcaatctacgcttcctggtaacaaagggttccgtcagataagtattattgtaaacccgttgattaaaaaggcaagcccgaccgagcctgaaaagaaagcaactggtgattactataatgctaacgcgcttgaacctgattccggacgtatgatttacatggaaaacagacaacctattattcgctcccttgatcagactgaggaagtgagtattgtattcgaattctaaggaaaaacaatggcttaccaaacagcaaaaaaactaattgatgtcggtgaaatcggcaacccatcaacaggcgacccgctttatgatggtggtgttaaactgaacgaaatgatcaccaacgtttataatgcgtttggtgatgtgcgtatgctgtctgcaaacgaaggtgtcggtaacatggtgatccatgctaccggatactatcagaaactaccacgcacttactattcaagcacaccgatcgaactgggttccctgcatgacatagatacttcaacaggttcgattaccgttgttcttccttctggtaaggttggcgaaggttgctacttcataaatagtacgggtagtgtctctgttgatcgtcctatcgcgtttcgtcctcaagttggggatactatcgcgggggttgcagaccagttgtatatcacgtcaccttacacctttgtaaaaatctggtgtaccaaaaaagaaggtgcggtaacaaaatgggattattctgtagaatctatgttcggttctaaaacgatgcctgttgacactacggcgcttgtactgaaagcaaacccgactgctattcctatgttcggatatagcgaatttagcggggctaaggtgcttgtatacgcagaaaacttagctggtacagttaccaaaatggcagaagttttaatgaccgtggatcgtgtacacaaaacgatttattcaacggaatacgctattttgaaaaacagtgaagatgaaatgtttacattaaactttactgtcggtgctggtgatgtcgtatacgctaacgtgcaagcgatcaaagaagatcgaattaaattcacgattaaagcaatagatacgattaaatcagggatcgcgtcatgaaacaagaaattttaataggtcagattgtagacgatggtacaggcgattacctgcgtcgaggtggtcaaaagactaacaacaactttacagaattgtataacatgctgggggatggtgagatcccccatccagcaggtgcctggaaaacttttgcgggtacgacgctatcaccaaaatttggtgaatcatgggcgttgaataccagtgcaaacaaaatcaccgtaaacctcccgaaaggcggcgtaggcgattataacaaggttattcgtctgcgtgatgtgtggtcgcgttgggctaccaacaacgttagactgatccccgcaactggtgatactatcaaaggttccccaactcctaaagatctgtttaaagattttatggatgtggaattggtgtattgttctccgggccgttgggaatacgtcgaaaacaaacagattgacaaaatcacaacttcggatctggcaacagtagcaaaagaaacgtatattgctactcagggacaaactgacttccctaacgtattcggtgttggtaatgaatacaacctgcaatcgttcgaagtttactatcgcggtaacttgctgttcatcgatgagaaagacggattcaatgctgataactcagactatggatcgattggctctgctcctggtgaactggttgcacttgatggtaattcagtacgtcttaaaaacccgtgtaacgctggtgacacgcttcaatttgttacctatctagatgggttagcaacatggcgttcgagctatgaagcgtatgtgatgcgcatgtatcagactggtgatacttctctggaaaccgttcctggtgaacagtgggtaggtgatctggcaaccaaaaaagagtttacacctgctgaatttggtgttaaccctcgcgtgttgattaaccctaactcgtttgaactgcttctcaacggtaaacaactggttaaaggcggtgacgctgactatccggcgttttcctgtgaaggtgcggaaggtgttgatgaaagtacgtgtgttggtaactctggtgtatgggttccgtcaggacaggattatagtttagtattcactgattctgtagtgacttcaatcaagtttgctcaggaactggaatccggcgacgttgtaacgatccgttggtttaacaatgatattggtactctgatggattgggaaggaactggcggtattaaagaaaaagctgataaggtttatctcaataacgaagaagaagttatattgacgaaccgtatcgaatataccgattataataacccttctcagaaaacaatgcgtaatacaggggaaacctatcaggggcgtattctggatattcaggctatgtttgatattatccacccgatcggaaccatctatgaaaacgcacacaacccggcaaacccttccgattatatgggatttggtggttggaaacgttacgcagaaggttatttcctggctggctggacatcaaatgcaacggatcctgatttcgcattaaacaataatgatttagatagtggtggtcaaccgagtcatacggcaggtggtactggtggcgatcgtggtacagaaatcaaaatcatcaacgttcctgaacttgtatcaaaagataaagttcttattgctgatgaaaatggtgctgtgatcattggtggttgtcagttagatcctgatgcttctggccctggatacactaaataccgtgaggatacattgaaagtgaatcatggtaacacattacctgataaaatcaaaactattccaccgtatatgactgcacatcgctggataagggttgcataatggcttacaaaaatatttcaaaaacaagggagggcgctcgcgtcctctctaaagaagcagattacttacagtatgatacttatggtaagttgcctctgatcggcggtaaacgttcgatcggagaaccaaacattgaccaaacaaaacgcggtgttctgtatggaaacgtacaatccgcaattgatgacctgtatacgcttatcgagcaaatcccgattaacggcgttgttaccatgactgaggatgcccctccaatcgctgtacagcaggttgagagcgtttcttttgatggtattgtacagaacatcgattcagaccaagaacaggctgtagttcacgtgtacggctttcctttcatctttgataatgggactaacgccgcaacagtttgtgaaacggcatacaacaaatttactgaattcgttgcagcggaaaaatatttcgcggaagttaaccgcaaaggtgttgatggtacgatccttgaatgtcgatttattgatagtgttccgcacccggcaacaaatatctcagaaaacggtattcgtcaaatcggaactatcgacgtagccgcaaaaagtggctatggttcatgggttaagttgggttctggtttcttacctgatgttactccgcaagtaaccgtgtattacttcaaacgaattgcataaggataacacatgagtaacaatacaatcaaccacgtaagtgataaatccatttacgtgacatttgacccaacaggtactgattggcctgataccataactaacgtacaagatgcgttggaaaaaataggtagttgggcgcgtactgatactgggcttcctatcgcaacaacttctgttcgtggtattgctcagatcgcaaccgaagctgatattgacgctggcacggataacaataagattgttactccgaaactgttagcatatcgtatgcagaaccctaaagcatcacaaactgtatggggttatacgaagtattcgactgatgcggaatctacaaccttaactaacgatgcatcgtctattactccgcgatctctgaactatgtgttcaataaccgtaaaggtacagaatcggtttggggttcttctaaaattgccaccactgcacaggcggttgctggtacagataacactgtaactatgactccgcttaaagtcaagcaagcgatcgcgtccctggttccggttcagtcaagcgcgaccgaaagctcgcaaggtttggtacaactggcaacagttgcacaggttcaggctggtacgatccgtgaagggtatgcaatttcaccttatacgtttattcgtttaactgcaactgaaagcaacctgggcgttattcgtatcgcatcacaggcagaagcaaacgcgggtactgatgacaccaaagcgattactgcgaaaaaattaatcaatacccgtgcaactggatctcagttcggtgttgtcaaattagcaacaactgttggttatgtggcaaacactgcactttcttcaaacgctgcggtattacctagtgatcgaaatgcggtaattaacggttctctttatgagaatagcgcaatatataacaacaaatatcagacatggacagatcttgattggcatttcccagtaggtgctattgtcatgactggttttcagactgaccacggtagtttgtatatttgtgatggtcgctcactgaataaaaataactatccgttactttttgagcgtataggttatacatttggtggtggcggtgattggtttaaccttccagattgtcgaggcgttgcagtacgtggtcatgaccgtgggcgtggactaaaccctaatcgtgggtatggtacatatgaaggcgatatgttgggctggcatgaacacccattacagcttatctaccagaacggcggtaatattcctaaatggcaagcagtttacgaactgaaaagcgccgaaaagaatgaccaaagcgctcgcgtatttgatgcttctataactaaagccactggtgtgggtggggaagaaacccgcatgaaaaacatcgcattaaactacgtaattcgtactcaatagaggttattaaatgatcatcgacaaattaaacccgttgccgaagatcccgtttgttgatggcgtcccagatgacgccacgactcaaacgaagattatttggatcaaaaacggtgaaactctggacggttcgccagataaagtgtcaaacactggtagtcttaaccgaactggtgtaaacatccagcagaacgcggttcagttagaacaaaataccatcacccataatgataaaatcaacgaagtaatcgatcaggttaacttgattactgaaaacattgatgctattggtgatgagagcgtaatcaaaaaagttaaccagttggatcaggatgttcgggcattaactttatctaacacccaaacacagaacaaggtagcacagttaaccctttctgtaaatgctcaaaacgatgaaattggtgaatacgatccagaaaaagatcctaaacaccgcacaattcgtaatgatatcatttacattaagaaagaagttggttcatatcctggatttaacgttgatggtgatgttgacccctcttctactggtactggccttaaataccgcgtactgagtaaccaacgtgctatttctatgcaggaaactcgcataaccaaactggaagatgattgggcgctttccgaagtaggacaactgacagaagaggtaaaagaacttcgtgctgaaatgggtgattctggtcttgccacaacccgatcaatctatgcgcgaatcaagatccttgaggatggttctattgtaatgcaaaatgaacttgatgcgattaatagttatatcggtcgcacgtcaggttcaaccagttccattaacgatcgtgtgaacagtctggaaaactccgttagttctctggctacacaaatcaatgatccggtaactggtatcactgcacaaattgcaaccattaacggtcaaatcggtacggcttctgctcagggtagtatccgttatgatattgcggaaactaaacgcagattgatggatatggaaatgattctgggtgaatccggcgatgatggattgcagggacaagttgcgatcttaactggtgacgttggtgaagattcagatcctaccagtatcaaaggccgtttgagtgttgttgagggtgaattgcgcaccaacactagcgcactctgggaactgcaaggcattgtaggtaactcttctagtggcctcgttgcaactagccagcagattaacaaagaaatctatggtgatggtgttagttccgatcctgttactcgcgctggtttgaaaaagacaacccgcaacctgttcactcaggtaggcgataacgcagaaggtaacgaaactggcatttatgcactgattgccgaccttaataaacgtgttgaggatttagaagcgttgaacattgcacaggcacttgcagatcgcgtaactatcgaagatctgaatgctaaactggctctgtacatcaaagaagctgacgctgatctccgttatgagagcaaaaacccgcctctgtcattcggtactaacctaactggtgatactgaatatactactggcgatccattgtctctaagcgtaactatgactggtggtgtttctccgctgtcttatcagtggacgaagaacggcgtaaatgttggtactaatgctaacacatttaccattgattcgctacagccttctgattccggaacctacaaagtaacggtaactgatgcaagccataaagtcatcgtttctgatgaactggcgatcactgtcgcttaacgattaacaaggggcttcggccccttttgaggatctttatgattacgaacaacccagcacaattaaaagatgaaattctgcgccgcttaggtgctccgatcgtcaaaatcgaagtgacaacagatcaggtttatgactgcattcaacgagcattagacctatatgcagaatatcattacaatggatctaacaaagggtatatcattcttaccctggggccggataacccgaaaaatattttcgatctgagtaaagaacatattttcgcaattactaaagtgttgcgtactaacatgggttcccttgtatcgatggatggtactgcggtttatccgtggtttactgatttcctgatgggccttactggtggttctctgggcggtggtggttgtgcatcacgtacctacggaatgaacgcatacggcgcggatatgggctattttacccagatgatgagctatcagcggtcaatgcaagatctcctgtctccgcttccggattactggtataacgacgacacaggacagtttgcagtatacggaaccgttaaagatggtgatattgttgttatcgaagcaatgatcagatcctttgttgatgtacccagtatggtcggtaacgtctctggatacgctacagcgggttctgatggcgaagataagccaactatagcagatatatacaataacccctacaaagctgtctcaggcggtgtgaaggctggtcaaggtacaagcgttcagggttcatcctctgcgtataacaaccgttgggtgaaagattacgcaactgctcttgttaaagaggtaaatggtcaggttctggctaagtttcagggtatgcaattgcctggtggtgttgctccggatggaacccgactgatacaggaagctatgcaagaaaaagaaaacctccgtcaagaacttctgttactgtctgatgcacttccagtgttgatgatgtaaggaggaaaaatgcactatagattgtatcttgttgtttttgaaacttctactggattaaaaatttatggggggaagcgtcattccccttatgataatccacataatgacccatatacaggatcagggacatatataaaaagagctattaaaaagtatagccattcttgtattaaatgcattcgatggtctaaagaatttcccaacagagaattactagcagaagcagaagaattattagttgatgagataatggattattattccagttgtgctaatctagtacggggaggaaaaggcggagtttctttttatgatccatcaaaaaacccaaatataggttcaaaacgaagtaaagaatctagagataaaatgtctatgattgccaaaaatagaaaatatagcgaaattggccttaaaaatagacaagaagccacccgtataatgacaagaaatagaaaacaccatgatgtttctggtgataaaaatcccgctgcaagaaaagttatcgttgatggcgttgaatacccaacattgaaagaatgcggagaccactacggcataacaaaaaattctgtatttcacagaataaactctaagaaatgggagggatggaactatgcgtgattgggatgaaaacttatttgcacaactggaatctggggaaggtgtagacaataacctaaaaacagaagttactaataagtatgttaactggtacaagtataaccctactcaacagttacatgattcactaacagccgaagcaattcaaatgaaatctccggatatgtattacgtccgtcgagaatttgttaatattgataaaattttgggtgaagaccgtgaatcgaagtttacaaaatcgtggaaaattgcagcatacatcgattcgtatgcaaactacgaagggcagagagatttttacagtaaattcggtatgatgtcaaacgatgaaatgacacttgtgatcaatcctcgtttatttgcacatcaaactgatggcgggatccctgttctgggagatttgatttatttccctatggataacagcctgtttgaaattacatggattgagtttgacccgttcttccagttcggcgatcgtcctcaacgtaaaatcaacctcgttaaatttatctatactggtgaagaattggatcctaaactgcaacgaaatgaagggattaacctttcccccgatgccgatctggatctcgaacctattcgaaatcttgatgggttggcggataccaatattgaacaatacgaagaagatcaagcctttgaagatgaaggcgatgaattcattgaatcgtttgatgttgttaacgggcgcggatcaccgttcgcacagttcccataaatataaccaggggaaaccctatacatgtagggtataggagaaatcttatacccgctttaacccatacaggaaaaataaaatgtttggattttggtataatagttcgctgcgaaattatattgtcttgatgggttgtcttttcaatcacgtgcaagttaaacgcgttcgcggcgaacaagaaaaatttatcaaggttccgattacctacgcatcaaaagaaaaattcctggcatccatgaacaagctgaactatgcatacagtcaggaaaatgttgctaaaacggaaacaattttaccgcgtatgaatctatccctcgttgatttgcagtataacgcaattcgtaaaactgggatcgcggtaaaccaaaaaatgacgcagttacgcgcacctggaaaaacagtaacgcagtttaaccctgctccgtatcgtctcatgttcgaactgggagtgtatacccgttacgaagatgatgtgtttcagatcatagaacagatactgccatacttccagccgcatttcaactgtcgtattacagaattacataaaaacgacattaaaatagaccgagatattaaaatatctctgcaatctgtttcccctgataccacgtttgaaggtgatacaacgacacggcgacacattgaatggtctttaatgtttgaattacagggctacctgtatccgcctgttaacgagattaaaggcgagatcagaacagtatacacggatttcttttccaatatgaacccgttggacaaagacaattttgaatccgttgatgctcaggtggatccggttgatatgcctatacaggattacacgggagaagaatacgttcaaacgtatgctaatgatatcccaattcctagcggtgatcaacctcctaaaccgaggggccaataatggaagaatttagcgtaaaacaactacttgatcttgaaaatctccctggtgctgaaactggggaagaaatggttgtatatgaaaaactcgaactcgttgatgtcgagtcacacccagcagatcgaaaaccggatttagaggaagactatgcacttgcgcgtaaaaccgcgcattacatgaatcagatgatcatggatatggcacaaattgccttgcataacgctaaaaactctgaatctccgagacacgttgaagtttttacaaccctgatgaatcagttaaacaattctaaccagggattgatgaaaattcataaagaaatgcgagaaattaccgaagaaacaacaaaaccaggatctgaaaaaggtaatggcggcggtaatgaaatgaacatagagaatgcaactgtatttgttggttcccctacggaattaatgcagaaatatggtagtgcatacgaaccaaaagaaggcttcattaatggtgaagcggtagaggtaaaccctgatggaaatggaaccgacgatcgatccgagtaaggaatcagatcacccaatcggattaatgcatcccgattatctgaaaaagaaaattgatgaatttgggatggagtggacgcaaagcgaacatgataaaaaatggtatccgacaaagtttagtgattacctaaaaattaacggtatccataaagttgatattcaagcaaaagacagttcaaactttgcgacgtataaaaacaaaggaaacaagaaaactcgatataacggaaacccaaacctgaaacgcgcgtacatccaaacgaaatggacgcaacagatgttgatggagtgggttaaatgtcgtgatgatattgtttattttgctgaaacatattgcgcgatcacccacattgactatggtacaattaaggttcagttgcgtgactatcagcgcgaaatgctgatcgaaatgcataaaaaccgtatggttgcctgtaacctgtctcgccagttgggtaaaacaaccgttgttgctatcttccttgcacactttgtgtgtttcaacgaggataaatatgttggcgttttggctcataaagcctctatgtctgcggaagttctggatcgtacaaaacaggcgattgaacttctccccgatttcttgcaacctggtatcgttgaatggaacaaaggttctattgaacttgataacaaatgtaaaattggtgcgtttgcatcttctcccgatgcggtgcgtggtaactccttcgcaatgatctacattgacgaatgtgcgtttattccaaactttattgatgcgtggttagcgattcagccagtaatttcttctggtcgtaaatcgaaaatccttatcacaacgacacctaacgggcttaaccacttctatgatatctggaacgctgctatagaaggaaaatccggcttcgtaccatacacggcgatctggacatcggttaaagagcgtttgtatacagacggtgatgatggcgtatttgatgacggctattcatggtcttcgaagatgatcgccagttcaagtaaagaagcatttttacaggaacattgtgctgaattcatgggaaccaacggaaccctgatcgctggctggaaattgtcaaaactctcatgggttgatactgatgaaacggaaactaatttttatcagtataaagctcctgtagagggacataaatatattgcggtactcgacccagccgaagggcgcggtcaggactatcacgcgatgcatattatagatattacatctatgccgtttgaacaggttgctgtatatcattcaaacaaaacatcgcaccttattttgcctgatgtcctgttacgttatcttatgatgtacaacgaagcatgggtttatatcgagctaaatagcacaggccactcagtggctaaatctttgttttctgagttggattacgataacgttatttgtgatagctataatgatttggggatgaaacaaagtaaacgatcgaaagcgattggatgctcaaccctaaaagacttgatagagaaagataaactcatcataaataacaaaaagacaatacttgaatttcgtactttctcagaaaaaggtgtttcgtgggctgcggaagaaggtttccatgacgatctcgttatggcgctggtttgctttgcatggctaacaacacaaatgaaattcgcagaattttgcgagaaagacgatttgcggttggcaaatgaggtattcgcacgtgagcgcgaactgctttatgaagatatgttatgtcctgttatcgtaacgagtggcgacgaaacaatatctgtcggccaacacggtatttcgtttatataaatttagaggaaacttaataatggctttaatctctccaggcattgaaactaaagaaacatcggtacaatctaccgttgttcgaaattcaactggtcgtgctgctattgttggtaaattttcatgggggccagcttaccagatccgtcagatttctaacgaagtcgaactggtaaactattttggctccccagacaatgacaccgctgattatttcatgaacgctgtaaactttttacagttcggtcaggatctgcgtgttgttcgtgtcgtcgataaagaagccgcaaaaaacgcaaccgcgatctataatcagatcaaaaccacgatcaccgctgctggttctaactatgcagtagacgatcagatcaaagttaaacacaataacgttgttattgaagaagatggtgttgttaccagcgttgatgatcagggtaaagtcctgtctgtgttcattccgagcactaagatcatcgcacacgctaaacaggttggtgtatatccggatctgtctagtggctggactacagaaatcgtttccagttcttctggtgtttctgctacgattacaatcgacggcgtagaagttgatccgggtattactctgctcaaccttgacaccgcaaaagaaactattcaggcaactgctttccagaaactttgcaccaaatacaagctaccgtctgttattgcaatttatcctggcgaaatgggtagcaccgtaacggttgaaattctgtctaaagctgcatacgattcttcggctgtcattaagtcttatccttctggtaagtctggtaaaaacagcggtcgcagttcgatgaactttggccctcagaatgataaccaatacgcgtttatcgttcgccgtggtggtattatccaagaaacgtttatcgtgtcaaccgctaaaggtgataaagatatctacggttcaacgatctacatggatgatttctttgcaaacggtggttcgcagtatctgtatggtacgtccctaaactggcctgtcggattctccggcgttctggaactgggcggcggtacttctgcaaactccactgtaggcgctgatgaactcatggctggttgggatatgttcgcagatcgtgaatctctgcatgttcctctgctgattgctggtgcttgtgctggcgaaactgccgaaatttcgtctactgtacagaaacacgctgtgtctatcggtgaaacccgttcagattgcgttgtattcgtttctccgccgcgttctgctctggttaatatcccactggctcaggccgttgataacctcgtagaatggcgtacaggctacaaaatcggtaatactaccccagttgataacaacatgaacgtaagttcaagttatgcgttcatcgacggtaactataagttccagtatgataaatacaacgatgttaaccgttggatcccgctcgcgggtgatatggctggcctctgtgtttataccgatcaggtatcgcaaccgtggatgtctccggctggctacaaccgtggtcaactgcgtaactgcatcaaactggctatcgaaccgactaacgcgcatcgcgattctatgtaccaggtacagattaacgcggttactggtttctctggtggtgctggatacattctgtacggtgataaaaccgcaacgactgttccaagcccgtttgaccgtatcaacgttcgtcgcttgttcaacatgatcaagaaagacattggcgataacgcaaaatataaactgtttgagaataacgatgatttcactcgttcttccttccgtatggatgcaggacagtatatgtctaacgttcgcgctctgggcggtgtatacgattaccgtgtggtttgtgacactacgaacaacacgccggatgttattgatcgcaatgagtttattgcatcaatctacgtcaaaccagcacgttctatcaactacatcacactgaacttcgtagcaacctcaactggtgcggatttcgatgagttgattggatcaacgtcagtataacatgtaaggggctgaaaagcccctataaatacacatagaggttagaaaatgcttactgatattgtacgcgcctttgaatccggtgatttcgcacgtccgaacctgttcgaagtagagatcccgtacctgggcaaaaactttaaattaaaatgtaaagccgctactatgccagcgtctaccgttgaaaaagttccggtaggttacatgaaccgcaaaattaacgttgctggtgaccgtacctatgatgactggacaatcacggtatataacgacgatgcacacacaacccgtgatgcaatcgtagcatggtcaaacatgctgcatggtatgggtgaagacattacaggggatatccctgcaaactacaaaaaaaccgctacggttaaacaaaaaaaccgtaacgacgaagtaaccgccgaacataccatttatggcctgttcccgaccaacgttggtgaggttactttagactgggatagcaacaacgaagtgagcacttttgagtgtactttcgcgctagactggtgggtttaaacgctataaatacaggggtagcaataccccttatcattatttttcggagttgtaaatgaacttttttggattagacaatgtgttagggtttttcaaaaatttcgccaaacaggatgaaatggaatttgaagcccaattaaaagatgatacaggttcgattgcgcctccgaaaaataacgatggggcgcacgaaatcgaaacggacttatcaaaccagcgttattcttctgtgttccaacagttctattccggacaggatccgcgaattcagaacaaaacacagctaataaatacataccgtggtatcatgacatatccggaagtggaaaacgctgtttctgaaatcattaacgaagcgattgttaatgaacaaggaaaagatattgttacgatggatcttactaaaacgaattttagtaaaaatatccaagataagatcatggaagaactcgataccgtaatgaatattcacgatttcgataaccgaggatctcgtttattccgtgattggtatgttgattcgcgtatctatttccataaaatcatgcacaaaaatgaagctgacggcatcaaagaattgcgccagttagatccccgttgcatggaactgatccgagaatcggttacagaaaccctacccggtggggttaaaattttccgtggctatcgtgaatacttcgtatacaccgcaccgaaaaacggttatagctacaacggacagatttatagtcacaatgacaaggtaaaaattcctcgctctgcgattgtttacgctcatagcggccttgaagattgcgacaacaacattataggctacctgcaccgcgctgtcaagccagctaaccagttgcgtttgctggaagatgctatggtgatttaccgcattacccgtgcgcctgaacgtcgtgtgttctatatcgacgtaggtcagatgggtggccctaaagctacacagtacgtaaataacattgcacagggcttaaaaaaccgtgttgtatatgacgcgagcactggtaaagttaagaatcagcaaaataacctgtcaatgacagaggactattggctgatgcgtcgtgatggtaaagcagttaccgaagtttcaacgcttcccggtggcactgccttctctgatatcgacgatgttaaatggtttaaccgtaagctgtatgaagcgttacgtattccgttaagccgtatgcctcgcgatgatggcggtatccagttgggtaacgatggcggtattacccgcgacgaattgaactttagcaaatttattcgcgaattgcaaattcaattcaaccctgttcttgcggatccgttaaaaactaacttgatcgcgaagaaaatcattacagaagatgaatgggatgaaaacgtaagtaagattgcttttgtatatcagcaagattcttactattccgaaatcaaagatattgagattttggaacgccgtttaaacctgatgggccaacttgaaggggtggtcggcaaatatatctcccataaatacgtaatgaaagaagttctccggatgtctgatgaggaaattcaaagcgaagccaaacagatagaagaagaatcaaaagaagaacgttttaaaaatccagaagcggaagaggaaaacttttgatgaaagaatttatcgaagcaatcaaaagcggtaatctggtggaagctaaaaaaactttttactccatcatggaagaccgcacagaagcgcttcgtcacgaattacgcgttgaacttgccgaagctgtacgcatcgaaggcgaagaagacaaagaaaaagacgacgaaggcgctgataaagatgacgaaaagggcgataaaaagccagccgaggatgataaatccgataaagatgatgagtgaggtgtgtaaatgcaacttgacatcgaaatcaccgccgaagatctccaggaacatttagacgaagcgaaagcccgtgtagatattctgggtatcgatgaaggcacggttaaaatcatcgaaaatttggcggtcaccgaaccaaatttagcccttgctatgatggcggttgttgaaggtttaacacttgatgaggtaattgtcaagcatgttgattcccgtggcaacgtagaacgcctcaaagacaggaaaacccgtgagcgtaatgcgtatcagactaccggattaactaaatcccaacgtcgccagatcgcgcgtcgtgctctcaaaacaaaacgtgctaacccgtcaattgctactcgcgcacaacgtaagcgcaagaaagcattgcgtaaacgtgctgcactggggctataaatatgaatgaatcccaaatcaacgaaaacggcgatatgcttttaatcgaagaatggggtttaccttgcggtgacgtttcagaatctattttagaatctgttggggaatcaaaagacggtaaattgcggatcgaaggtattttccttcaagccgaaaaggttaaccgtaaccgtcgtttgtatcctaaaaacgtacttgaagaagcagttaacgattatattagaactcaagttaacacccgtcaagcattaggtgaaatgaatcaccctccgcgcccgaatgtggatccgcgaaatgcttgcatcctgattgaaaaattgtggtggaagggtaacgatgtttggggccgcgctgttgttgttgaaggcgacggtggtgatggtgacaaactggcggcgttgattcgtgctggttgggttcctggtgtttcttcccgtggattaggtaagctctccgattccggcaaaggctacggcgttgtacaaaagggctttaaattagctgtaggcgttgatgtcgtctgggggccaagcgcacctgatgcatatgttaagcctatagtggaaaatcagcaaagcaaaccgcttgttgagaataatagtgctgatgacgcttttctggcattgtccgagcgtttgaaaggtctataaatacattaaacaaaacaacaggaaaatcaaaaatgcttaaagaacaactgctggcggaagcccagaacctggatactccggtcgagttagacagcattttcgaatcagttgaactttctgatgacgtgaaagcgacattcaccactgtattcgaacaagctgtaaaagctggcgctgcaaaactcgctgaatcccacattacccagatcgcggaacgttccgacgaactggtcgaagctcaggtaactgaacgtgccgctgaaatcgaaactaagctgtacgaagatgctgataaatattttgcgcacatttccgaagaatggctgaaagaaaacaaagaagccgtttcccgtgacatcaaagccgatctgtttgaatccctgatcatgggcctcaaagaagttctggttgaacataacgttgtcattccggaagaacaggttgatgtagtcgccgaactggaagacgaactgactgagaatcagcaggaagttaaaaccctgtttgaagcgaatcaggaactgaccaaagaaatttcagaaatgaaacgcaatgcagtagtttcagagaaaactaaaggtttgaccgaatctcaggtcgaaaaagtagaatctctgattgaagggctggaatattccgcaaccttcgaaaataaactcagcgcaattgttgaaatggtagcaaccaaagctgaaaaacccgttgacgagtctgtaaatactccgcaaacgaaagatgactttgttccggtagtcgaaagtgttccggcagagaaatccaagatcaataaatatgtacaagcggcaaaagccctttcttaatttcaaaaggtaagaaacaatgtctaagaaaaacgaattgatggaaaaatggaacgatcttctggagtctcaggaaggcttaccggatatcgctaccaaatccaaaaaacaactgattgctgccattatggaagcacaggaaaaagacgcagaagttgatccggtttaccgcgacgagaaaatcgttgaatccttcggtggtttcctggcggaagctgaaattgctggtgaccacggttacgacgcaaccaaaatcgcttctggtaactcaagcggtgctatcaccaacatcggccctgctgtaatcggtatggttcgccgtgcgattcctaacctgattgcgttcgatatctgcggtgttcagcctatgactggccctactggtcaggtgttcgctctccgcgcagtgtacggcaaagatccgctggcttccggtgctaaagaagcattccatccgatgttctccccggatagcatgtactccggtcagggcgcggctccgagcaacggctttaccgaactggcttccggtactgctatcgctgacggcgctatcgtgttccacgatttctctgaaactggtcgtgtgttcctccagaacgtttctggctctccggttactgtaactggttctaccgccgatgctctggatgctgctgttatcgccgaacaggaaaaaggtactctggctgaaatttcttacggtatggctaccagtgtagcagaactgcaagaacagttcaacggttctactggcaacccgtggaacgaaatgggcttccgtatcgataagcaggttatcgaagcacgtagccgccaactgaaagcacagtactctgtagaactggctcaggatctccgcgctgttcacggtatggacgctgacgccgaactgtctgctattctggcaaccgaaatcatgctggaaatcaaccgcgaaatcgttgatatgatcaactataccgcacaggttggtaaaactggtttcactcagaccgttggctctaaagctggtgcgtttgacttccaggatccgattgatgttcgtggcgctcgttgggctggtgaaagctacaaagctctgctgattcagatcgacaaagaagcaaacgaaatcgcacgtcaaactggtcgtggtgctggtaacttcatcatcgcttcccgtaacgtggtttccgctctggctcgtatcgatagcggtatcactccggcaggtcaaggtctccagaagactctgaacgttgacaccactaaagcagtattcgctggtgttctgggtggcgtgtataaagtatacatcgaccagtatgcacgtggtgattacttcaccgtgggttacaaaggcgataacgaaatggatgctggtatctactacgctccgtatgttgcgctgaccccgctgcgtggttctgatccgaagaacttccagccagtaatgggcttcaaaactcgttacggtgtaggtatcaacccgtttgcgaactctcgctctcaggctccgtccgaccgtatcacttctggtatgattaccaaagaaatgttcggtaaaaacgcatacttccgcaaggtttatgtgaaaggcttataagttattgaaaaataacgatattaaagggaaccttcgggttccctttttcatttctataaatagtgaaaacaattgaggctatattatgaaacatattatctacaaaataacaaatttggtcaataataaaatttacgttggtgctcattcaacagaagacatcaatgattcatacatgggttcaggggtggctataaaggcggctcagaggaagtatggtatcgataaatttataaaagaaatattacatatttttgatacccgtgaagaaatgtatgaaaaagaaagagagattgttaatctagaatttgttaataatccacatacatataatatgggtatcggtggtgatggtggccctatgttgggtatgtttcattcagaagagaagaaacaagaaatttccaagattactaaagagagaatgacagatgaagtaaaatctcgtctctctaaacttaaaaagggtaaaccacagtccgaagaatccaacaggaagcgctcagagacgttaaaagctaaatatatgaatggacgtatagacagagagtataaacctctcacagaagcgcacaaggcgaaattaggccgttctgtatcgatagatggagttgtatactcatccgggtcggaggcggcaaaatcccttagtatgtcccactctggtttaaaatatcggattaatagcgacaaataccctacctggaaatttgttgcataaataccattatacactttacgcaggaacataaaatgagtgaaaaattttacacaattaacaagctggtgcgtcagtcacagctaccgcctggcctgtctaaaaaggttcttgatgaggcaaccggaacagaaacaattaacgtagctaatacccgtccggatctggtatctcttacccgtgcggtaaacaacctgatctacggtgaacttgtagcgattcaggaaactaatttacctaccgcaactctgttcggtgtgcgttatcgtaaccctaaaggcgatatgacgttttccagcgctgctacatattccggtaagtatgcaagccgcgataatattccagttggtgcggttggtactgcctacaccaaaggccaagttttcaaacacccgacaagtgatgttgtatacgaagtaactgatagcgtaactctcacaggtgctgatattgatgaagcgattatggtcgcattattcagcaataaattacgcctggcaagcgaagccgcgccaacaagtcaatatgaaaccagcgaagatattagtacaacttctttcgaaatggatcgttggaatatcaacgttcgttcccgcaaattcaaaactgaaatgaccgtggaacttatgcaggatctggaagcaaaccaattcaacgcagaaaatgtgattgaagatgttctgggtactgttgccagcgaagaagtaaacaaagatatcatccagactctgatcaacgtatcacatcgttacaacgttgatggtgtggtaacaaatggcattttcgatgctacaaccgcatacactgcaaaggatgctccagctttaggtcgtttcctgtatcaattagtgtgtgaaatggggcaggaaatgaatagaacgacttcatttgaagctacctatgtactggcctcttctcgcgttgtaagcgttctgtctgcgtctggttggatgcatgaaactgatgaaacccacccgttagcaacaggtcgacttaaaaacggttactatgtctatactgacaccaatacaccgtttgattacctgctgactggttgcaagtacgatctgggtgaaatggatcatgttggctctctgttctatacgccatacacagaagctgatcaggcaggttcgatcaagatttctgttgatcctcaatccttacagcctaaagttgctattctgatgcgctacggtttatcggttaacccgtataccactgctgctaatgaaagacttgtgaaaggtgatgactgggtaaacctctcaggtaaatctaagatgagtcagattgtgggtatcaaacttcctaaactgggttgatagtattataacccaacggggatgatattcaataggtggagtagggaaacttactccatcttttaataattataattaatattaaattagatcttgaatttataaatgatttatgataaaatttattaattataattattatagatcaaataatttttgaaatcaagtaaaaataaatttgattttataaattagatcatgtataattattcttttaataatatattatattagatcaatttaaatttgactacaaattaatatagtatattatagatcaactgggtaaattggtgagtatgttatgagtttgaaattagaagatctgcaaaatgaacttgaaaaggatatgctgatagatcccctcaagttgcaatcagaatcagcggatatccctaagatttgggctaaatggcttcgttaccattcaaacgcgaagaaaaaactgatccaacttcatgctaaaaaagaagctgatgtgaaggatcgtatgttgtactacaccggaagacatgacaaagaaatgtgcgaagtggtgtatactgggactactgaaatcaaaatcgcgatcgctggggatccgaagattgtagaaaccaacaagctgatccagtattatgacatggtggtagatttcaccagcaaagcactggatatcgtcaaaaacaaaggatactctatcaaaaacatgttagagatccgtaaattagaaagtggtgcataatgtctactgaaaatgaaaaatgtgtagtgtgcaagtgtccggttccttctactggttttgtgactgaatccgggcgcgtgtgtagtactatctgtgctgactacatcgcagaaaaaacaaaaaacggcgagatcaacgaatccgatgatctgaatgaagttcaaatgttgctgtaggagaatcttatgattggttacggtgaaggaattacagatcgtgatgaacgtccagatctcttagaatctgacgaacaccctgatttttagggtataaatactagcgtacccgaaaggggcttgataaaagaatgctggatgataggcgtactcttttgcgccgtccgatggagtttaccttcggcggggtgattgataacataccttcgatcaagggcatgagtaaaaaaaaagccagaatagtacctcactggctataatcaaatgtacgtgttgggctgattgcgtcccaaaattaaaaagccccaaccgaaaggaaggggctttttttagaacttttcttcttctccgctttcgagttcggcctttaattcttcggctcgacctttcagcgcatcgcgcatagaaatatcgtctgacggcgcaacatcaacttcttttacacgatttttgtaatatttttcaagctctttaaggccgtccatagtacggcaagaggcgaccttgctcatgaaatcatcaatagccgcctcataaagtcgaaaatcgttgaaactcttcattttgacctctaaatttcgatttgtttgatcacgtagtcaaacttttcttcattgtaaatgcgtactcgttcgattgcgtgtttcataccatagtttttgtatgaatatttatttttagcatttttggactttgccagcgttgctaagttatcaaccaaatcccaaacagtagcaagagatttagaatcatgtttacgcagtacgcgcccaattgactgtttgactataacagcagatttgcaaggatgtccgaagatgatgtgatgcaggttcttgacagaaatacctgtactcagtacaccaatagaaccgattacgatcagccccttcgttgattccgcgatccgtttcatttcgtttcgctcatcaatccccgtttccccagaaatgtatacaacgttgtcatatacctttttgagttgctcatacagccatttaccatgtttgatctgattgaacatcacaaacacgttttcatctttttcccttgccagttttaacgccagcttacagatccatgcgttacgcctggtatgcgatgttatatacttgatttcgctttggtaatcagcccccttcattttcttaatctcatcctctttatatctcatgaagatggtattaattcgaaggttggtaacttgaccttcctgcatcaaccgatttgtatcaactggcttgaagatttgaccaaaagcgccaatgtattgcatcatgtttgctttgccttctttcagagaaccagaaaggccaaacttgaaaatacactgatccattgtgttgatgatcttctgtatgctttgtccggttgatttgtggcattcatccaccatcaaacacatgaactgctgaaaccactcaggaggcattttaacagccgattgccacgtagacacgtagatcaatgcattactgtttttagcagttcctgaccgtattccaagcattgcctcgcgaggtaaaaggcgatagttgacgatatcaccgatcatctgatcaacaagggcagttgtggggacaatgattagtactttgcctgtgtaattttccagacaccaacgagatatcaatccctgaataagagatttacccgctgacgttgggaggttaagcacagcacggcggtttttaatcgcatgaaacaccgattgtttttgataccaatacggatcaatttgcttgtttccgtcgtatactgggtgttcttctaaccacttgtcaaaatctggctgggtaatttcttctgtttcgtggatcttaggatccatccagatagaatacccgcgagactccgcgaattttgttacaagataggctaaaccgtagggcagtttcccgttatagtccatcaagtatatgtagccgttccatccaccatatttgtattttgcctggtactgataacctggcggctggaagctgaaatagtcgcgcaattcatagactatgttagcctctgcctgaatctgcacatgactagtgttaaggaatttgacttcgatatccactatgtgtatcctatatacggtttatatgaatatttataggctaaataatgataaacattggagaactacaatgagtattgattacgaaaaggttgaaggtttcaaagccttagaacaaaaagaagccaaattacagcttgctacctacgcgcaagaaacgtttgatgtcaaactgaaccgtcagaagtcattcgaaaatatgcttgctgatctggaatctgccgtaccagcagaaaagccggaactgttgatcgactcccccgatcctgaaattgttacatacgaaggtgaacaatccgttcctgatgttgttattgatgtgactaacgatttcatggattacgttaaagaggttgctccggaaatcgcagaccagattgaaattgttcctgacgctctacaagctcctacaagcgattctgagacggtttctgatgaactggcatggatggaagggtttaccccgtctatcatcatgatgggccgctctgtttcgaatactggcttttatacgtgtccgtattggatctatgattggatgaaacaaaatccggattggtacaagcaccctgacagttgtcctcattattcagcgcgtcaaaccctcaagtcgctggcatggtacatgcatcgtgatgggatggttactgtaagggaaacccgaaacagccagttctacacgttcaaaaaataattttaaaaagtagttgaccttgccctgctattcgagtatatttgtattcgaaggcgggggaatggctctcgcagtgaagaaggaaatacaaaatgaacatgatgaaaaatgcttactacccagttctgtttgtttggactaatggtgaagttaagaaaatcgtcaattctaaagctccttattacactgtaggtgaagcacttcgccacgctgcggaagcaaattatcctgttcatgccgaacctggttatgctcgttggaacggttctaaatgggttgctgatacctgggacaactacgaagaagaaagaatggagtgtgatcctgattacgtatctcgtcaaatggaagctcatatgattgcagatcgtagactggataatgaagctcgcggattctattgattaacaaggggctacggccccttttcttttaggtgaaatatgaacttaaatcacgaatgtttaaaagatttgagcgatggtaacgagattggtaacgttatttttcttgatatcgatggcgttctaaataatatgcggtgcatgaaatttggtgaacatatggacatcgaatgcgcacgacacttacgccggatagtgaatcacgctaattgtgatatcgtcatttcctctacgtggagaatcggcaacagtacccataatctacgtgaaatattttatccgtggggattgtatcggatcattggtaaaacttgcactaacttccctcatagtactggaatgcgtggtgatgaaatcaaggcatggatcgatactttcggatgtaaaaactatctcattcttgatgatgataccgatatgctttcttcacaaaaagaacattttattaaaactgatgggtttgttgggttgaccgaagaacaatccacttatgcgatccgtaacattttcggggttactactccgttttgtcctgaatgcaatgggtatggacgtgttaacggctacgacaaatgcggaacgtgtaacggtaaaatactccggctataaataccaataaacataagaggctaaatttatggcaattccttctgtaacaattagcgccaacaaaaacgaacttttgattggcgaaactttgaccttagaggttgaaactactgaactagatcctggtgatgtgtttctggcctatcgttggcaaaaagacggtgtagatattccaggcgcaaccgccgatacttacacaactacggttgacggtacaactgctggcgattatactctgatcttaaaacacggtgctgatgaagaatcagcaacagaaaccacgtctgatacaatcaccgtgaccacttattctgatgatcttgtttctaaatggacggttcacccgattccgtggcgtgataccagctttaccccgatcggttattgggtacttgatgaaattctgtatcaaaaagcacagggtaaagattggaaaactgattatgctgattacaagtatagtgaggaagtacaaacgatcctgaaagcgttcatggaaaacggtgaatgtgagatccaagattcacgaaacggctatattcataaaatgagtgaaatctaagaggctttaaatggcaactgaaaaatggactacggttcatcctattccgtggagaaataccagttttacatatcttccatactggctatacgatattatcgttgatgcttttgagaaaggcgacgactggcgcgattatgcggaagaaaaatataaattagagtttgatactctgaaagaggcgtttgaagattatggtgatattcatgtaatcgaatctcgtaatggtaaactggttagtctgttgtcattgactcctgctcctgaaccagatcctgaccaataaaataaggcaaacaatgaatacacttctttttgatttcgacgacactttagcagaattttctcagactttttatgataagttcggtgtacgtccggaaggaacgccaaaggaacgatatgatgaaatggcggcttctttggtgcgtactgatttttataaaaaccttccccgtattcaggctgggattgacctccttcaatggagtttccaacgccgaatcggtgatcctgctactttgctgcttcgcgcggaagcggtcagccctctttgggttatgaaagaaaaactgaactatacagataagatttgcgctgaactggggatccctcgtctcgattttagtcgcattgactatccggaacagttcgcagaacatgcctatcgtggtgttctgatttcccgcaaccagaaacatcttgaaatctggaacaattctcatctagctaataaagttcctggtattttccttgcggaaaccctggaagaaaatattcagctagtcacggaagcgcttgcaaaggctaatcaataacaaaaaagggaaccgcaatggttccctttcttttacaatctttttaattcatcaagcgctgttttcttatcaccaacaaagaggatcgctttacctcctgcttttctgaaaggcaacaccgcttttgcccgatcgtcaaacaggattcctttaccagcgaatgctgctttttcatggctacttttaacgtagtggaattctggaacgtaacccaatactttttgcaatgctttacgtttttgttcggcaacaccgtcagaattgaatttaccaacactggttagtattgctacatcaccaagtgttcttaaatgatggaataattcaaatccttctttgattggttccagattttcgtagaaatcagttttggcaatttttgctttgcactttttcaactcatcttctgtcatcatagagggttcgccatacattggcacaaatgaaccttcccagtcgaacaatacaccatccatatcaaagaaaaacttattcatatcaattcctcagtttgtgtatgcatactataatgtttaatcattaatgtcaaccccaagtgtcagttttcggtgcgtatgctgcaactttagccacaatttccttatccagttcagctacagatttctgaggcttaccacgggctttaactttgatgtagtttgacttaacaacaaacatccctttgttacttgatttcttgatctcgctatcaacaccaactttgttaaagctgatccaaatgtcgccgtccatatactgtttaagagaatcacccatgttcaggatcttcgccatagtaagggccgcgccttcgtgggtatccatgagaatttctttaggaactacacgatcgcgtttctggttctgctgcatagcaatatgcacatcgttcataacccatacgatatgtacgttttcttttttgtatcccagcgtttcgacatcacgcgcgatgcttgccagcttgctcatgccttttaacgttacgtcaaagatgaggttaggtttacgatcttctggtgctgccataataccggaataaacacggttttggtttttgttggaaatgttgaaaacgtcggcgatcacatgatggagggtagatacgttttctgggtttttgaggttcattgttttgacatcatgacccgtttgtttcttgatctctgctgcgagtttatcgctacccattacaagttttttcagggcgtcaacgtccagggtaataccttcgatgcctagcagtttttc

SEQ ID NO: 128 - DNA, 177937 bp, Unknown; identical to SEQ ID NO: 5
  source: /note="Description of Unknown: colon-6 Bacteriophage Sequence"

SEQ ID NO: 129 - DNA, 177196 bp, Unknown
  source: /note="Description of Unknown: 1.2-2 Bacteriophage Sequence"
cgagattggaataatgacgtagcggcttcaaaaggggccgcagcagtaagaaatagtttgattggtatcgtaaccacgatcaagggtacacgtccatttgatagtaactttggttgtgctattagtgatatgctgtttgagaacatgaaccctctgacagcggaatcaattagaacttctatcgtatctgcgatccggacatatgagcctagagtatataatctttctgttgaagttattccacagtatgatgataactcagtaacagtaaccatctattacagcatcattgatgacccggatgacgtagagcaaatcaaactacagctttccgcatcataacaaaaagccccttcctttcggttggggctttctcttagaattcaatgaatcccattagtgtttgatatcgcaattcaaacggggagatataactttgcatctggttttgatcggatacgatgtaataatacacctcatcattatcatcgtatagtgcttctttgatgatgcaatatcgatcggtttccacgttcacataaagagtatccatgtactttgtaactttggaaccctgtgaactgatctcgtgaatagcgttatctatgaacagtgacaatgcttgcatgaagttatcaaactcaccatattcacagcccataatagaaattgcagtgtattggtgccagcctttgattgtatctccacggcggatccatccgatttgtctacccccgatagatacacaccacactttaccaatagggctatagaaccgcacaacttcttttaataacagggacatgaccccgcattttgtataaggattcattttaacctcatttcatatcaagtagccatgaagggctagtttcaagagaaatcgcagtatattcgtattttacagtataacctttgaaaccgaaaggaataattgcattttcattgagatattttactttatgctttgcttcttcttcattcagagcagcacagactgttgtttgttcaacgttaccagcaggagaagtaaatttttcaatgatgatatatacgcagttcatcctattgtcctctttccattttttcaagtttcatcgtatccacttgcagttgaagtttaagaatacaacctttcgatatgttatacaagtagtcactaacgatttttgactttacctgatcgtaatcagaagataacgtaatccaatcatacatcgtttggtatgatggaagatacgtacattgttcttcttttgataacgctttaaatgattggtaatcggttggaggttccgaagcaattgcggttgtggtcataagactaagtgcaagtagtagatatttcataatgtattcctcattgttttcgatagaaccaatatagcaaaaagccccgaccgaagtcaagggctttttcatcaatgcaagaaagatttcacgtactgttcgatcttttcacgacatgtatcaactgaggtgctttccgcaattacggcatgacataacgcctcgcctccgacccagaaactcatcatgtactgaatatcacgaccttccatttctttttgatgcgctttgattcgatcgaaagcgttttcgattgtttcagtagcagtaagcatttcggattccccgtcaacctccgccagttccccatcgatcatttcgctttcgacttcttcccagtatactatcgttatcatgcattaccccagtggttaaccgtcgtaatccccgccacaattcacatcgccttcaatgaacagttcgcggttatcacgtaataaattatactttctttcgagttcaggcccgaacgcgtcggcgtcgtcataccagtcatagttatagcatccggtttcatcgtcgtattctggttcatcaccgcgctcgttgaagtgaacaattttaatatcgtccatccccagttctttcagcttatcccagatatacgaaatctcaacgctatgggaaccgaacgcttccagtgagatcgtaccgtcgctatcgacttgaggaacaccccacttcgaacgagtatcatcggtgatcatatctattaatgactcaatattattctcaccgtagatatcagcaacttccttttctttaccaggacgaacaagcccgatcccgataataaagctactgcttgagctattgctcacaaacccagaacgaattttcatcgcatcaccatattaccaatcatgaatagagggattaacgcgaagacaataccccatagaatgaccttatcttcacgacggtcgcacccatgatagataacacctccagcgaaaatcaatacaacaactgaaacgaacgcgaataaagaaatcatttgcgggtatccattctcatagaaacttctttcaggatcttattcagatcgtgaagcgcatcttttacgttaccttcattataggtaagcatatcctggtacagccctttcaagcaacgattgataacatatgctttttcggaaggtaacattgtcccagaacgattataatctctgaaaatgtccatcatcgtgccggtgttgccaggtaatgacgggttgaagttaaccataccggacatcaaactatcaacatacacaacggttgtgttatcagaacgatacgcgccaccaactttaaaccagttgctgaacacatacggagattcccgcacttcgctcaaatcggttccgatttcatcgatgtttacacgaatgttgttaaaatacaccgattcatcaatagaaccaggacgccataagatagcaccgttgttatttttgaatccgactacatcaacctgccagccgttatctgttaaccggacatcatcaacgacgatgaaatcaggtagctgtgaatgaaagccgatgttttcaggacgggaattacgaaacccatcacgattggagaaataaaggatgtcgccttgattcagtttgcatatattcataagatttttaaagtccaattcaagtaattccacaagtcacctcaaagccccctttcgggggcgagatctcattagagtttaacttctttttcttccagaacgattgtgcaatcaaatttcacatctttccagaattccgctgcaacgatatctgttgcggtaacgcttacgctggtttcttcaaaatccagatccgcaaaccatgcgtgtccgacgacaataccgtacattacacgactcaggcgattattaagggcgcgaacctctttaatagtttcctttgtctgcttatcaagatactcgatcaggtcattcttgtcaagcgcttcgatctctttagatacagtatcataagcccacagaatgatcaggtcgccattgttgagtttcttcttaccttcggcgcgttttgcaacggtagcagcaacagccggaagtgatgaaacgcctttgattttcacgttcagttctttcgacatgtaaacatcagtcgattctgtgcgctcaaccttcggagaaaagccgtaatcacggatcccttgctcagacaaccattcaccagccgcctcaccaaagcgctgtttaagcccttctgcgttgcgtaaaccaatcgcgttatcacggaagaacttcattaccttctgacggcctttcaggatttccagacggacgttatcagcaacaaattccttaccagaaataccgcgagtcatcgaacggttaaccagaggcagagaggtaaagtcaaccagtacagacatacggtcttcaccaattttagccagcggtttgatagtcagaccagaagcacgtaagtttttcagagtcgggatatcggtttccagcggaagtaccttaacgttaacgataccatctttaacaatggtaaagttacgcacttgtttggtttctactttttccggcaatccaaactctttttgtttgctttccggaatggttacgtaaccttgtagatccgtattgatagaaatgttcggacgggaactgttaccaaccaggtgtttcactgcaactttcgttgtggtttgggtaaattccggtttccatacttcatgcgctaccagttgcgccgccagtgctttacgttcttccggagtagaagcgtttgcaatctgttctgacagtttatccagtgtatcatcatctttctggacagtctgacggcctgtacgattgtacgcccagtgttcagaagacaggtcgatcactgtgtcggtttctgccagcagttcgagagcatcaaccagagtaaacgcgttttcatcaggaaccatgttgtaatcaacaccatccatcagacgtttagccggatcaacaaccgcttcggagatcatatctttagcgttggaataatcctgtttggtaaagcagttatcgtatgctttaatcagacgcacatcacccagctttttcagaactttccatgccagatctggattcatggtatgaagcgcatgatacagaaccacatacagaacctgttcaccttctgctgttgccggatcgaagccgtcaacgtcattgatcgcgttttcacccagcgcccaaatgtttttgatatgttccggaaccagaacaacaccatttgcagcattcaggacatacacacggccttcatccaggtagatcgcatgagttgcatcgccaactttgacttcaacacgtgcggaggtttgcgcggtaatgatttcatcaaatgcaggtacatacgcatcaaacccttcaacgaatttgtgtaatgcgttggttgcttccgccattttttccagcagaggacggtttacataataaccatattccaggaaagcaatgttgttaaacgtcaacggcagagtagaacacgctttcaggatgtcatcagtacgccagcagttatcataaccatcagtcaggaagatcagactgttcagattgccattatccgcttgcagatcggtagcgacttcaaccgccagttgcagaggttcaacgaagccagtacatccggtcggacgcagataacgatcgatagcatcattgattttgctcaggtcggatacagagctaaccttttcgcccacgaatacagaaccgaactgaccacggctggagaaatacagaatagatacggtatcatcctgcttaaccagcgttgccaggttgtttttcaggtgctgacgaatgcgcgggagttcgttatacatcgatccggatacgtcacaaacaaaaacgtggttagtcggggttggtttggctacggcgtttttgaattcaatgttagtgatcataattttctcatttataggtaaatttgattaaaatttcgtttacttttttgctaattatatctaatgcatcatcgcatccaaacttactactcaacaatgaaacaaaatcatccatcgttgttgtttgagactcgccaacgtcaaaagacagagcgtaggcaacaggatttttaatccttacgatttgaatagtatactcattcaggtcaaaccgttcaagatattttcgcaaagaaaataaatcaatcggtactggtagagtttgactaaacgttatttcttcccccagttgataggggggcatttttacacagatttcgtattccatcagtgatgactcttcatagtgtgttccagattacggaaaatttgcccgtgttcaagctgggattggaattctccgcattcatcagagtaagtaaattcataaatgaatacaccgtcctgattgccaaatttagagttgtactcttcatacaaccacatcttgatcagagcgtctttctcttctgtttccagatcataccagtcacgcccatcataagcaagcgcaatttgaggattagaccgatatcgagtttcggcgctatcttcggtttcccattcataacgcttatcatcatagtatgattcgaagctatttcccatatgaccgcccaggtcgcggtgtacctgctgtacaacttcttccgctgtcgggcaagtcatccagctataaccacagttaggaacacagtcacccatcatttcgcggagattgttgatatcagtcggatccttcgggaaccggacgatgaaactacttgatgaactattgctcacaaaaccagatcggattttcattataatttctcccaacgttcagcatttttaaccttcatctttcacttccttcatgtttttcataacttcttcaaaagttacagggatctcgttgtactgttgcgattcttcatcccatacatcgcgatgcccgaatgttgaactttttgcaatgattttttcattttcccatacatcaatagtaacatgatcaccaagataagggaaattaggaactttgttcagcgcatcaacgcagttttgcaatgattcagaaacatgggcaatttcagtgaattcataatcagcactataagaagctacgtaaatcatcaccaccccctaacgatgctaaccagcagtaaacccaggatccagaacacagcaaccgcacaaatacgggccattactacatttccgcgactagtccactccgcactaagaaacaagaggacaaaagttaacgcgtataaaaccatttcaataacttcggtaatcatataaacctcacgaaaaagcccctttcggggcttgtttaattaatgcccgaacacaccacgaatagactctgcgaatgcatacagttcaggatttttagctttcactgtttcgatttgctccagaatgtaatctggtttatatttcgcaccgaaccagcagtaagagaaagaacgatcccacatgaacacgttatagtattcaccgttgcgaacttcaaccatcacataaccaggattagaacccagcggataatctttcagaagattgaatttcgcgccagcaccagtacatccgttaaacaggtcattaaaagtcatggtatgttccttttgtcagtttcgtttcaacaaggacactatactattcttctttagcctgtgcaagcgcttttttgatttgttttgctatggcttcaatcactgggatggaaactgaattcccagcctgtttgtaagcctgtattttgctttcagggatgataaacgaatccggaaatccttgtaacctaaaacattctcgcgggcttaatcttctagggttcttaccttcctgcaataccagacattgaacaccatccttatagtattgggctgttatcgtcccagtacacacagaatcaactgtaacggcctgatagccaaaccccttgccgtttgccttgtttcgttctttacgctctctaaagcccttccaggcacgatctgatatggtgtattgatcattatccggttcgagaatgtcaccgacccttgttggggtacgtggaggaacaggaaagctaaagaacaccggatcgcgaaagcagacaataaacacacgctctcttcgttgaggcaatccaaaatcttttgtattcattacctgataatggatatcgtatccttcgtcctgtaacagcctgtagatggttttaaacgtgttgcccttgtcatgggttaatagctggggaacattctcaaagaacagcacagagggctttttagcccgtataatgcggagtatttcaaagatgatagtaccgcgaggatctaacatgccctgttttaaccctgctttactgaacgcctgacaaggaaaccccgccaacaggatatcgtgatcgggtacatcgttttcatcaatggtgaatatatcaccctgaatattttcatcaccccagttatcagcatatgtttgttgtgcatgtttatcgatttcagacgttaaaaggcattcgaccccgccgaatgccttatcgaaaccgagcctcacgccaccaacaccagcgcaaaggtcaattattttcatacgtcgaaatcaacctcatcgattttgtatgattcttcgccaatatcagcccatagctgaatattcacactttttgcatcacgataaagagattgaccacaaagcccacctgtataacaagtttctgtaatctcgttaacttccaggcggaggctattgcgcataattttaacaacagccttttccattgccgaatctagggttttagtatcacccaatactacatctttaacgttcaaaataacatcactcattatcgccactccgtttcaattccgtgtttgtatgcgtcaacgcccagaggggtgatcactaaacacatatcagtatttttcgttggtgaactaaacgccatagatgcataacctttttgaatcagggcatcacgccccgatttactgggaacatcgttgaaatctaaatccaacatttttgacgagtatctgtaaagtttacacagaacatcaatttcagcgccggataatttcgggtatgtcatttgtagtacctcacaacatgttcagaatacacacgttcaatgaaatcattccagaaatcgcgatcaacttctttcggataaccagatacagccgccagcttttcaacttcacacatcgttgattctagcgcctcttgtacggttgcgaaaggaacaccgccagctttaaccattttcaaaaatgcgctatccggaagaggatacacaatatcaccttctttgaaaatctggatcaattgcataccaccgcgcaatgcatgagaaagagctttccagtcgatcccgttgttggcttctgcttgccgtgcgcgttccccgtattcatcccagagtttatacacggatttcttcatttccgctacggtgattgtagactggaatttacgccccagaacttcataaaattcctgacaacctgatttcagtgttttgtctgtaacgaatcgacaaaactcgttggtcgggaatcggttagaaacctcaccaactttgatgcgcttgccgtagttagattcatctacgttacccagcaatgatgtaccataccagtaatcgggaatcatttgtaacacatcaacaacttcacgcagtgccgccaggcgagaacctttaacgccatacttcgccgcttgcttacgaacataaccaaacaggccagttagttccgtagtgtagaagcgtgaacggttagcgcggagatattgccagatatcagagttagcgatcagtttgctatcatctgcatgaagcatatcaatcgccacggtgtcaccatcacatgcgaggctaataaacttttgcagactgtaaatctgacgatctacgtcattaacatcgttctttgagtttttatcaccagttgatgtatcgatagacttcttcgcagtgcctaacaggatttcgcgaggatgagggagatagatccctttgtagtctttatcgcttgttggtgtttccagtccgtacaggtgagaaccgaatacggtttccataatcattttcatcagaattcaacctttaatgtttttgcgatcccgcgcaattcagcggtagtaatatccggaatgtttgttccgtagctattcccaaatacttttttaatcttatcacacaaatcgcggcgatacaccatttctttgtattcttcttcgctacgatacagttgataacccatccacccctcagcccatccggaattgcgcttgattttaatattagtacaacaatcagacccatcttccggtcggaaagatgcatacaggtactgacgcgcaactttttgtacgtaaagggttttggggttgcgattttgtcgctggtcactacggatcccagcatcatacaacgtatcaccaactttcacatcacttaaatcaatcatttacgtctccagcaattagttttttcacagtagtgaacgggaacaggcacacccaacgtttctttactgcttctgttgtatgttatcacaacgaatcggttttcgccacccctaacacactccagatccaaaatctcgcgggttcccttcgtgttaatgtctgcaacataatattcttcgttgttgacaatcactatatccgacataatcaagcgaggtttcatgcagcgtacacctctgattcatcaatccattccagatcctgattgagtgattcaatcagttttttatcgcgtcgggaaataacaacggtagaacctttttctgccttcacgatgatatcaccagaagaggtaatgtattcaaccacataatcacggcgagggcttccgagtttatcaccaactttaacagcacgtctaaccgattcatgagatttttcggtaaacattaattcatcgcctacatgggtaacaataccatcaacagcagaacgagaattaacataaattttgctaatctccgccatgaaaacactatctctcagatatcgagcagtcactttatctaaacactgagaagatactttatctccgccaggatatactgagataatcattacatgaccctgaacacggacggttcctactttatgcagaatgtaaaccattgaaccatcagaatctttagatacaaggatcacgctgaaagattctttgtgttgcttctgagtttctccacaggtaaaactcacgtccagaaaatcaccaactttaacagcacggggttttgctacttgttcacgagcactaataacagggatcataatcatttcctcacagtttcaaattcttcatcagatttccaatatacgttaaaattacgacaatcgtgttcggatgtcaacgtgtatttttcatttgttttttcgtcagtgataaccatagtttcattctcgatcgagttaacaccgtaaacgaaaacattctcaccacgtttgtttaaaaacgcatcacccttttcaatcaactgccaacaggtaacaggcaaaccacccggactaaccgggcgggtaacaagacaatagggatgtttaatcatttaaattcttccattgcataggaagtaagatctttgaaataccttgcggtgttgccttctgggttgtttgtaatctccatcaggataacagcactatcaactcctgctttcttagccatgaatgaaagggcttcggtagcaataatcgttgctttcataacatcagctttagaaacgttgattgtattcatttttcttccttttcattaatcacttggtatgtgtgtataatacaaaagccctcacgagaacgcaagggcttttttattaaatttcgtataaatctggattcacaataaccgcacataaaagatcatctatatgtgcggcttcttgttctaaggtttgcttagatgaatgtgctttcaagcaacccccgtaaaggcgtttactatctggaaatgatcatcgaagaattccccttgtcgttgtacgacctcatgcataggtagccagaacgcgtctgctgcatcatcagcaccgcccatgatacgaggcaatgaaccatcgttattaggttctagcttgatatactgtgctacagtcggttttgagaagtacaccgaacgtttcggatgatcgaacagcatcgaattacggatagaaccacgaataaccttttcaggtactttaattcgtacttcttccagtaattcacggatcgcacaatcaaggaacgtttcgttaccgtttttgtgtccacccggaagcgctaacgcatctttaccaggcgcaaacttacgacggattactaacacgtggttattacatacgaccactgaatcagccgtgcaacagttcagagaatccggatacggatattttttgaacttgtcaatctctcgttgccagtgtgcatcttcatgggacaaacgctggaattcttttgtttgtgtccattcatcgataaaggaaaccgtagtgctaggcgcatattttaacaaatcttcgtcccagccttcatggtgttcccagataattttgcgtaaattggtcgaggacagatcctggtctccaaccttcacagattcaaccggaatatgattccatccgaatgctttaagccagtaagaatctttgtctttttcgtacccgacgatcgcaattcggtcatttcgagtttcatcgattgccatacgaacacgggatttccatttttcctcgttatagagataatccggaatgtgagcgaatttgattctggctgcatcttcaacatcaagtttgcagatagaccagcgagtgatcattgcttgacgctgtttagcggtcaatgggtttaatgtgttcggatatgcataagcagaaccgatcagaatgtaaaccgtatcagcaacagcaagggcttcccttaccattttctcatgaccatagtgaaaaggttgaaaacgtccaattactacagctttatcatatttgtgtttcataacgtgctccacgtttaaaggttaatcataaaacagacgcaattattaaaacaccaaacaatccaccaatgaaaccaaagaatagtgaaatgagtattgtcaatacgatctgttttatgttcattatagtattctcgttttagatgtcaagcccccaaagagggggctttaaaacattatttacgagaatcgaaaatcactttacccgcataatccgaacccattacagtttgaggtacgccacctttatagcgggtagagtagttcatctgtacatccagttctttccagcggatcatttccggtgtaatggtgcgttgcagggcggcgttggcttctgcttctttcttcgctgcatacagacgggcatcagcatcacgttcgttagcgattgcagcgttttcacgcgcctggcgatcggcttccgcttgttttactgcttgtaatgaagtctgttctactttttgcagttcagctttagcagcgttaacctgttcttcgcggatcttcgtgttagttacctgttccatgataacttccggcagggtgatatcctgcaagaatacctgtttcacagtgtaaccgtaaggccgtgcataatcttctacttcctgctgaattgcgatttgcagttggttttggatcttcgcatcaaacaggtcttgcgcttttggtacggatttaccaaattcgcgaacagtggaaagcagtttttcagttacatacttatccagtgcctgatcctgattacccgcgttgatacggttgatcggtgctttgctaccgtcgaattgcagcattacggtcatatccacagtggatttaaatttatcctgggacggaacctgtaatttgtcgaacttcatcgcgatgtctttggtgctgaacgtgtcaaacgtcgccagcgggtttacaatgtggaaaccaggcagtacgggtttcggtgatactttacccatgaaggtttcagttttaaccgtaccgtcttgcacaatggtatacatgttaggcactaaccacagtgctgcgactacgcccagagcgatcagagaggttttcttcgggttgttcacgatagtgtttaagttcatcataatttccataagttgttgttcaattcgatagttattctatcatcacatttcacgctgtcaaactatttttaagaaagttttgtcagcttgtagattgtttgatagcacaagcccttaatctcgtccaggatgttcttcaaagaactatctactgattcgtagatctcgtttgcttcgttggctattttacggagatacgccaccgtgtcaagcacattttcggtttttagcacaggtttgtatcttcccgtgattcctatgtggatttcggtgaatttatcaaccaaatcctgcatatcttcgtaaaaaccctcatatgctttatgttgtgagtatgaacctgttgcaaaatgtgcgctatgcatataggtaacggacataaggcacatgccaataaaggcatctatcttgcttgagttctcagattctgtaatttgtttaaatgattgcatgatgatccctttatgaacgatggatacttgcaaactcatacgcgaccctaatccctagctttgcgcattcggattcagatcggcattgtttttggcgccattttcgttccatgtagttgtagaatagttcgcttgtatttacgctgggagggatcgttgtgatgtatacttgaagggccgcattgatataatcgtcaaattctttctgaaccggacggtcggcggcgtgtgttgtgggtgtcatcatcaacaatccgaacagcacagccattgatatgcgtttaatgttcataacaattactcttttactcatagacccactataggtctactcctgtatatatttatagcaaaaacgaggccgaagcctcgttataatatttttgctgtaaagtcaatcaagtaatgtcataccaacacaaacttctttcgaaagcgcgtattttgttcacgttttctacgttttcatcccaaccgatcacaccagctttcatacgtttcagttcctgacgtaaacgggtacgtacttttgaatcaattttctttactgcaatagaaagcattgcgttcagatcgccatgagctttgttaccgtcgcgacacaaattattatcaaatcgaatgtatgcacatcctgatttgtgtttccagttggttgagtaccaacgtaacccatccggatcaataccatgttgagcataataacgagaatactcttttacttcttcgatcttttcgttagatgaacggtcacgaagaggattgtatttcttacggtaagtgcgactcataatgatctccttttgtttatgcttccactgtatcagggttgttctttagttgcaagtagtgttttcgacaaagtgaaacatatttgtcttctgccccgatctcaatctggtcgccattagcaacaaatttgccatttgcatcaatacgggcaacggtagttgctttctttccacaatgacaaacccctcgcaactccctgatctcatcagccagcgccagcaacatataagaaccttcgaacaagttcaactgaaaatcggttcttagtccataagtcattacgggtatatctaattcgtcaacaacccgacacagatccatgacatttttcctggaaaggaattgcgcttcatccacaaacacacaagaaaccagattcgggctgtctctataaaaatgattgttgtgaacatcataatacaagtccatatcaggcgtgatcatagtgcatgttgcttccaacccaatgcgcgaagagatactctgtttaccttctcgcgtatcaattgctggtttgtacatcaggatccgcataccgcgttcctggtagttgtatgcatcagtgagtaaacgagcactcttgccagcattcattgatgcataatgaaaatacagtttagccatttatcctctcaacaaaatctggggtattctggaattttccttccccttcatggtttttgcatgttttgtttgaacagtagatccaccaatcccactcatcataagggggtttggtaatgttcattacgcaaattaaagggaaatgacaatcccgacaacgaactttttctataatgtgtgcgttagccaattgaaaaccatcctttacccatgagtttttcattatgtcgcgcaagatactctttgatttctggcatccggatcgcagtgtcatattcttctttcgtcatggtatgatttgcgcaacccatacacccgcacacctgcgcgttacaccaacggagtgttccatatgtcgcaatcaccttcattgctttagctttgattttgtcagtcatgattataaccactcatttcgttatcttgtgcttgatgtatatcaagataccacatattgattttacttttcagttcgtccatttccttactcagacaattgtcaacgatacatagaacattaacagtttctttacgctgcataatgttgatgttattcgctttcatcgcttgcgccaatgcattacaggttttaaccagtgcggcgcgttgtcctttgattacggcgatccgcttgtttgctttcttaatctcccgacctgctttgataggatccatcatgattaattcgccttacgaggatcgaaatgaacgacaatgatcgggtaatcaccagtcacctcattaataatgcgcttaatgagttcccagtcgcccccagcgaggccagcaccgattaaaggtgtgatgataggctttccagtcttaacggcgtcagcaagccctacagcctgtttaaaagcattgccgattgcgtcataatcgacacgcggcccaggtgtccagaaatcatattgagtatatgcattgaaaacaatgttgcctttttcgccaatgtaaacagaacaagttccgagcttatcacgggaaccttttaacgtattggcatcaacttgaaatgcaccaggaatacgatcgcggatttcgcgagcaataccagcgcccatattgcaatagcagttgcatccgtggatcaaatggccttcaccgttcagatacatattgacagcattacctttcacttctttaatgatcatttttatttttccgatatagtagggccacaacaaggcccatcaaaatcacaaggatccacaatacagtgaattgaacccctacgctcattttctcgctttccgttcacggcggcgatcttcttgatgacacatatataaaacaccaccaaaaattataaaaccgataacaacgcctataaagtatccagcactaaacatagtcatcatccccgcaatagtaacaaggcccagtgctctcatgcttaccagcattgtacgccaagaacaccacaaccgccgccataataataaaaatccagatagccattagtaaagtcctatgccagcattgaattcgtcaaccaaataagtacggaacttttcgcaccgttccttatttggcgcttgtttgcatagattcatcattggttcagactgcaaaaactctttttgtttcagcaacttaccgcgtttatacaggtgagcattttcctctccccacatataagcaacatctaactgttctgcgatcacttgcttacatactgcgacatctttgatatcacgattgttgcataactcatccaggcgagcatcacccgcgtgagcaaatccagcaaccagagttaaaagcagtgctaactttttcatgatgattccttattcatcctcttcgataggggtataataatgcgcattgcagatatacgcaagaacttttttcagagacatatccgagaacgtcggatcctgatttcgtctcatcccactaccagtttcaacagcccaacgtttgttagctggattgtatgtcagccagtaacaatcccattcagacagagtatgttcgaacagatcgaaacgcttacgcccatttgcttgcggcctgacaaaaggttcaaccatttctaaagcggttaaaactcgattaaggtttgaaccgtcttcatccatcgcgatccgcaaacagtattggttaatgtccggatccataccatcgatacccagaccgatagattcgaaaaattttgttgccgcgtgataagacacactggaagaacgatattccaacatcacggggatcttttccccgtccttgacgttgttaatgatatcctgatcgatgagttcaatcaggtctcttttctctttaatcaacgtggaaatttcttcttgcagtggggctatctgtgcatgaagttcttttatccgttgatcaattacggtcacttcgaacgctaagtttctcattgtacccattccccgtttttgtcaatgtacatgatccaatcagcaaccgcccaatgggaagtattgcctttcggagtcgccacgatgtaggaaccagctttaaacagtacgcgtttagtttcgttcaggatcaggtcgctcataatgtattcctcatttaaccaaagtgaatcgtgattcataagcatcgttcgggcgctcatacacagtatccgaacttgtaatgacagtgtacacggtttctttcacaagatccatgattttctgtgattctccccagacattgatactaaaataaatcccatttttaggaataggattgtattccatatcataatacatatccatgagttcacaaatgaacaggcggcgctgttcgttatcatatgtgaaataaatgttaaaacaatcgagagatttactcaaagtaatctctttgataacgatgttgtcttgtttgctaaaatgatcgcggattgcttgcacacaacgcaacaggttagggtaatcatatttttgtgaaacaatgacttgatgtgaaacgctcataatgtattcctctcaattagatgcactcataataaaaaagcccccgaccgaagtcaagggctttttgtcaaatgatttgtttttcttctaacagcttcgcggttgtattaaccatacgagcataatcacgggcttctttctttgtatacttgaaaccagcgttatagctcgcaagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaaccattttaaatggttttcgcatcgctcagtttgttctcgatgaattcagcaagattatagttcgaaattgatacgttcggatcgtatagtgcaacgatttcatcgaacgacaccataacagcccgtttaaagtaaacgctccagctagtcgtaaagatttcgctgtgatcaaatccacaattaggactgaacaaggcgcggtattggtatccgctgtatttggtcagacggcttgtgctgtgcgcgttactggtgatcaggaatttccctgtgtgagtctcaaccacgaagaaataacccagacgttctttattgtccagcatcgtttcaaacttacgattgttttcttcgcggtcaacacgggtttcgatcatcttccagacctgttcatattcaggccaatcatgctcgacaacaaccccttttatgggttctttgccttgctctttacgatagcgatcaattttattcactaccgcagagagaagcagtttgtcgctatcacttaacgcggcatcaatatccgcatatttaaacactgcataacgttcttcgcgtttcatactactacatccttatcacagaccggacaacggatcacacgatacacatcacgaccgccagtgtaatcggttgataccttttctttaacatcctgtgccgtgtatgacagaacagcaccacaacgacaggtagtttgttttggggtaatgcttacaacttgaaccataataacctcacaagaatagtttcacttcgctaccgcatttcgggcagacgatatgttttttcacgatgtaatcagcagcacggaagaaaccattataaaacgcttcggttctcttctgtacatcagacagttcatactctaacccacttttgcagttagcgcaaacggtaattagctttggactaacaataacggtgatcatgtatacctcacgaaaaagggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtgtttcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacatatttgtcaacttccggttgatccttaaacagaatgttcaggcttgtaatacatggttctacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacgagttcaccatccgacagaatgtattggttcgggtaataatcgccgtcaggaagcgaggaatagcttatttgggctacttcgccaacatatcctaacacctcgacatcatcccagaatccagggatatcgacatagccagaatacaacacatcgctatctttcagcgagtcatcgcccgtgtattgttcaacaggacagcccttagacatcgcgatcaacagcatgttaatatcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttacttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacgtagatattcagtgtccctttagactgcttgatgatatcgaaagccgctttggttttacccgacatccgacccatatccagcgcagtttcgaagatagacaccccgccgcattcttgcccccagcgcccatcaatgattcgcgccaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcacccgtgatgtgttttgagttcattgtttgagatacacccttacggacgttctcgcgctgttgttctacagtacgcagaccttcacgtacaccaaaatcaacaggagacagttgcagagcgcgttctacaactttcaccagttgaggtttaacacctttaaggttgttaaggcttttttgactgaatttaaacataaatcacctcttgtaaaaataccctgtttgggtacacagggtatttatggtttaagaggttcgataattaataatcgtaaagatcaccgaagcattcttcaaattcacgtttacgtttcatctgttcttcttttcgctctttcatatcaggaggaagacggtcttcattgacttcatcaatgtaagcctgtgcatcctctttggtcaggaagaaagcatggaagttatatccgttgcgcccattcatactacggtcttcaagagagaactctgtgtgacagtcccagtctttgtacatggtgatgcatttagcaaacagcccgataccgcgatgcatatacgggaatccagtaacaatcatcttgctacccatttcagccttttcgccattcacacaaaatacttcatacatgatcgcaccaggtttcacatctttcttgagagcacgtttttcaaaagcacttttcataatgtattcctcacaattagttttcatatacagattaccacaatctgttttgatgtcaacaaggtctatcgtttttatttgggaaagttaacgtgaacaggcgatcgtgtaatccctcgatccgctcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagaaatcgcaagcctgttcagcggtttcgaagattgcagcatcatagaagccgtgttcttcgttaccatctttattgaggaacacaggaagccagctttgcggtttgtagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagagcacaacaacgacaaccataaaaatacacgcaacaattttccacataatttatactcgtttaaggttagttttgcaggcttcgatccagcctgaatagaaaggggagaagtcctccgctacacccaaacaaacggtagtatgtccgaatgggttcggtgttgttactttactatcgggattgatcggaagttcactagccccaacactggtcgcaaacaccataccaccagttacgtaaatggtttgaatatgcccgtaagcatcgccaggccacttgaaacggtattcagtgttccataccttgacgttgtacacatcatattcatcgaacagaggatcgttgccctttgtcgcttcgtaaagcgcaccgcgccattcatacagctttgcttcgatgtcgctaacgttgatctcttcacccgcgctcaaatcatcaagcactttctcaagggtgcggattgctccgcttaattcacgatcgagtttcatgatttaatctctttaatagaatcaagttttaaccgagcatcgtaaggcccgaaagcgttgccgttatggtcgaacttatgttcttcactcttccagtatttgccggacttcatcaaaggaattcgtctacgccctgttttattagaatcaaccattcctgtatgtgtgaaaatcatacaataccctcttcttcgagcacttcccagatcaaacgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacggcgcgttttaaacgcgctcattaattcatcgactacggcggtacacttcatatgcttcatccttttcctgtacagacatccgattatagcggatctcttcgcgctgttcaacttctctcacggcttcggctttcttttcagcggtcagtatgtgatgtactacagcgtttcggatttcccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgttggaatgtcaatagataccggaaccattcgcatcgttgaatcattatgggattgataaatcatcagaatgtgatctccgcaaactgcattctacgctcaatcgcatggatagcgttatcacgctgttctttgttttcatatccagcccaggtaatcggggttgaacagatcaggtgaaaagtgattgctgggtgtcttttcccttcaacaacgattgttgcatcatcttcgatccaggttacgtgatccagattcaccggatagtttcttacggtaacagtttcaccaaccataggcgacacatccagaatatcacgatcacgaacgtatgatttaatacgagatacgattaacattatttcaactccactgcatatacatcggtttcaggggctttgtgtacgcgcatatctttaccacataccgcataagccggacagttacggcaaccgttatgatccttgttgcccgtcagttctttacggaactgttttgttttcgggtgttcccagatatccttcacaaaatcttcggcttccagaacatccagaccttcttcccagccaccttcaacccaacgttcggtaaacgagcaagggaagaactgaccacgttcgttgatgtaagagctaaacatcgttgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcccttttgtttcagtcccaggaacacgatcgcgtttacttgtttcaggcgcggatcattcttcacggcatcaaccacgttaaacgcgtcatcataggttttcgagctaaccatgaaatgcaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcatacgccatcatatcgaacatatcagggtttgtttgcccctgtgcatcagcaccgagtgcgcattgagtcagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgagttcgtgttgcatcattttacactccgtttcagtttacgttcgtcagccagttcttttttgtaggttttgatgtacttcccgttaaggatgcgaagctgttggaaaactttgttacacaaagcacgtttcgctttgtattccggcgtattacggattgattcgatcgtcatacccatttcatttttagggtaagcgctcaattccctgccgatctctctgtgccagttgcttaactgatcacgctgtgctttgtactcttcaaaagttaacattataactgatctccgtaatctttcgctgcatcttcgggggttgcatccagtcggtaaagctcaacagctaacggactgggtttgatttcgcggttcaggatctcactgataccgcgaaggaactcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcgtaaccccatgccccactgtactcacatttcacgttccggtacttgatgtaaactgctgcaacatcttcttttttgtagttccggcttttgtagatgatttccataatttcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttgggtatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttatctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacaaatcagagcgcatcatattgaactcaatattgttctgttcaacgaagttgccaatcattgatgtccagcccatcaccaggttatatccgtcttcggataacccgtaagccaggttaaccctgatacaacgcttatcagccagttctacgctgatacagttacttgaatgcatagaattgcatgggaatttgctaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaatctgaaccagccacatttcgatgttcggcgcgtaagtaacgtttaccttatgcatagtgcggtatttgtaagcggctttgtacgcatcgagttcagtcggaacacagaaagagaaaccgttatcatagcgttctgcgttagaaacttcacaaccaactacagcggcaatgtttttattcatgttcatgatattttcctttctctgtttcgtttcgatgtgtgtaatataacaaagcccctgcactaatgcaagggctttttgattattttggtaatttttcgattgttgctttcaactcattgattttattaaagagttcatcgctatatttcatcaactcactacggcgtttttcggcccacttgatcaggaattcaggagaatctacaccatacgtgtaaccttctgcactcagttgaatacgagcacgggaaccataatcaacagaactttgttcaatgagaaacttgaccgcatcaagcagggctaaatcttcatgacttaccatgattccttctgcctttggaagatccacaacttcatcctgaatgagttcacggcgggttgtttcttccagtgtttcatgattctggatcatcgtttcgaccggatcctttgccacggctggtttgttttcacctacttcttccaaaaacatcaacatccatccaggaattttagtccggaaagaactttgtacttcactggtgcatgaatttcccagaatgtggatcgcgttaccatgcatatcagctttattgatatagataacgttctgctgttcctgtcggttgctaccataagaaaggaagcggcgtaacgatgtgttatgaccatacttccctaaatcgatttcagccaggcaatcaatgatcccacggttagaaaccttgtaacgtttaccctgtttgaaaaataacgattcttccaggtgagtaggggtaaactcttcataaagaacatagaattctttaggaattttgcgctgaaccagactcagtttacaattattagaaggaacaataacagcgtgaatgtttccttctgcgtcacacatagcttgcattacttgcggatagtaaagatggtctttcttgcaagtatagctatggatacgactctgccgttttttgaagtaccatttaccagtttcaaaaggcgctgttgtaaaattcattttgcattctcatacatagttaaaattgcttgcatatgttccggtgattgtggaacccctgcaaagttcactttcaaaaagaaattcaaccgatcttttatgttgcactcatcgagtccaagcgctggtaatgaaatgttttcaaaagcacgttgttcatgtctttccatttcaccccaaaacaaacgggaaccgttaggcatcggtattccaatttcattgttccagaatttcatgatagttgtcaagcgttgttttccgtcgatgacttctacccatcgagattcgttgaattcactatcaaccgcgatcgcgatgataccgcaaggaaacccagtaatcaaagtcttcatgaaagcatcttgctctttctgcttccacacgtagggccgctgataggacggattcagatccagatcgttgttcttgaaccagtgaatgtaactaccaaccatgatcgcatgatcgcgactttggaaagtttttaactcacgaatacggtttcttacaatttcgtctgtcattataaaatcaccatccagtatataatcgtaatcataaccgctacagtgaaacacattgcagcgtacacccgcgcattatgaacctgtgttttcaattctgcgatctcttgatccttttcgctttcaaactcttcgcgagtaccataatacccaggatcgttagcagttgccaatctaaccgcatctttttcaaccagcgttgcataaccgctttttatttgtgtcgccccgtaccatccaccccgatcgttgttaatgatcagatgatcgcctttttcgttatgctttgattcaccaacgacaataacccgcttaccattcataatatgatcctcaaaggggccgaagcccctattttgcgttcttctgtagataatctaacagatttccgctttgatgtaaatccaaaactttagaaaacttctctgcgtttctttcgtttgtgagttcgtcgaaatgccatacaccatcatcagctattaacgcgccaggtgatgaacctgtttctacatcacgggaaagcgcaagccccagagggtgtaagatttcgcggttaatgcgccaaacaaggcccatttcagatagagtattaaaatcgacgtatttcatattatgcctttggtttcacaccgtaggccaacataccaaaacgatgatcattatctgcatctttaaacagaacttcgttaccatcaatgcagatgacctttgcttccggatcgatgtatggaagcaaccacaaagggatcaggcgtaggccgctatgttcatcccagcgactgaaattgagttcttccagttcatcaagggaaagctcattaggatcgatataacggaaccatttggtatttttgaggcggtcggggaagtttacaatttcttcatagccgaattcagcactccatgaagagtaaatagtgacttcggatgctttggttaaaacagcatcgcgaattgatttgcagatatcgattaaagtcagttgattttccatgatatatttctcatcttgctaaaattttaggcagtagttgccccatcgttttacgtgcatgtgacggaatctgtgagatcgggacatatttaaaatcatccatttcacgtatagtccgtccgttcttaacgaaagttgatgcacaatagcattcttccgctactgggtaatcttgccctacatagaggaataaagcaaggttttttgttttcgtgtaatcgagaacacccaggctaaccaattcctccgcgaacacttcaaatcctgtttcttcgaagcattcgcggatcgccgcgtcaatatgagtttcgcccttttcaacatgccccttcggaatatcccaatggggcgtttcagtggcatggcccatcaacacggcaccatctttaacaaagataatacccgctgatagttccatttattcacctgcaaaagcgttatcaaatgcttcaagtgcgttgttagcgcgagcactggcttttgtcacaccagcctggagattttcaaagaaagtacgtttccacacttcgcggcgaatagattcatgttccagactgtttttgtgatcactgcgaatctgttcttccatgttgtagcggtacagatcgagttctgcgtttaatttctgttctaatgcctgtgcaaatacatgttcaatattcatttcgtatagcctatttcagatttaaggttttcgagggtggagtgataaacaacactcccttcgtgtcgagtataccatacttttccgttctggttacactcattcattacattttcatctaaaccagggatcggcttcatgctgggagaaaacgcgatagacatcatttgttctgcgctatcagcaaacccacaagggaaaacagatccagttggtttatcaagatacatcaactctactttagccatagatttcttcgaaatcctcacaatcaggcaaatacgtttcacagaaggtgcaaagcgtaaagaatgcaggttgacgaataccaggattatccggtagatacatccagaaggtgttagcaaacacgatgaatgttttcaggttttcggtggtaatttcgctaacaccatcatacccggattgattgatcgcgcgttgcagtggcacctcgtactgttcgcaatagtcggcataatgatcgcttgttacaaggccattagccattttaatcaaatcgacgattttcatgattttacatattccactttaacaggttttgcaacaaatttatctttggtgcgcccatgaccattacacaggtcacattctttgttgaaatctttcatatcttcgacccatccagaatctggcaacccagacggatatgcgttataacgaatggtttcataaccttttccgttgcatttcgggcaaacatgaggacgttcttttttagcagactctgccagttcgcgaagggtggtagaactaccataagcccgacacatgttttcaaagtcttttaaagtcattctataaacatcaatgacgttatattttttgccggatggtttagccataatatatttctcacttaaagaatttttttgatgaaagagatagcaaggccgataccaaagaaaattaagtaaccttttccgtcaccgtgcgccaaaacatagagtgagctgccgtatgcgatgagttctgcgatgttcattaagtttctcatgatatcctcctttttctatattaagtatcttaccataatataaaccaaagtcaacaacaaagttttatcaacccacttatcaccagtcattagtaatcccctacaggttgagacgccgcaacactcaggatcttgaaagtgcaattgttccactcacaatacgtttttgcacagtgaacacttcctttcataacaaacccgtttgagaaaattaaccagtaaagtttcatgatagcctcctttgtttcgacaaggccaatataacaaagcccctgcacgaatgcaagggcttttttcaatttttcagcatccaaagttgcggaggacaatctttagaagcgattagacgatccaggcgggacataacccgacgataaccgtcgtattcaaaattaatttttggtggaacgtagttgacctggattgtttttctgttagctaaagaaacatactcagggatcaccgttcgtaaccgtatagcgatcactggcttctcttcgccttcgttaaagaacatttgaacagttataggacaagcaaagattttaccatttacccgacgataaacaataacttcctgtgtcccttctgttttggccttcacagcgtaggttagaacataacacgaataatgatttgctagactcatcatgatatcgcgataagtttcaatatcttttttaatcgatactgaacggtctttaaagcgatctgaaatgtggtcagcagtagccgctaccttgattgtataccagtcacctaacgcgctagtaaacgcctcgctaacttcttttcgtacaccgttaacaagatacattaaacgtgttctgttcatataatcctcactgatttttgaagtattcgatctgacgcaaacgcttttcagcggcggctttcgaattgtattcaccaagttcttttgtgcgatcgtgattcaaaacaacccacttatcgccacgctgttcaatgtgttctgtaatatcttttaacgacttatccagatccagtgattcagcctcttcacagataatagtcaaatccacgggcagtgtcaacaaccttttcactccgctgatatcatcaagcatcgaatcgtatgcaagggttacgtgcggcttgtaatccggataatcgtatgttgcgccagcatcaatagaatctttgaaacggctatgcaggtattcagattccaggatccctacaatagtgctaccgtattttgtgtcccacttttcaacatcaaccagtttagcaggttctgtgatgtcctgttgcgggaacaaatcaaccgttttccggctgtatacgatcgttgtatgcatcttttcggctgaaacagcattctttgtgatacctaatgtcttttgaacatttttcaaagcctcacatgaagcctgatcgaatttagcacacatgtagataccaggatctacaacaggttttgtgatttcaagaaatgatttcataaaacaccccaataaaaaaggggccgtagcccctttgtaataaatttgtttttacgcttcttcgccaaaggcggcttcatcttccgcgactttttcgacttcaacggaagggatcagagcggataccgcgccaattaccgcttctggggttactggctggcttgcgtcaatacccagtaccgaacacaggtcggacagaagttgacgatgaacagagagttcactttctttttgcgcgataacttcgttcagatcgaatgcgcggcctttcagtaccagtacttcattttgcagtttttgaatatcagacattttattacccattgttaaaatttaaaagtatcgagcactttgctctttagttgtttcaaagtaccttcgttagtgatgatactatctccaggttgaggtgtcaaacctttttccgtggaatgttcatcaacaattccggtatcctttacaataaacacaaacttagcacctaagcgttttaggtatttgtattcgtgttcttgacgacagtcagtgaccagaagatggttgtattcgtcaccagtatatttattgacgaatctttccaacgtgtaacgaacccaaaccgtgttatcatacttgcatacgatatcagttccaaacacttgcatcaagcgtctgatactccagggagtatcgttactcataatcaggttatcaatatcatcaggactataaacaatattgtatccacgttctttgaggatttcaagcccgattttgaaaatatttagaacatcttcattagacatcacaagaggtttctctcgatcgcctttgtaaaaaatagcatccggatcagaatattgtccttcaatcatattgcgaatgtatggtttatcgtaaccatatcgctgcattgctattcttagcgttcttttgataccaaatgccagtgcttcacactgaacatcattgtacgcctcttgaataaatttagcaaccgtatctttaccagttcgcttttttccactaatcacataaatcattagctcattctcttttgagaagtgactacttttccgtcaatttcaacttccatatgaaggaagccaaaagttgccatacacgtaaccgcttcatcactatcgttagtataacccaattcaacctcacccaagtttgttgggaaggcaccataaaatctaaatgtggcgatcgttttcatctgggagttatccaggatatgcacagcgaatgattgcttaggatcatcccacgcaacagagttaaactcattgtaatcgtttgtgctcaacatccatatgtaaatcccaagatacgatctcatttcctcatcgactacaaagcggatcatcaaaggatcaaactcaaaagccgaaccaggtactttacctcgaaccatcatatttgcaggaatatcaactgctgggaggttcattgatggtagtgtaaccccttgaacttgtaaagtcaaacctttcatgtaactgttatcaggaatatcaacccgaaagtttgtaggtgagatttggtttaaaatcatttctgtagacataggatctcctttcctctatttagcggggaacgggatcaaagcggcctgacggggtaatataaaaatttgaagaaaatgcttgaccttttaaaatctttgatctataataattattaattaaaattttatcaaaaagatctaacaagatcaagtaaaatttaataaataatttatcaaaaaattttagatctgatcttgaattcataaattttatgatctataatatattaatattttattttatcataaatttttatgaagatcaatacttagatctaataaattttatgctttttctgaaaacttttcctttaccccgtcactaaatactggtactatgttcccatattggaaatcaggaaaaacaaaatgactcacttgaaaaaattcaaagaatttctgaccgaaggtaaaaccctcgctcgtaccgtagcacgtggtcaacgcgctaaaacttccgataaacattcaatcggttttcttcacttcaaacatggttctgatttcgaagttttagcaccggattctcacgatctggcatacttcggtaaaaacattgtacgtttgaaaggtatgactactggtaaagttcaagcggcttatgtcgattgggctaaaggtactgtttctttctacagtggcaatccggatgatgatctggatttcgacaaaccagaaaaattcaaagctgctactctgtatgaagaggcggaagaaaatctggatctgtataaccagttagcagaagatttcgaaatcgagatccctatggatgaagctctggtgaaaggtaaagtttacaaactcccaagcaacgatatgcgtcttctgtacactgggcgttctaaaactaaagcaagcggtgaatatgcagtgtttaccgtagtcgatgcttccggcaaacctcgcctggtatctggtaaaaaattcacccaggaatataaaggcgatatggtttctaaactagttctggttgaatccgaagatctgaatgaagcggctaaaggcattcgcgaaaaagttattgctgtgatggtgaaacgcgggtttaacgaaaaagatgcagaaaagatggttgacaaaaacctgaaagatgctatgaaagttagacctggtgcgacccctggcaaacttgcagaaatagttagcatcctgtaaaaataaagccccttcctttcggttggggctttttgattagtatttgctccagacttttttcgcgccgtaaggtttccctttggacataaattgctgagtcggtagccaaacagctttcgcccaatctttaggggcaatctctgctaatggtgatttgaggtgtgatggtagatatgctttgatcatttctgttgcgcctcgcatacctttcacgttaccccagttaattttgagtacagtcttgttagagaggcgtttagtggatccgtaccctcgcttcaataactcttctaaaaactcctgtcgtgctctgggtggcgcatagtgcaagttcaaaccatagaacactaagttacccgctttcgatcttccggatcctaagaaaatgatcagtggaaatctatcccaatacggcagggtgtctttatattttgcatcatatgcaaacgtgtacaggcgacccgttgctggttttgccacacggtgtgttttgatactggttttgatgaaattaccaaaccattctgttgaatctttctgtcgctttgccgctgatacaccaacagtgatctttttcagactattacggaaatcgttgatgatctcgatcccgtgttttttacggtagtcattacgttttttacgggcttctgtctctgcggaacgtcgttcaatctcatcatcaatctgttttttgtaacgatgcattgactttgtgaacgttgcgtagtttaatccctcagaatcggcaaaacgtttagcagaaacacctttcgttcttgccttacggaatttgatccccagttcaacccaatcactcaatttgcgtttgggtggtgctttgggtttatcctcttccgcgatgatctcaaactcaaaaataaaactcatgtttccctccagggattactgacctcgccacccaaaaacttttttgagtgattcttctgttacgattttgaactgccagcctttttgacggcatagctcatttgcggctttccacttatcaatattaactgtataggtgtaaagagcatcaataaatttctttttattgtgtacgttgttgtttactggcttcggtggaggcatggtttctttaaggggcttaacctcccaaagatatgtagtaccattttccatttccacatagaaatccatgtaatagcgtcttctcttaccgtctgcattgcagaaatacgggatcactatacattcagaattccaacgttttacgtgtgggtttttatccagccacttcataacgtagcgctcccacgatgacctatacgtaatctttcgcggatcgcctttatacttctgtatgttttcgggtacaaacgaccctttatacgtctgtcttccagccattgcgtaaatcctaaatagaataatataacgtttagataggggaacttatcgtgctattttcatacttcccgcctgttgattacaaaggcacccagacaactgatattttccgagactatcgattttattttaatcgtgtgattggaaaatataaaacccgtagttaccagataacaggcacactacgacctgaacaacttgcagaatcattatatggaaaccagcaatactactggatcctgttgatgcttaactctgtttatgaccctttctatggttggatctccgatcaggaagccgcgtatcagtgcgctatacagcgttattctgaggttggcggtgaacaggttctgtatcacgtagatgaaaacaacaacaagtattataaccttgtcgaagaccccaataaccctggtcattggtatgacaaaggtgacaaaccaatgctgtatttacagtatcaaggtgtattagctcctgtagatatttatgaagatgcagtgttgcaaaatgaagcaaaacgaacaataaaaatcattagtccgtctgacatccaggcgtttctgaatgattttattaaagaaatggaaaaggctaactcatgaaattaggcggaaatttacactcacctttctttgatggggtggttgaaaacgttgatgatccgcgcgggttgggccgtgttcaagtccgtgtatttggacaacacccagcccaaaaacaaaaatccgatgcaatcggtgttcctgttgaagatttaccctggatgatgcctattcaggatattagaagcgctgcgatctctggtgtgggcttctctccaactggtatcactcgcggatcctttgttgttggttattggcgtgacaaatggcaccaagatggtatgataatcggtactgtcgctggtgaatatgtcgaacaaccagacacacagaaaggtttttgcgatcctatgggtgaataccctcgctatgttggtaacgatgttaactcccttgcattaggtggtttgaaaggcaaaggatcatcaagtgtcatcattcgtgattcaaacacaagcatagcagtaaacccagacgatcgcccactggatgagataccagaagataaccgccctgatacgggtggatttacgatcgaaaagatgctcaagcaggatgaggggatccgtacacgctggtatacagacagtgaaggatatccgacaatcgggatcgggcatttgcttatccgcgaaaagactcgcgacactgcaaaaattaacgctgcgatcagtaaagcggtaggtcgagaagtaacaaacgggacaatcacggcagaagaggtatcaaccttatttgctcaagatttagccaaagtaagatctgatattcagagaaccactaacgtccgtgaagtgtatgtgaacctaaaccgtcctcgtcaaatggcgatcgaaaacatgtcgtttcaaatgggcgtcggcggtgttgctaaattcaccaataccctaaaagcgatgaaaaatgaagattggcaagcggcttataatggtcttcgaaattcactgtgggctagtcaaactccaggccgttcttctcgcgtgtctaaaatcgtcctcacgggcaaccttgaatcatatggggtgcaagtaccagatccggaagggcgctctctgagtgctgcttacgctgcgtataacggtgctacattgtcggctactagtccggaagatccgtttactcctggtgatacccgtgtgatgtttgaagaaccagcatcatcttataatgcggaatatccgtataacatggtgtttgaatcgagatccggacacattcaggaattcgatgataccccaggatacgaacgatataaccgtgttcacccagcagggagttacgaagaaattcgcccggatggaacccgcgttgttaaaatcgtaggggatgattatcagatcgtgatgcagggacggaaactcaacgttaaaggcaacttacaggtagttattgaaggcgatgcgttcatttacaacatgggtaacgttcaacaaacggttgatggtaacgtaactgaatttgttcgtggaaacgttcaacaaacggttgaaggtgagtacgttggcctgattaaaggcaatgctgaactaactgtaaacaaagatgcaacagttaacgttgatcagaatcttaccgcaaatgtgaaacagaatgcaaccgttgctgtaacagaagacgcaacggtcactgcaaaaaatgcgaaaattgagattgaagaaacgatggatatcggtgctaaagatatcaatatcaaagcaacgaataacacgtttattgattctggcgcattaacaaaaatcactggcggcacagtacaggtaggctaacatgattatggattatgaatcaataattgatggaattatgcaaaattatcagcatccttgtgatgctgagatccccgctggctattatcggcgggttatctggcaagggcatacagaaaattatccggctgttggggttgagtgggataccgagataatcaaaatcggtactcatctttatactcaagaaccattcggacatagaagcacggatctacctgttgtcaattcaccaggaacagatccaaataccggacaatcaacagggatccttgttccgaagattggctattatttcaacactcaagcagaaattgatgcttacattacatctattggtgcaactaaaatcaatggtggtaatgattggtatggcgcggatctgtcaaaatcaaacctatacaaaaaccctggcgaactggctatgtataaggtcgaaaacagtggtgggtatctttccggaacaaaccctgtatgtgatgctcgcatacgtcagacgtataatcaggacactggcgcattcaccaatattgattattattggaatggtaatcgtatagcctatatgaagcatgatgaaacaggggcgcatcaatgcaaatatacgggtatgcaggttaacaccaacgcagatacaagcattcctcctgttcctcctgcaatgccttccacttatggggcattaccgagtgaattaagccgtgctgatatttcgtgcattccggcaactgttggtttcgcatatacaaatatcagtgatgctatgttacaggcatggaacgaaacccgtaatacgttcaagctacagtttaacatgttaacgggtgctgtacagaatggattcgggatcgcgacaatgtttgatggtttatccgtatcgatggaagaagtaatggcgggggcgctcgcattgtcacagcaagcatggcaaactgctatgaaagttttcagacaagtgattagcgctgcatttaacattatcggtggtgcatggggattgattaatcagttcttgcctcaagtaaccatcttaggtgttgcgatcaacatttacgatctggtgtttggtgataattctgttcagactttgaaagatgcgtttaatgcaatcatcaaatccggacaacaaacatatgaaaccgtcataaacgcaatatacggggccataggaagcgcatacaattactctgtggaatatgtcaaagctggcgctcgcgaccttgtggatgcttgtagcgcgttatttgattggtgtttaacgatgttccaaaacggttgcgttgcattaatcgacttatacggtcggatcatgcaaacatgggctatccctccggaagtcccaaacccgttatggtctgcggtgctggctatccgtaacatcatgatgcaaatcaaaccacttgatataattctgggcggtaacttccctggattcactgcaatggatttgtatcaacaagcacaggaaaaagtcaaggcttttgttgatgagtcatacgaacagatccgagggctttatgaacaggggcaggaactttacaaaacgttaaaaagtcagattttcgaacgtgatgcaattcagagaaaattcaaccagtacttaaactggatgtggggcgctgtaacagacgaagcaacagcggcttatcaatctgcattggatgctgcaaacgctgctgtagctgcaacacaggccgcgtatgacgctatacaggaacagattggatctctacaagacgcaatgaaagatacatacagcatggcgatggaagaattaaagaaattgcctttgatgagtacaataaacgagtttttaggcttctgtggtgtcgcatttgacgatcttctcaagtcatatgaaaatgcgattactggtgctcagtctctgtacaaaaatttcattgatagttcgcgctcgtttaaagatcactgcaaagtaatctataaccaaatttgtacgttggcgttgagtaaagtcacacaatatgtgaataaattgctgtctctcataggattagcaatcaacttcggttcgattagtgtatgtgttccagtactgaaatactaaatagtcgaatgatcaagaggaatttataataatggctactgctaagactaagactgtcaaaaaacagattaaccaaatccccgatatctttatcgggggtactttcgaagaaattaaaacagatctgattgattggctgggtggacaagaagagtttaaggattacgatttttccggctcgcgaatgaacgtactgatcgaccttctgtcgtatgctactctttatattcagcagatgggtaacacagctctatttgaatcgtttattcgcacggctgcattgcgtagttctgttgtacagtctgctcaagaactgggatatatgccagattcgcgcacggctgcaagtacagcagttatgattacggctgctaacccactgaccccaacatcgatccgtatcccgcgcggtacaaaattcatcggtactgtaaagaatacagacagttattcttttgttgtatcagatgacgttgttatcgttcgtgatagtaataacaactatacatcaatgctgaacctggtgcaaggccgtttagttcgtactgaactaatttatgacggttcgagtatcctgatccgagatccaaacattgaccgtagtcaggtacgtttaactgtaaacggcgcacaatgggacgactggacaaacgaaagcattgtaaacgcaacaggcgcaagcacgatttactacatgcgtgaaactgttgatggacataccgaagtttatttcggtgaaggtgaagcaagtcaacaagtggcgggtggcgcactaaccgccgaatatatcgggggcttgaaacctgctaatggttcgactatcgttattgaatatctgtcaaccgatggggaagcggctaacggtgcaaaagattttatctatgtcgatacattaaccaatattagcatcacggcgattaaagagaacccaaccaacacccctgattatgtcggtgctgatggtggtggtgacccggaagatatcgagcgtattcgagaactagcccctgttatgcgtgaaacacaacgccgttgtgtaactgcatcggattatgaatccttcctgtctcacaggtttggatctatcatccaggcggtacagtgctttactgataacgaaaaacctggttatgctttcatttctgttaaaccaaagtcaggtttacgcctaacatcggtacagaaagaagatatgcaaacgtatctttcgaaatataacctcgcgacgatcaccccgtcgattatggatcctaactatctgtatattgtgcaatctgtaaaagtaacgtatgatatcagtaagttgacggaatcagaggaatggttacgcggtcaggttatttcgtcgatcgactcttactatactgacaacgttgaaattttcaacaaatcgttcagtgtatctaagatgttgacttatgtcgatcagtctgatacttctattatcggttcggaagcagatattaaattgctccgtgaaattgacaactattacagtgctcctatgtctgggatccatttcttgaaccaggtggaatcgaaatcaatcatttccagtacgttcaagttcaccaacgaagaagacgaaagttatgttgttcgttatgcttctacggaaatggatcaggatggtaacgcaaaaattgtaataggcccgttcaaggatggggatatttcgatcgctgcttatacaggtgatgactttgaaaaattaacagatgcaggaacccgtaataaatattacgaagtaggatcggtgtctcattataccgatttcattagctttgatctgggcgttctgaacgtatccgccgatagtttcagtgctgcttatatcgagctaaccgcaaagcctctcgaagaaaccatttttactcgcgatggatcgttgatcgtgtttgaaaatgacctacgtcctcaatacaccacattgactatgaatcctatcagtcaataatcgttaacccctgtcttcggataggggtttttctttttataaatacgtgatatacataaccgcaaatttggagaaatataatgattaaagcgccttcgattacgagtttgcgcgttgataagctggctgctaacttcgtttaccttaaatgggatgatgttggcatggatttctattatgtggttgaattggcccgtagccgtgatatggacggaactattattccagacgaagagttaatctggacgcagttgggttatagctacgaaaacgaatggtttagcgatcaggttgccccaaatacacgttataaattccgtattcaaacaactcatgaagggtttgaaccttctgattgggtgatcagcgatgaattatggacgtttgatgagaacgcctacgcatatacaaccatgcgtgaattcacccctgctgattcgtttatcaatgaaaaattcgccaaaaacaatcgtgattacgtcgattttaacgatgatgttattatggcttctctgatggttgaggattttgtatactctcccctgtattctgatgtaagccagatcagcgataagatcctgaaacaagaaagctaccatgaaattcaagatcacatcgaacacgtttgtaatgatatagatcgcacgttcctggtatactcaaacggattgctttacctgtttgaacgttttcagaatatggctaaagtgtcaaatgacaaaggccaaacgtggtattactacaaagcattaaacgatcgtgtaggcaatccggtttcccgtaccgttgcttatcagagcgctaacactacgtatgtgttaggatacgatcgcatattttacgggcgcacgtcaacagatattcgttggtcttctgatgaagttcgtttttcttctgatgatgtaacgtttgcgaagctggggaaccagtcagggttagattttgatgttgattcatacaacacatatgcgcgtctaccgggaggagtgtcgaagtatgccgaagctatagcttgttctaatgaatggctctacgtggctgctaagaacgttatgcgccgtattgcgttacgtaacacaccaattgatactgatcctggttcgccgacctttggtgaacgtatttttgatgaagtttcatataccatcgtaccaggaaatgataaaattgttgttaaaaaaatggacgtgctgaatgaccgtctatacgttctggtaactggtgaagttaaaacggcgatgatggatccgactgtcaaagctaacgtgatcccatcaaacgatgctggcgtttatctgtgggatgagaatgcaaagacgtttacccgtgtttatggtaaaaccgaagatgaacgtttttatatcactcatgaatataccaatatgtcaaccaatggcgatgaagtttacatttctgttggtaactacaaatatccaggcactttgccagatccagatctggttgaaaagtatccggaagatgtgcattcagcggtgaaatacgatcttgttcctggttatactgcgagcatttcgattaactttgctacagttcgtgcaaatcagaacgatcctacagtatggaactttgggccgcaagagtactacaatgaagcaaactttagctggcatttccgcgataaggttagcacatggatcaccaatgataaccgtcctctggtggtttatccggaaaccctgtatactctggttactgatagcgcgtctcctgcgtcaacgattcgtgtaaaccatgaagtttgggacaaaggaacagttactatctacttgaataatatcaagtttactggttttacgaagtacacaaacggtgttctgttgtatcgctcaggtggtaggataattggattctatgaactgtcataccgcgcaagggatgaactcactattttctggaaacccgataacactttaatggtggcaagtctggttaatcaggaacgtgaaaacccatatacgccggatattgaacctggattaatcgaccctgatctgagtcacatgatcactcgttttgctccgcaaagctatctggacaaccaacagttcgaaaaatttggtgaatactatctgcaatacatttcgttgggaagcaacagttactataacaaattgctgaacctcatccggaacaagtatccgagagagaaaaacaacgttgaatatttgtggtctgaaatcaaccgccgtaacatttacctggataaaaccaaacgtgaggcagtggttagatttttcgaatcacgtgcaagtgatttctattcaacaaaagggatcgaagcaagttatacgttcctgtttaaattgctgtataacgaagatgtttccgttgagatcgaaagctccaacagtctcgaatatgatattttggttagttcaacaaatatcagtcaggatatcgtaggccggacgatctatacaccaactggacgcgctaacgttacatacatcgaacgtgactatgaaaatggtcaattgcgttggtcaatgactctgcataatgctcaaggtaactttatcgaagggcaggttgtcaagtcagaaaaaaccaatttcaccggaatggtaattcgtggtgttcgcggtaaacaaatggctaacaactcgatcgactatatcaaccgtggacgatcttactatgtgatgaaaattcgttcaaatctaccgacttcccgttataaggatgacgtattgaggtttgttcatccggtaggattcggctttatgggtattacgatgttaacagtattcatcaactctggtttgtcaatgactcataacgagacaatcattgatattctgagaaactaccgcttcgatagtggttatcctaagttctggcctgatcgcattgcgagtatggacggtaacggaaaccaacaattcgacctggttactggtgaacctctgtacaccgtacacccgcgagcgggggaaccttttgatgtacctccggaatatgacattgaagaaaaaccgcttaacggtgttcttccttctgcgcgacggttcgatcaaagtccgttgttcgattgctcaggcgttaaatattcacagttccgtaatttggtggataaacgactgaaagatgatgcaggaaacccacgtgatccaaatcctccatcacagattaaggtaggaaattaaatggcacaacaaaacttgtatcggtcggtaattactgcaaaattccgaaccgaaaacttgatgaacttcaaagatatgatcggcgatgccgccgatctaaacacgatttacatgtctattggacgaactgaatcgtggtcggataacgaatccgaccctaacttcgccccgccatatccaaatgatagcaccgatggtgttagtgatatgtggacgcatatgatcggggctactaaagttcctggtgatatgatagatgcaattttaccacgtaaagactggggtgatactcgttatccaaacccgaaaatcttttactttaacgatattgttgttgtaaacaccgcaccttataaccgtactgatccgggtaaaggttggatggtttatcgtgtggttgatgttcctgatatcggttcttgctccatttcgagcattaccggaaaacttgaatgtatcaggatcggcggtatctggagtccgtctcatgaatctagtgaacctccacgcggagaagctaacgggatcgacatgggagacggttataaatgggaatacctctacacaatcccgccagatgtcgtgatcaaccgctgtacaaatgaacatatcgtagttcctttccctggcgaactggaagaggatccggtacgttggggttatgataacgtgattcaatggtatccaggacaatacgatctagtgtatcggttgaaggtgaattcaatgcgttttcgtgcatacatggattctcttttcttcccgcaatctacgcttcctggtaacaaagggttccgtcagataagtattattgtaaacccgttgattaaaaaggcaagcccgaccgagcctgaaaagaaagcaactggtgattactataatgctaacgcgcttgaacctgattccggacgtatgatttacatggaaaacagacaacctattattcgctcccttgatcagactgaggaagtgagtattgtattcgaattctaaggaaaaacaatggcttaccaaacagcaaaaaaactaattgatgtcggtgaaatcggcaacccatcaacaggcgacccgctttatgatggtggtgttaaactgaacgaaatgatcaccaacgtttataatgcgtttggtgatgtgcgtatgctgtctgcaaacgaaggtgtcggtaacatggtgatccatgctaccggatactatcagaaactaccacgcacttactattcaagcacaccgatcgaactgggttccctgcatgacatagatacttcaacaggttcgattaccgttgttcttccttctggtaaggttggcgaaggttgctacttcataaatagtacgggtagtgtctctgttgatcgtcctatcgcgtttcgtcctcaagttggggatactatcgcgggggttgcagaccagttgtatatcacgtcaccttacacctttgtaaaaatctggtgtaccaaaaaagaaggtgcggtaacaaaatgggattattctgtagaatctatgttcggttctaaaacgatgcctgttgacactacggcgcttgtactgaaagcaaacccgactgctattcctatgttcggatatagcgaatttagcggggctaaggtgcttgtatacgcagaaaacttagctggtacagttaccaaaatggcagaagttttaatgaccgtggatcgtgtacacaaaacgatttattcaacggaatacgctattttgaaaaacagtgaagatgaaatgtttacattaaactttactgtcggtgctggtgatgtcgtatacgctaacgtgcaagcgatcaaagaagatcgaattaaattcacgattaaagcaatagatacgattaaatcagggatcgcgtcatgaaacaagaaattttaataggtcagattgtagacgatggtacaggcgattacctgcgtcgaggtggtcaaaagactaacaacaactttacagaattgtataacatgctgggggatggtgagatcccccatccagcaggtgcctggaaaacttttgcgggtacgacgctatcaccaaaatttggtgaatcatgggcgttgaataccagtgcaaacaaaatcaccgtaaacctcccgaaaggcggcgtaggcgattataacaaggttattcgtctgcgtgatgtgtggtcgcgttgggctaccaacaacgttagactgatccccgcaactggtgatactatcaaaggttccccaactcctaaagatctgtttaaagattttatggatgtggaattggtgtattgttctccgggccgttgggaatacgtcgaaaacaaacagattgacaaaatcacaacttcggatctggcaacagtagcaaaagaaacgtatattgctactcagggacaaactgacttccctaacgtattcggtgttggtaatgaatacaacctgcaatcgttcgaagtttactatcgcggtaacttgctgttcatcgatgagaaagacggattcaatgctgataactcagactatggatcgattggctctgctcctggtgaactggttgcacttgatggtaattcagtacgtcttaaaaacccgtgtaacgctggtgacacgcttcaatttgttacctatctagatgggttagcaacatggcgttcgagctatgaagcgtatgtgatgcgcatgtatcagactggtgatacttctctggaaaccgttcctggtgaacagtgggtaggtgatctggcaaccaaaaaagagtttacacctgctgaatttggtgttaaccctcgcgtgttgattaaccctaactcgtttgaactgcttctcaacggtaaacaactggttaaaggcggtgacgctgactatccggcgttttcctgtgaaggtgcggaaggtgttgatgaaagtacgtgtgttggtaactctggtgtatgggttccgtcaggacaggattatagtttagtattcactgattctgtagtgacttcaatcaagtttgctcaggaactggaatccggcgacgttgtaacgatccgttggtttaacaatgatattggtactctgatggattgggaaggaactggcggtattaaagaaaaagctgataaggtttatctcaataacgaagaagaagttatattgacgaaccgtatcgaatataccgattataataacccttctcagaaaacaatgcgtaatacaggggaaacctatcaggggcgtattctggatattcaggctatgtttgatattatccacccgatcggaaccatctatgaaaacgcacacaacccggcaaacccttccgattatatgggatttggtggttggaaacgttacgcagaaggttatttcctggctggctggacatcaaatgcaacggatcctgatttcgcattaaacaataatgatttagatagtggtggtcaaccgagtcatacggcaggtggtactggtggcgatcgtggtacagaaatcaaaatcatcaacgttcctgaacttgtatcaaaagataaagttcttattgctgatgaaaatggtgctgtgatcattggtggttgtcagttagatcctgatgcttctggccctggatacactaaataccgtgaggatacattgaaagtgaatcatggtaacacattacctgataaaatcaaaactattccaccgtatatgactgcacatcgctggataagggttgcataatggcttacaaaaatatttcaaaaacaagggagggcgctcgcgtcctctctaaagaagcagattacttacagtatgatacttatggtaagttgcctctgatcggcggtaaacgttcgatcggagaaccaaacattgaccaaacaaaacgcggtgttctgtatggaaacgtacaatccgcaattgatgacctgtatacgcttatcgagcaaatcccgattaacggcgttgttaccatgactgaggatgcccctccaatcgctgtacagcaggttgagagcgtttcttttgatggtattgtacagaacatcgattcagaccaagaacaggctgtagttcacgtgtacggctttcctttcatctttgataatgggactaacgccgcaacagtttgtgaaacggcatacaacaaatttactgaattcgttgcagcggaaaaatatttcgcggaagttaaccgcaaaggtgttgatggtacgatccttgaatgtcgatttattgatagtgttccgcacccggcaacaaatatctcagaaaacggtattcgtcaaatcggaactatcgacgtagccgcaaaaagtggctatggttcatgggttaagttgggttctggtttcttacctgatgttactccgcaagtaaccgtgtattacttcaaacgaattgcataaggataacacatgagtaacaatacaatcaaccacgtaagtgataaatccatttacgtgacatttgacccaacaggtactgattggcctgataccataactaacgtacaagatgcgttggaaaaaataggtagttgggcgcgtactgatactgggcttcctatcgcaacaacttctgttcgtggtattgctcagatcgcaaccgaagctgatattgacgctggcacggataacaataagattgttactccgaaactgttagcatatcgtatgcagaaccctaaagcatcacaaactgtatggggttatacgaagtattcgactgatgcggaatctacaaccttaactaacgatgcatcgtctattactccgcgatctctgaactatgtgttcaataaccgtaaaggtacagaatcggtttggggttcttctaaaattgccaccactgcacaggcggttgctggtacagataacactgtaactatgactccgcttaaagtcaagcaagcgatcgcgtccctggttccggttcagtcaagcgcgaccgaaagctcgcaaggtttggtacaactggcaacagttgcacaggttcaggctggtacgatccgtgaagggtatgcaatttcaccttatacgtttattcgtttaactgcaactgaaagcaacctgggcgttattcgtatcgcatcacaggcagaagcaaacgcgggtactgatgacaccaaagcgattactgcgaaaaaattaatcaatacccgtgcaactggatctcagttcggtgttgtcaaattagcaacaactgttggttatgtggcaaacactgcactttcttcaaacgctgcggtattacctagtgatcgaaatgcggtaattaacggttctctttatgagaatagcgcaatatataacaacaaatatcagacatggacagatcttgattggcatttcccagtaggtgctattgtcatgactggttttcagactgaccacggtagtttgtatatttgtgatggtcgctcactgaataaaaataactatccgttactttttgagcgtataggttatacatttggtggtggcggtgattggtttaaccttccagattgtcgaggcgttgcagtacgtggtcatgaccgtgggcgtggactaaaccctaatcgtgggtatggtacatatgaaggcgatatgttgggctggcatgaacacccattacagcttatctaccagaacggcggtaatattcctaaatggcaagcagtttacgaactgaaaagcgccgaaaagaatgaccaaagcgctcgcgtatttgatgcttctataactaaagccactggtgtgggtggggaagaaacccgcatgaaaaacatcgcattaaactacgtaattcgtactcaatagaggttattaaatgatcatcgacaaattaaacccgttgccgaagatcccgtttgttgatggcgtcccagatgacgccacgactcaaacgaagattatttggatcaaaaacggtgaaactctggacggttcgccagataaagtgtcaaacactggtagtcttaaccgaactggtgtaaacatccagcagaacgcggttcagttagaacaaaataccatcacccataatgataaaatcaacgaagtaatcgatcaggttaacttgattactgaaaacattgatgctattggtgatgagagcgtaatcaaaaaagttaaccagttggatcaggatgttcgggcattaactttatctaacacccaaacacagaacaaggtagcacagttaaccctttctgtaaatgctcaaaacgatgaaattggtgaatacgatccagaaaaagatcctaaacaccgcacaattcgtaatgatatcatttacattaagaaagaagttggttcatatcctggatttaacgttgatggtgatgttgacccctcttctactggtactggccttaaataccgcgtactgagtaaccaacgtgctatttctatgcaggaaactcgcataaccaaactggaagatgattgggcgctttccgaagtaggacaactgacagaagaggtaaaagaacttcgtgctgaaatgggtgattctggtcttgccacaacccgatcaatctatgcgcgaatcaagatccttgaggatggttctattgtaatgcaaaatgaacttgatgcgattaatagttatatcggtcgcacgtcaggttcaaccagttccattaacgatcgtgtgaacagtctggaaaactccgttagttctctggctacacaaatcaatgatccggtaactggtatcactgcacaaattgcaaccattaacggtcaaatcggtacggcttctgctcagggtagtatccgttatgatattgcggaaactaaacgcagattgatggatatggaaatgattctgggtgaatccggcgatgatggattgcagggacaagttgcgatcttaactggtgacgttggtgaagattcagatcctaccagtatcaaaggccgtttgagtgttgttgagggtgaattgcgcaccaacactagcgcactctgggaactgcaaggcattgtaggtaactcttctagtggcctcgttgcaactagccagcagattaacaaagaaatctatggtgatggtgttagttccgatcctgttactcgcgctggtttgaaaaagacaacccgcaacctgttcactcaggtaggcgataacgcagaaggtaacgaaactggcatttatgcactgattgccgaccttaataaacgtgttgaggatttagaagcgttgaacattgcacaggcacttgcagatcgcgtaactatcgaagatctgaatgctaaactggctctgtacatcaaagaagctgacgctgatctccgttatgagagcaaaaacccgcctctgtcattcggtactaacctaactggtgatactgaatatactactggcgatccattgtctctaagcgtaactatgactggtggtgtttctccgctgtcttatcagtggacgaagaacggcgtaaatgttggtactaatgctaacacatttaccattgattcgctacagccttctgattccggaacctacaaagtaacggtaactgatgcaagccataaagtcatcgtttctgatgaactggcgatcactgtcgcttaacgattaacaaggggcttcggccccttttgaggatctttatgattacgaacaacccagcacaattaaaagatgaaattctgcgccgcttaggtgctccgatcgtcaaaatcgaagtgacaacagatcaggtttatgactgcattcaacgagcattagacctatatgcagaatatcattacaatggatctaacaaagggtatatcattcttaccctggggccggataacccgaaaaatattttcgatctgagtaaagaacatattttcgcaattactaaagtgttgcgtactaacatgggttcccttgtatcgatggatggtactgcggtttatccgtggtttactgatttcctgatgggccttactggtggttctctgggcggtggtggttgtgcatcacgtacctacggaatgaacgcatacggcgcggatatgggctattttacccagatgatgagctatcagcggtcaatgcaagatctcctgtctccgcttccggattactggtataacgacgacacaggacagtttgcagtatacggaaccgttaaagatggtgatattgttgttatcgaagcaatgatcagatcctttgttgatgtacccagtatggtcggtaacgtctctggatacgctacagcgggttctgatggcgaagataagccaactatagcagatatatacaataacccctacaaagctgtctcaggcggtgtgaaggctggtcaaggtacaagcgttcagggttcatcctctgcgtataacaaccgttgggtgaaagattacgcaactgctcttgttaaagaggtaaatggtcaggttctggctaagtttcagggtatgcaattgcctggtggtgttgctccggatggaacccgactgatacaggaagctatgcaagaaaaagaaaacctccgtcaagaacttctgttactgtctgatgcacttccagtgttgatgatgtaaggaggaaaaatgcactatagattgtatcttgttgtttttgaaacttctactggattaaaaatttatggggggaagcgtcattccccttatgataatccacataatgacccatatacaggatcagggacatatataaaaagagctattaaaaagtatagccattcttgtattaaatgcattcgatggtctaaagaatttcccaacagagaattactagcagaagcagaagaattattagttgatgagataatggattattattccagttgtgctaatctagtacggggaggaaaaggcggagtttctttttatgatccatcaaaaaacccaaatataggttcaaaacgaagtaaagaatctagagataaaatgtctatgattgccaaaaatagaaaatatagcgaaattggccttaaaaatagacaagaagccacccgtataatgacaagaaatagaaaacaccatgatgtttctggtgataaaaatcccgctgcaagaaaagttatcgttgatggcgttgaatacccaacattgaaagaatgcggagaccactacggcataacaaaaaattctgtatttcacagaataaactctaagaaatgggagggatggaactatgcgtgattgggatgaaaacttatttgcacaactggaatctggggaaggtgtagacaataacctaaaaacagaagttactaataagtatgttaactggtacaagtataaccctactcaacagttacatgattcactaacagccgaagcaattcaaatgaaatctccggatatgtattacgtccgtcgagaatttgttaatattgataaaattttgggtgaagaccgtgaatcgaagtttacaaaatcgtggaaaattgcagcatacatcgattcgtatgcaaactacgaagggcagagagatttttacagtaaattcggtatgatgtcaaacgatgaaatgacacttgtgatcaatcctcgtttatttgcacatcaaactgatggcgggatccctgttctgggagatttgatttatttccctatggataacagcctgtttgaaattacatggattgagtttgacccgttcttccagttcggcgatcgtcctcaacgtaaaatcaacctcgttaaatttatctatactggtgaagaattggatcctaaactgcaacgaaatgaagggattaacctttcccccgatgccgatctggatctcgaacctattcgaaatcttgatgggttggcggataccaatattgaacaatacgaagaagatcaagcctttgaagatgaaggcgatgaattcattgaatcgtttgatgttgttaacgggcgcggatcaccgttcgcacagttcccataaatataaccaggggaaaccctatacatgtagggtataggagaaatcttatacccgctttaacccatacaggaaaaataaaatgtttggattttggtataatagttcgctgcgaaattatattgtcttgatgggttgtcttttcaatcacgtgcaagttaaacgcgttcgcggcgaacaagaaaaatttatcaaggttccgattacctacgcatcaaaagaaaaattcctggcatccatgaacaagctgaactatgcatacagtcaggaaaatgttgctaaaacggaaacaattttaccgcgtatgaatctatccctcgttgatttgcagtataacgcaattcgtaaaactgggatcgcggtaaaccaaaaaatgacgcagttacgcgcacctggaaaaacagtaacgcagtttaaccctgctccgtatcgtctcatgttcgaactgggagtgtatacccgttacgaagatgatgtgtttcagatcatagaacagatactgccatacttccagccgcatttcaactgtcgtattacagaattacataaaaacgacattaaaatagaccgagatattaaaatatctctgcaatctgtttcccctgataccacgtttgaaggtgatacaacgacacggcgacacattgaatggtctttaatgtttgaattacagggctacctgtatccgcctgttaacgagattaaaggcgagatcagaacagtatacacggatttcttttccaatatgaacccgttggacaaagacaattttgaatccgttgatgctcaggtggatccggttgatatgcctatacaggattacacgggagaagaatacgttcaaacgtatgctaatgatatcccaattcctagcggtgatcaacctcctaaaccgaggggccaataatggaagaatttagcgtaaaacaactacttgatcttgaaaatctccctggtgctgaaactggggaagaaatggttgtatatgaaaaactcgaactcgttgatgtcgagtcacacccagcagatcgaaaaccggatttagaggaagactatgcacttgcgcgtaaaaccgcgcattacatgaatcagatgatcatggatatggcacaaattgccttgcataacgctaaaaactctgaatctccgagacacgttgaagtttttacaaccctgatgaatcagttaaacaattctaaccagggattgatgaaaattcataaagaaatgcgagaaattaccgaagaaacaacaaaaccaggatctgaaaaaggtaatggcggcggtaatgaaatgaacatagagaatgcaactgtatttgttggttcccctacggaattaatgcagaaatatggtagtgcatacgaaccaaaagaaggcttcattaatggtgaagcggtagaggtaaaccctgatggaaatggaaccgacgatcgatccgagtaaggaatcagatcacccaatcggattaatgcatcccgattatctgaaaaagaaaattgatgaatttgggatggagtggacgcaaagcgaacatgataaaaaatggtatccgacaaagtttagtgattacctaaaaattaacggtatccataaagttgatattcaagcaaaagacagttcaaactttgcgacgtataaaaacaaaggaaacaagaaaactcgatataacggaaacccaaacctgaaacgcgcgtacatccaaacgaaatggacgcaacagatgttgatggagtgggttaaatgtcgtgatgatattgtttattttgctgaaacatattgcgcgatcacccacattgactatggtacaattaaggttcagttgcgtgactatcagcgcgaaatgctgatcgaaatgcataaaaaccgtatggttgcctgtaacctgtctcgccagttgggtaaaacaaccgttgttgctatcttccttgcacactttgtgtgtttcaacgaggataaatatgttggcgttttggctcataaagcctctatgtctgcggaagttctggatcgtacaaaacaggcgattgaacttctccccgatttcttgcaacctggtatcgttgaatggaacaaaggttctattgaacttgataacaaatgtaaaattggtgcgtttgcatcttctcccgatgcggtgcgtggtaactccttcgcaatgatctacattgacgaatgtgcgtttattccaaactttattgatgcgtggttagcgattcagccagtaatttcttctggtcgtaaatcgaaaatccttatcacaacgacacctaacgggcttaaccacttctatgatatctggaacgctgctatagaaggaaaatccggcttcgtaccatacacggcgatctggacatcggttaaagagcgtttgtatacagacggtgatgatggcgtatttgatgacggctattcatggtcttcgaagatgatcgccagttcaagtaaagaagcatttttacaggaacattgtgctgaattcatgggaaccaacggaaccctgatcgctggctggaaattgtcaaaactctcatgggttgatactgatgaaacggaaactaatttttatcagtataaagctcctgtagagggacataaatatattgcggtactcgacccagccgaagggcgcggtcaggactatcacgcgatgcatattatagatattacatctatgccgtttgaacaggttgctgtatatcattcaaacaaaacatcgcaccttattttgcctgatgtcctgttacgttatcttatgatgtacaacgaagcatgggtttatatcgagctaaatagcacaggccactcagtggctaaatctttgttttctgagttggattacgataacgttatttgtgatagctataatgatttggggatgaaacaaagtaaacgatcgaaagcgattggatgctcaaccctaaaagacttgatagagaaagataaactcatcataaataacaaaaagacaatacttgaatttcgtactttctcagaaaaaggtgtttcgtgggctgcggaagaaggtttccatgacgatctcgttatggcgctggtttgctttgcatggctaacaacacaaatgaaattcgcagaattttgcgagaaagacgatttgcggttggcaaatgaggtattcgcacgtgagcgcgaactgctttatgaagatatgttatgtcctgttatcgtaacgagtggcgacgaaacaatatctgtcggccaacacggtatttcgtttatataaatttagaggaaacttaataatggctttaatctctccaggcattgaaactaaagaaacatcggtacaatctaccgttgttcgaaattcaactggtcgtgctgctattgttggtaaattttcatgggggccagcttaccagatccgtcagatttctaacgaagtcgaactggtaaactattttggctccccagacaatgacaccgctgattatttcatgaacgctgtaaactttttacagttcggtcaggatctgcgtgttgttcgtgtcgtcgataaagaagccgcaaaaaacgcaaccgcgatctataatcagatcaaaaccacgatcaccgctgctggttctaactatgcagtagacgatcagatcaaagttaaacacaataacgttgttattgaagaagatggtgttgttaccagcgttgatgatcagggtaaagtcctgtctgtgttcattccgagcactaagatcatcgcacacgctaaacaggttggtgtatatccggatctgtctagtggctggactacagaaatcgtttccagttcttctggtgtttctgctacgattacaatcgacggcgtagaagttgatccgggtattactctgctcaaccttgacaccgcaaaagaaactattcaggcaactgctttccagaaactttgcaccaaatacaagctaccgtctgttattgcaatttatcctggcgaaatgggtagcaccgtaacggttgaaattctgtctaaagctgcatacgattcttcggctgtcattaagtcttatccttctggtaagtctggtaaaaacagcggtcgcagttcgatgaactttggccctcagaatgataaccaatacgcgtttatcgttcgccgtggtggtattatccaagaaacgtttatcgtgtcaaccgctaaaggtgataaagatatctacggttcaacgatctacatggatgatttctttgcaaacggtggttcgcagtatctgtatggtacgtccctaaactggcctgtcggattctccggcgttctggaactgggcggcggtacttctgcaaactccactgtaggcgctgatgaactcatggctggttgggatatgttcgcagatcgtgaatctctgcatgttcctctgctgattgctggtgcttgtgctggcgaaactgccgaaatttcgtctactgtacagaaacacgctgtgtctatcggtgaaacccgttcagattgcgttgtattcgtttctccgccgcgttctgctctggttaatatcccactggctcaggccgttgataacctcgtagaatggcgtacaggctacaaaatcggtaatactaccccagttgataacaacatgaacgtaagttcaagttatgcgttcatcgacggtaactataagttccagtatgataaatacaacgatgttaaccgttggatcccgctcgcgggtgatatggctggcctctgtgtttataccgatcaggtatcgcaaccgtggatgtctccggctggctacaaccgtggtcaactgcgtaactgcatcaaactggctatcgaaccgactaacgcgcatcgcgattctatgtaccaggtacagattaacgcggttactggtttctctggtggtgctggatacattctgtacggtgataaaaccgcaacgactgttccaagcccgtttgaccgtatcaacgttcgtcgcttgttcaacatgatcaagaaagacattggcgataacgcaaaatataaactgtttgagaataacgatgatttcactcgttcttccttccgtatggatgcaggacagtatatgtctaacgttcgcgctctgggcggtgtatacgattaccgtgtggtttgtgacactacgaacaacacgccggatgttattgatcgcaatgagtttattgcatcaatctacgtcaaaccagcacgttctatcaactacatcacactgaacttcgtagcaacctcaactggtgcggatttcgatgagttgattggatcaacgtcagtataacatgtaaggggctgaaaagcccctataaatacacatagaggttagaaaatgcttactgatattgtacgcgcctttgaatccggtgatttcgcacgtccgaacctgttcgaagtagagatcccgtacctgggcaaaaactttaaattaaaatgtaaagccgctactatgccagcgtctaccgttgaaaaagttccggtaggttacatgaaccgcaaaattaacgttgctggtgaccgtacctatgatgactggacaatcacggtatataacgacgatgcacacacaacccgtgatgcaatcgtagcatggtcaaacatgctgcatggtatgggtgaagacattacaggggatatccctgcaaactacaaaaaaaccgctacggttaaacaaaaaaaccgtaacgacgaagtaaccgccgaacataccatttatggcctgttcccgaccaacgttggtgaggttactttagactgggatagcaacaacgaagtgagcacttttgagtgtactttcgcgctagactggtgggtttaaacgctataaatacaggggtagcaataccccttatcattatttttcggagttgtaaatgaacttttttggattagacaatgtgttagggtttttcaaaaatttcgccaaacaggatgaaatggaatttgaagcccaattaaaagatgatacaggttcgattgcgcctccgaaaaataacgatggggcgcacgaaatcgaaacggacttatcaaaccagcgttattcttctgtgttccaacagttctattccggacaggatccgcgaattcagaacaaaacacagctaataaatacataccgtggtatcatgacatatccggaagtggaaaacgctgtttctgaaatcattaacgaagcgattgttaatgaacaaggaaaagatattgttacgatggatcttactaaaacgaattttagtaaaaatatccaagataagatcatggaagaactcgataccgtaatgaatattcacgatttcgataaccgaggatctcgtttattccgtgattggtatgttgattcgcgtatctatttccataaaatcatgcacaaaaatgaagctgacggcatcaaagaattgcgccagttagatccccgttgcatggaactgatccgagaatcggttacagaaaccctacccggtggggttaaaattttccgtggctatcgtgaatacttcgtatacaccgcaccgaaaaacggttatagctacaacggacagatttatagtcacaatgacaaggtaaaaattcctcgctctgcgattgtttacgctcatagcggccttgaagattgcgacaacaacattataggctacctgcaccgcgctgtcaagccagctaaccagttgcgtttgctggaagatgctatggtgatttaccgcattacccgtgcgcctgaacgtcgtgtgttctatatcgacgtaggtcagatgggtggccctaaagctacacagtacgtaaataacattgcacagggcttaaaaaaccgtgttgtatatgacgcgagcactggtaaagttaagaatcagcaaaataacctgtcaatgacagaggactattggctgatgcgtcgtgatggtaaagcagttaccgaagtttcaacgcttcccggtggcactgccttctctgatatcgacgatgttaaatggtttaaccgtaagctgtatgaagcgttacgtattccgttaagccgtatgcctcgcgatgatggcggtatccagttgggtaacgatggcggtattacccgcgacgaattgaactttagcaaatttattcgcgaattgcaaattcaattcaaccctgttcttgcggatccgttaaaaactaacttgatcgcgaagaaaatcattacagaagatgaatgggatgaaaacgtaagtaagattgcttttgtatatcagcaagattcttactattccgaaatcaaagatattgagattttggaacgccgtttaaacctgatgggccaacttgaaggggtggtcggcaaatatatctcccataaatacgtaatgaaagaagttctccggatgtctgatgaggaaattcaaagcgaagccaaacagatagaagaagaatcaaaagaagaacgttttaaaaatccagaagcggaagaggaaaacttttgatgaaagaatttatcgaagcaatcaaaagcggtaatctggtggaagctaaaaaaactttttactccatcatggaagaccgcacagaagcgcttcgtcacgaattacgcgttgaacttgccgaagctgtacgcatcgaaggcgaagaagacaaagaaaaagacgacgaaggcgctgataaagatgacgaaaagggcgataaaaagccagccgaggatgataaatccgataaagatgatgagtgaggtgtgtaaatgcaacttgacatcgaaatcaccgccgaagatctccaggaacatttagacgaagcgaaagcccgtgtagatattctgggtatcgatgaaggcacggttaaaatcatcgaaaatttggcggtcaccgaaccaaatttagcccttgctatgatggcggttgttgaaggtttaacacttgatgaggtaattgtcaagcatgttgattcccgtggcaacgtagaacgcctcaaagacaggaaaacccgtgagcgtaatgcgtatcagactaccggattaactaaatcccaacgtcgccagatcgcgcgtcgtgctctcaaaacaaaacgtgctaacccgtcaattgctactcgcgcacaacgtaagcgcaagaaagcattgcgtaaacgtgctgcactggggctataaatatgaatgaatcccaaatcaacgaaaacggcgatatgcttttaatcgaagaatggggtttaccttgcggtgacgtttcagaatctattttagaatctgttggggaatcaaaagacggtaaattgcggatcgaaggtattttccttcaagccgaaaaggttaaccgtaaccgtcgtttgtatcctaaaaacgtacttgaagaagcagttaacgattatattagaactcaagttaacacccgtcaagcattaggtgaaatgaatcaccctccgcgcccgaatgtggatccgcgaaatgcttgcatcctgattgaaaaattgtggtggaagggtaacgatgtttggggccgcgctgttgttgttgaaggcgacggtggtgatggtgacaaactggcggcgttgattcgtgctggttgggttcctggtgtttcttcccgtggattaggtaagctctccgattccggcaaaggctacggcgttgtacaaaagggctttaaattagctgtaggcgttgatgtcgtctgggggccaagcgcacctgatgcatatgttaagcctatagtggaaaatcagcaaagcaaaccgcttgttgagaataatagtgctgatgacgcttttctggcattgtccgagcgtttgaaaggtctataaatacattaaacaaaacaacaggaaaatcaaaaatgcttaaagaacaactgctggcggaagcccagaacctggatactccggtcgagttagacagcattttcgaatcagttgaactttctgatgacgtgaaagcgacattcaccactgtattcgaacaagctgtaaaagctggcgctgcaaaactcgctgaatcccacattacccagatcgcggaacgttccgacgaactggtcgaagctcaggtaactgaacgtgccgctgaaatcgaaactaagctgtacgaagatgctgataaatattttgcgcacatttccgaagaatggctgaaagaaaacaaagaagccgtttcccgtgacatcaaagccgatctgtttgaatccctgatcatgggcctcaaagaagttctggttgaacataacgttgtcattccggaagaacaggttgatgtagtcgccgaactggaagacgaactgactgagaatcagcaggaagttaaaaccctgtttgaagcgaatcaggaactgaccaaagaaatttcagaaatgaaacgcaatgcagtagtttcagagaaaactaaaggtttgaccgaatctcaggtcgaaaaagtagaatctctgattgaagggctggaatattccgcaaccttcgaaaataaactcagcgcaattgttgaaatggtagcaaccaaagctgaaaaacccgttgacgagtctgtaaatactccgcaaacgaaagatgactttgttccggtagtcgaaagtgttccggcagagaaatccaagatcaataaatatgtacaagcggcaaaagccctttcttaatttcaaaaggtaagaaacaatgtctaagaaaaacgaattgatggaaaaatggaacgatcttctggagtctcaggaaggcttaccggatatcgctaccaaatccaaaaaacaactgattgctgccattatggaagcacaggaaaaagacgcagaagttgatccggtttaccgcgacgagaaaatcgttgaatccttcggtggtttcctggcggaagctgaaattgctggtgaccacggttacgacgcaaccaaaatcgcttctggtaactcaagcggtgctatcaccaacatcggccctgctgtaatcggtatggttcgccgtgcgattcctaacctgattgcgttcgatatctgcggtgttcagcctatgactggccctactggtcaggtgttcgctctccgcgcagtgtacggcaaagatccgctggcttccggtgctaaagaagcattccatccgatgttctccccggatagcatgtactccggtcagggcgcggctccgagcaacggctttaccgaactggcttccggtactgctatcgctgacggcgctatcgtgttccacgatttctctgaaactggtcgtgtgttcctccagaacgtttctggctctccggttactgtaactggttctaccgccgatgctctggatgctgctgttatcgccgaacaggaaaaaggtactctggctgaaatttcttacggtatggctaccagtgtagcagaactgcaagaacagttcaacggttctactggcaacccgtggaacgaaatgggcttccgtatcgataagcaggttatcgaagcacgtagccgccaactgaaagcacagtactctgtagaactggctcaggatctccgcgctgttcacggtatggacgctgacgccgaactgtctgctattctggcaaccgaaatcatgctggaaatcaaccgcgaaatcgttgatatgatcaactataccgcacaggttggtaaaactggtttcactcagaccgttggctctaaagctggtgcgtttgacttccaggatccgattgatgttcgtggcgctcgttgggctggtgaaagctacaaagctctgctgattcagatcgacaaagaagcaaacgaaatcgcacgtcaaactggtcgtggtgctggtaacttcatcatcgcttcccgtaacgtggtttccgctctggctcgtatcgatagcggtatcactccggcaggtcaaggtctccagaagactctgaacgttgacaccactaaagcagtattcgctggtgttctgggtggcgtgtataaagtatacatcgaccagtatgcacgtggtgattacttcaccgtgggttacaaaggcgataacgaaatggatgctggtatctactacgctccgtatgttgcgctgaccccgctgcgtggttctgatccgaagaacttccagccagtaatgggcttcaaaactcgttacggtgtaggtatcaacccgtttgcgaactctcgctctcaggctccgtccgaccgtatcacttctggtatgattaccaaagaaatgttcggtaaaaacgcatacttccgcaaggtttatgtgaaaggcttataagttattgaaaaataacgatattaaagggaaccttcgggttccctttttcatttctataaatagtgaaaacaattgaggctatattatgaaacatattatctacaaaataacaaatttggtcaataataaaatttacgttggtgctcattcaacagaagacatcaatgattcatacatgggttcaggggtggctataaaggcggctcagaggaagtatggtatcgataaatttataaaagaaatattacatatttttgatacccgtgaagaaatgtatgaaaaagaaagagagattgttaatctagaatttgttaataatccacatacatataatatgggtatcggtggtgatggtggccctatgttgggtatgtttcattcagaagagaagaaacaagaaatttccaagattactaaagagagaatgacagatgaagtaaaatctcgtctctctaaacttaaaaagggtaaaccacagtccgaagaatccaacaggaagcgctcagagacgttaaaagctaaatatatgaatggacgtatagacagagagtataaacctctcacagaagcgcacaaggcgaaattaggccgttctgtatcgatagatggagttgtatactcatccgggtcggaggcggcaaaatcccttagtatgtcccactctggtttaaaatatcggattaatagcgacaaataccctacctggaaatttgttgcataaataccattatacactttacgcaggaacataaaatgagtgaaaaattttacacaattaacaagctggtgcgtcagtcacagctaccgcctggcctgtctaaaaaggttcttgatgaggcaaccggaacagaaacaattaacgtagctaatacccgtccggatctggtatctcttacccgtgcggtaaacaacctgatctacggtgaacttgtagcgattcaggaaactaatttacctaccgcaactctgttcggtgtgcgttatcgtaaccctaaaggcgatatgacgttttccagcgctgctacatattccggtaagtatgcaagccgcgataatattccagttggtgcggttggtactgcctacaccaaaggccaagttttcaaacacccgacaagtgatgttgtatacgaagtaactgatagcgtaactctcacaggtgctgatattgatgaagcgattatggtcgcattattcagcaataaattacgcctggcaagcgaagccgcgccaacaagtcaatatgaaaccagcgaagatattagtacaacttctttcgaaatggatcgttggaatatcaacgttcgttcccgcaaattcaaaactgaaatgaccgtggaacttatgcaggatctggaagcaaaccaattcaacgcagaaaatgtgattgaagatgttctgggtactgttgccagcgaagaagtaaacaaagatatcatccagactctgatcaacgtatcacatcgttacaacgttgatggtgtggtaacaaatggcattttcgatgctacaaccgcatacactgcaaaggatgctccagctttaggtcgtttcctgtatcaattagtgtgtgaaatggggcaggaaatgaatagaacgacttcatttgaagctacctatgtactggcctcttctcgcgttgtaagcgttctgtctgcgtctggttggatgcatgaaactgatgaaacccacccgttagcaacaggtcgacttaaaaacggttactatgtctatactgacaccaatacaccgtttgattacctgctgactggttgcaagtacgatctgggtgaaatggatcatgttggctctctgttctatacgccatacacagaagctgatcaggcaggttcgatcaagatttctgttgatcctcaatccttacagcctaaagttgctattctgatgcgctacggtttatcggttaacccgtataccactgctgctaatgaaagacttgtgaaaggtgatgactgggtaaacctctcaggtaaatctaagatgagtcagattgtgggtatcaaacttcctaaactgggttgatagtattataacccaacggggatgatattcaataggtggagtagggaaacttactccatcttttaataattataattaatattaaattagatcttgaatttataaatgatttatgataaaatttattaattataattattatagatcaaataatttttgaaatcaagtaaaaataaatttgattttataaattagatcatgtataattattcttttaataatatattatattagatcaatttaaatttgactacaaattaatatagtatattatagatcaactgggtaaattggtgagtatgttatgagtttgaaattagaagatctgcaaaatgaacttgaaaaggatatgctgatagatcccctcaagttgcaatcagaatcagcggatatccctaagatttgggctaaatggcttcgttaccattcaaacgcgaagaaaaaactgatccaacttcatgctaaaaaagaagctgatgtgaaggatcgtatgttgtactacaccggaagacatgacaaagaaatgtgcgaagtggtgtatactgggactactgaaatcaaaatcgcgatcgctggggatccgaagattgtagaaaccaacaagctgatccagtattatgacatggtggtagatttcaccagcaaagcactggatatcgtcaaaaacaaaggatactctatcaaaaacatgttagagatccgtaaattagaaagtggtgcataatgtctactgaaaatgaaaaatgtgtagtgtgcaagtgtccggttccttctactggttttgtgactgaatccgggcgcgtgtgtagtactatctgtgctgactacatcgcagaaaaaacaaaaaacggcgagatcaacgaatccgatgatctgaatgaagttcaaatgttgctgtaggagaatcttatgattggttacggtgaaggaattacagatcgtgatgaacgtccagatctcttagaatctgacgaacaccctgatttttagggtataaatactagcgtacccgaaaggggcttgataaaagaatgctggatgataggcgtactcttttgcgccgtccgatggagtttaccttcggcggggtgattgataacataccttcgatcaagggcatgagtaaaaaaaaagccagaatagtacctcactggctataatcaaatgtacgtgttgggctgattgcgtcccaaaattaaaaagccccaaccgaaaggaaggggctttttttagaacttttcttcttctccgctttcgagttcggcctttaattcttcggctcgacctttcagcgcatcgcgcatagaaatatcgtctgacggcgcaacatcaacttcttttacacgatttttgtaatatttttcaagctctttaaggccgtccatagtacggcaagaggcgaccttgctcatgaaatcatcaatagccgcctcataaagtcgaaaatcgttgaaactcttcattttgacctctaaatttcgatttgtttgatcacgtagtcaaacttttcttcattgtaaatgcgtactcgttcgattgcgtgtttcataccatagtttttgtatgaatatttatttttagcatttttggactttgccagcgttgctaagttatcaaccaaatcccaaacagtagcaagagatttagaatcatgtttacgcagtacgcgcccaattgactgtttgactataacagcagatttgcaaggatgtccgaagatgatgtgatgcaggttcttgacagaaatacctgtactcagtacaccaatagaaccgattacgatcagccccttcgttgattccgcgatccgtttcatttcgtttcgctcatcaatccccgtttccccagaaatgtatacaacgttgtcatatacctttttgagttgctcatacagccatttaccatgtttgatctgattgaacatcacaaacacgttttcatctttttcccttgccagttttaacgccagcttacagatccatgcgttacgcctggtatgcgatgttatatacttgatttcgctttggtaatcagcccccttcattttcttaatctcatcctctttatatctcatgaagatggtattaattcgaaggttggtaacttgaccttcctgcatcaaccgatttgtatcaactggcttgaagatttgaccaaaagcgccaatgtattgcatcatgtttgctttgccttctttcagagaaccagaaaggccaaacttgaaaatacactgatccattgtgttgatgatcttctgtatgctttgtccggttgatttgtggcattcatccaccatcaaacacatgaactgctgaaaccactcaggaggcattttaacagccgattgccacgtagacacgtagatcaatgcattactgtttttagcagttcctgaccgtattccaagcattgcctcgcgaggtaaaaggcgatagttgacgatatcaccgatcatctgatcaacaagggcagttgtggggacaatgattagtactttgcctgtgtaattttccagacaccaacgagatatcaatccctgaataagagatttacccgctgacgttgggaggttaagcacagcacggcggtttttaatcgcatgaaacaccgattgtttttgataccaatacggatcaatttgcttgtttccgtcgtatactgggtgttcttctaaccacttgtcaaaatctggctgggtaatttcttctgtttcgtggatcttaggatccatccagatagaatacccgcgagactccgcgaattttgttacaagataggctaaaccgtagggcagtttcccgttatagtccatcaagtatatgtagccgttccatccaccatatttgtattttgcctggtactgataacctggcggctggaagctgaaatagtcgcgcaattcatagactatgttagcctctgcctgaatctgcacatgactagtgttaaggaatttgacttcgatatccactatgtgtatcctatatacggtttatatgaatatttataggctaaataatgataaacattggagaactacaatgagtattgattacgaaaaggttgaaggtttcaaagccttagaacaaaaagaagccaaattacagcttgctacctacgcgcaagaaacgtttgatgtcaaactgaaccgtcagaagtcattcgaaaatatgcttgctgatctggaatctgccgtaccagcagaaaagccggaactgttgatcgactcccccgatcctgaaattgttacatacgaaggtgaacaatccgttcctgatgttgttattgatgtgactaacgatttcatggattacgttaaagaggttgctccggaaatcgcagaccagattgaaattgttcctgacgctctacaagctcctacaagcgattctgagacggtttctgatgaactggcatggatggaagggtttaccccgtctatcatcatgatgggccgctctgtttcgaatactggcttttatacgtgtccgtattggatctatgattggatgaaacaaaatccggattggtacaagcaccctgacagttgtcctcattattcagcgcgtcaaaccctcaagtcgctggcatggtacatgcatcgtgatgggatggttactgtaagggaaacccgaaacagccagttctacacgttcaaaaaataattttaaaaagtagttgaccttgccctgctattcgagtatatttgtattcgaaggcgggggaatggctctcgcagtgaagaaggaaatacaaaatgaacatgatgaaaaatgcttactacccagttctgtttgtttggactaatggtgaagttaagaaaatcgtcaattctaaagctccttattacactgtaggtgaagcacttcgccacgctgcggaagcaaattatcctgttcatgccgaacctggttatgctcgttggaacggttctaaatgggttgctgatacctgggacaactacgaagaagaaagaatggagtgtgatcctgattacgtatctcgtcaaatggaagctcatatgattgcagatcgtagactggataatgaagctcgcggattctattgattaacaaggggctacggccccttttcttttaggtgaaatatgaacttaaatcacgaatgtttaaaagatttgagcgatggtaacgagattggtaacgttatttttcttgatatcgatggcgttctaaataatatgcggtgcatgaaatttggtgaacatatggacatcgaatgcgcacgacacttacgccggatagtgaatcacgctaattgtgatatcgtcatttcctctacgtggagaatcggcaacagtacccataatctacgtgaaatattttatccgtggggattgtatcggatcattggtaaaacttgcactaacttccctcatagtactggaatgcgtggtgatgaaatcaaggcatggatcgatactttcggatgtaaaaactatctcattcttgatgatgataccgatatgctttcttcacaaaaagaacattttattaaaactgatgggtttgttgggttgaccgaagaacaatccacttatgcgatccgtaacattttcggggttactactccgttttgtcctgaatgcaatgggtatggacgtgttaacggctacgacaaatgcggaacgtgtaacggtaaaatactccggctataaataccaataaacataagaggctaaatttatggcaattccttctgtaacaattagcgccaacaaaaacgaacttttgattggcgaaactttgaccttagaggttgaaactactgaactagatcctggtgatgtgtttctggcctatcgttggcaaaaagacggtgtagatattccaggcgcaaccgccgatacttacacaactacggttgacggtacaactgctggcgattatactctgatcttaaaacacggtgctgatgaagaatcagcaacagaaaccacgtctgatacaatcaccgtgaccacttattctgatgatcttgtttctaaatggacggttcacccgattccgtggcgtgataccagctttaccccgatcggttattgggtacttgatgaaattctgtatcaaaaagcacagggtaaagattggaaaactgattatgctgattacaagtatagtgaggaagtacaaacgatcctgaaagcgttcatggaaaacggtgaatgtgagatccaagattcacgaaacggctatattcataaaatgagtgaaatctaagaggctttaaatggcaactgaaaaatggactacggttcatcctattccgtggagaaataccagttttacatatcttccatactggctatacgatattatcgttgatgcttttgagaaaggcgacgactggcgcgattatgcggaagaaaaatataaattagagtttgatactctgaaagaggcgtttgaagattatggtgatattcatgtaatcgaatctcgtaatggtaaactggttagtctgttgtcattgactcctgctcctgaaccagatcctgaccaataaaataaggcaaacaatgaatacacttctttttgatttcgacgacactttagcagaattttctcagactttttatgataagttcggtgtacgtccggaaggaacgccaaaggaacgatatgatgaaatggcggcttctttggtgcgtactgatttttataaaaaccttccccgtattcaggctgggattgacctccttcaatggagtttccaacgccgaatcggtgatcctgctactttgctgcttcgcgcggaagcggtcagccctctttgggttatgaaagaaaaactgaactatacagataagatttgcgctgaactggggatccctcgtctcgattttagtcgcattgactatccggaacagttcgcagaacatgcctatcgtggtgttctgatttcccgcaaccagaaacatcttgaaatctggaacaattctcatctagctaataaagttcctggtattttccttgcggaaaccctggaagaaaatattcagctagtcacggaagcgcttgcaaaggctaatcaataacaaaaaagggaaccgcaatggttccctttcttttacaatctttttaattcatcaagcgctgttttcttatcaccaacaaagaggatcgctttacctcctgcttttctgaaaggcaacaccgcttttgcccgatcgtcaaacaggattcctttaccagcgaatgctgctttttcatggctacttttaacgtagtggaattctggaacgtaacccaatactttttgcaatgctttacgtttttgttcggcaacaccgtcagaattgaatttaccaacactggttagtattgctacatcaccaagtgttcttaaatgatggaataattcaaatccttctttgattggttccagattttcgtagaaatcagttttggcaatttttgctttgcactttttcaactcatcttctgtcatcatagagggttcgccatacattggcacaaatgaaccttcccagtcgaacaatacaccatccatatcaaagaaaaacttattcatatcaattcctcagtttgtgtatgcatactataatgtttaatcattaatgtcaaccccaagtgtcagttttcggtgcgtatgctgcaactttagccacaatttccttatccagttcagctacagatttctgaggcttaccacgggctttaactttgatgtagtttgacttaacaacaaacatccctttgttacttgatttcttgatctcgctatcaacaccaactttgttaaagctgatccaaatgtcgccgtccatatactgtttaagagaatcacccatgttcaggatcttcgccatagtaagggccgcgccttcgtgggtatccatgagaatttctttaggaactacacgatcgcgtttctggttctgctgcatagcaatatgcacatcgttcataacccatacgatatgtacgttttcttttttgtatcccagcgtttcgacatcacgcgcgatgcttgccagcttgctcatgccttttaacgttacgtcaaagatgaggttaggtttacgatcttctggtgctgccataataccggaataaacacggttttggtttttgttggaaatgttgaaaacgtcggcgatcacatgatggagggtagatacgttttctgggtttttgaggttcattgttttgacatcatgacccgtttgtttcttgatctctgctgcgagtttatcgctacccattacaagttttttcagggcgtcaacgtccagggtaataccttcgatgcctagcagtttttccagtgtgaatcctttaccggaaccagcaccgccagcaagaataacaacctgaccgaacttaggataagcacggcctccgaaggtgatcagcgcttcggttaaggtgctttctgtgaattgtttaaatgacttcatgtaaaattctccagtttattttctattatttattgacatgctttctgacagtggtgtatggttagggtgttcgacggataggccggaagaactttaaaccataaggtatatgatatgaaaatcaatttacatcgcttcattgtagaattttcccgcaaccgtgacatggactcttacaactattactcccgtgagattgaagatctttttgcggctcacgttggattccttcgccaccatacccctaaaatgcgtcctgaccacgatccgatatatagccctattacatggcaagcccctatcgatggttacgttgaagggatccggatcatgacgtttaacgcgatgtatggaaacgcgttgatccatatcgcacgtgagaaaagggccgaattccctaacggatggcgtattgatgaagtgattcaaaatcttatgcagttacgacgtgaatacaaagcgggtatgtgtctgcgtaatgaacagtatcagatgtataaaacgtatgcatatatctctaagcacctaattaattccatgttttacatcgttggtaatcatggttccgctatagatatcggttcttatgaaatcgtggcttatgctcgcgaacaaggaaaggccgctgcactgaaaatcattgaatctggtgctatcattcttaaccatcgcgttgatactattgcttactatggtgatcaggttgaggttgaaggcgtacaccatgaacgattcaacaaagccgtatttgctaaaaatggttatgcgtatggtaatgacattataacttctgcggttcctttcgttcgtctaactgttgaaggatttggagaaaggttgtcttatagactgtcagaagctcaaatgtgcgcggctgctgaaagaatagccagaaagcggaaaatgtataccgatgaatacctggcgtatgtcaacaaaacaaaagaagatgtagaccgagaaatttcttgcatggatttatccatttgatataatgtaagcatctttttaagggaggatacatgaaaacgatacattgcagaaatgaaaacgttgtttattatcacggttcgtgtactgctgctggtattgaaagcatgttattgcctccctgtgattctgatactctgtctgaaaaaggcagaaagaaaaatttagaccgtgttttctttaccgctgatatcgggttagctcgtatatatgctggaagggccgcacgttctataggtggggatcctgttctgtacagggttgtgtgtccggttgatgttgtatgcatgaacgaagacaaaggcgcgagcgtttaccatgcagcatgggcgttttgtgaggaattatgaatgataaagtgttggcgtatctcgttttcttgttgggatatcgcttagaagtgatgggcgcgtattcatcaatgtatggtgatttaacggctatctggatggtcgggttaggggttgcttttacattcctttcctttgcaattgttaatgaatcggaaaaggatattgtatgaaactatatcatgtgatctactctggtgttttaggcattgacaaacaaatgttagttgatgtaatgtgtaaaaaactcgatgaacgaattggaactcgatacaaaaatcatgtatcggaaagtattttcatcaacgttgaccatccaaatgacatggaagaaatggttaatactcttgatgatcagcagatcccgtttgttgacaatttcaacatgagcgctggagtgtatacggtagtaacttttgttctaaaaaatgttgacatccgaaacgatagcgtgttgaatgtagttgcaaaaatcgattctaccaaaggaaaataatatgaaaattgtacaccgtagcatttccgaactgtctcaagccgaaaaagtgcaaattcatttcaaattcaatgatttgcgtaaaggttatgccgaaattgcccgtgaacatgggttagataacggcgatatttaccaggtagtacaggaaattgaacgtatccgcgcgttccgttctgcaaatctccctgttaaaaatgcaatgcgccgcgaagcgatcgaaatccatcgtaagcgtgtgtacaatttagaacgtgctaaacgtccgatgaagaaagaaaagaaacctcgcccgtttaaacgcgaacatcttaacacctctatggcgctggcgtttcaagatgcggggattatctgatgcgtaaatctgcgatggatcgttgggctagtattgctacttcaaacgtaaaaccaaatcaagccgctcctgatgtagaagcggttcgtaaagcaaaagaacctgagattgtggcccttagccccgaactcattgagcatcgccgccgtgcgtctgctattgaactggatctgcgtattgcgcgttcatacaatctcaagcatgaacacgccgcaaagaacaaccattcttttgaccttactctggaagattggaaagtattgatgacaactgaacgttgtcagtattcaggcaagatgtttagcaataaacccggtagcccgtatgcccgtacaatggaacgtattaatccacgtctgggatatacacaagaaaatacaatagcggttatcaatgctgctaatgctgaaaaatcaaatctagatgcattcgttaagggtgatgtcattctggatgaagtaaaagtgaagttgctgcgtaaagcactttatcaagtcgaaaaacgtgtgaaaatgaaaggttaaattatgtttaagaaatattcttctcttactaaccattatgaaggtaagttcatcaatggtgtaattatgaacgggcttactggcggtgtgtgggttgcgcgtgaaaagatccacggtgctaactttagttttatcaccgatgacggaattaccgttacccccgcaaagcgtactgatgttgtgaagccagccgaagatttttatggctgttcagcagtagttgcaaagtattcaccagggatccgtaagatgtgggaaaccctcaaaaagaccggaacttatgatgatttggttattcaagtctacggtgaatttgcggggcgcggtgtacagaaagatgttgattacggcgaaaaagatttctacgtattcgatatccgtgtaaatggtgaattccttccggataacctgtgctcgcttatctctcgatctcatggcctgaaaatggccccgctgttgggatacggtacttttgaagagatcaaagaactgccgatcacgtttgaatctgtggtgaataaagcaaatagcggcattggtagcgataatacagtatatggtgaattcgtatatcctatcatggacgttgaagagggcaacattgcagaaggttttgtaatgaaacctgtttcacctgcttttatgccaaacggtgaacgcgttgcaatcaaatgcaaaacaaccaaattcactgagaagaaagcgaagaaagcaacccgctttaatgctccggtttcattgtcagaaaaagacaaaaaccaactcgatgagtttgtttgttaccttacagagaaccgtgtgaaaaacgttctttcgaaactggatctggcttcgatcactgctaaagatttcggtcgcattatgggcttaactgttcaggatgctatcgaagaaatcagccgtaatcacgggcctttcctcgaacagttcgaagacccagcaatggctaagaagctgtttgtaaccgaagcccaaaacatgattcgccctgtatggggcaaaatcctgaaccatgaattttaaactatgaacagtcacggaaactatagaagtatttctgatgaaatagccgcaataagagaactccttcaatacgtttcagttgatattacttctggaaatatcgtatggtcttctccgcgtcaaggtaggagggttggtgattccgctggtactatgaaagatggatattgtgttataaagtttcaaaagaaacaatatcgcagacatcggatcatcttttatgttgctaatgggtatcttcccgctcttgttgaccataagaatggtgttgaatttggtgatggtatagataatttgcaagaggcaacgcaacaagagaacataagaaagcagataaagaaacgaagcaatgcttctggaaaaagaggggttatttttgataaaagaagaaataactatcaagcgcgaatagttgttgatggtaagcagatttttctaggttcatatgataaccctgaaaaggcttatgaagtttacaacgaaaaagcaaaagaattgttcggtaatttttatgtcgaatgattttagtacagtaattaaaactgccaagacagtaacattaattggcagtcgtaaacctcctgaacatatcgcaaacattgctgttaaaatcggacgtgctttgaacgaacgcgggatcagggcttattctggcggcgctcctggtatggatagtcattttctgtttgactataatccggataacagatgtataatccttcctgagaacggttttaacggccttttcgcaaacggaaaggatatcatcgactttcaagatttaaacacacagaaagccgctgacgaagccagaaaggtagcaggtaacttcgatacacagaatgaatacgttcaaagaaggtatgcacgaaacacgattcaagttcttcgtgaaaatcttgacaatccaactgattttgttttattttgggcggaagaacgtgaaggatgtgttaaaggtggaaccgcgatcgctgtaagattggctaggttgtacagggttccatgtttcaatctcttcaaagaaagtgtattgaacgatgtgtgtgatacgttagggatcaatatcaaacccccaacgttggattttttatggtaattgaacatgcgcccttacttcgtgaaacatacgaaagatgggctgttaataacgcaataggtgaaaatatgattcatgtacgtagtatcggtactgacggcgaaactccggtagaaggccgatcacccactctcgcagaacgagcaagagaaattatcaacgatcagaatactaagatgatcgaacatgcgcgggatacaatcacaaaaggtgttctgaaacacgcgacaaaacaaaaccttatctatgatatgaagcacgatatcggctcttgtctgggtattgaatgtactcgctatgcattccaacgagtttctgaatggttggaagaagaagggctaaaattcgatacagaagaaaaacgcaacgccgctaagatcacaaattctctggctagtaagtacaatcaaacgtatcgaaaccaggaagaacgcgaagttttcggtttcaacattcctgaaaggaaaacagatcgccgtgtaagtgaattcactttttacattagttggtaaaaaggtgttgacgggggttggttatagtagtattctaactcccgtagacaagacactaactcagaaggataaacatcatggaaatcgtaatgaaagcaacttatgctggatattgcctggaagcaaaaggtgttgctaacaacggtaaaggcttacgggccaatgttgaagcaatgctggatgaattacatgcaatgtacgaatacgacaacgtagcgggtagcgttcttatccaggcgttggaagttgatggtgttgattgtgctggttggtgggatgcttacattgactacaacgataaccgggtttacctgttgagcaacaaagattatttctaaggaaccactatgagcgatgaagctgaggctttagaagattgggctgattttgatgacgaagaagacggtgaatatttctgcgttaatcgtggtgcttataaagaccgtttagaactccgtaaacttttatcgggttcctctcaaatatcaggatccaaacgaaaaagtagtaaacaaaaagttcagtatagtgatggttctgtacgtgatgaaactgttgttgctgaattccgtggtcgggttatcacaaaagaaagacaaattgatgtaaagaacttgtatgaagtggctaaggctgctaaaataggttctgtgattgtttgccctgtgtgcaaagaaaaacacacaaagacaacgtatcacaaagttttctgttcgaatggcagaaaaaccagtaaggattgtaagtctaaatatcacaatacaatccatcccgaacgactggatcgggtattttaaaataaacctaaaacgtggagtacgtttatgaacaacaaaactttcgaagaactgaacagcatcatcacttccgtagattcctataaggtttctcactggtcgcaatatccaactggctccgaagaggcgctgttttatattgaatctcgtggtggtaaatttgatcaagtagttacggctggctgtaaccgccttgcgcaaatcctatcacgtccggtgactatggaaaacgtagattttgctaatcggttgtacaaaatgcactttgggcgcgaaatcttcaactacaaaggttggaaagaaattgctgaactgggttacatccctcttgaattcagagcgattccggaaggaactccagtagcggttaaaaatccggttgcaactttccacgctgggaaaaatgcgctgtggttagcaggacacgtagaaaccctggcgatcaggggagtatggttcccttcaaccgtagcaactctatcccgcgaatgtaaaaaagtgttgaagaaatatctcaagaaaacctctgatctcgaaggcgaagcatttgatatggtgttacgtacccgtttgcatgacttcggcgcacgtggaacttcttctgctgaatccgctggtattggtggcctcgcgcacctgtataacttcctcggtactgataccgtagaagcgctgattatggctatctctctgtttgaagattgtcagaaagcgtttgatgatggtgaaatggcggctggtatttcaattcctgctcgcgaacattccactaccgtttcttacggcaaagaaaacgaagaccttgcgtacaaaaacagtattgagatcttcggcgaagggatgtatgcatgtgtgtatgattcctgggattttaaagcggcggttcgccgtatcgcagaatataaagattcgattctttctaagggcggtactctggtagttcgtccggattctggtgatatggtagacaatatcatgtacgctcttgaagaactgggtcgtatctttggctatacagtgaactcaaaagggtataaagtactacacccagcagtaaggatcattcaaggcgatgaaattcatggccctgaaacaatcaatcgggtgttgaactggatggagtctaaccgttgggcgtctgaaaacatcgcgtttggtatgggcggcggattgcttcaagaagttacccgcgacactcaaaaatatgcgatgaaaatgtgcgcaatcaaaattaacggtgtgtggactggtgtgtataaatgtccaaaaggcgctgaatggaaaaagagtaaaaaagggttgttgatgactatcactgatggtgttaactttaaaaccattgatactctggaacagaaagtgccggaaggctggaaagatgctatgatcacatactatgtcaacggaaagattacttcccgtgacactttagaggaaattaggaaccgtgccgggatttagtatccgcaaaaacaacaaaggaaccgtgattttctatgacaacattccccttgtagctcgcaaggggctttttgctaaaatcgctgggtattcctttaaactggaagaagtcaacgacgaaacactaaaagagatcgtaagaattgccttacaattaagaggtaagaaagacgaacagaaagctattgacatgatcaataaattgggtgaaactcaatgctttatagtgaatcgtggttacaagtacgataccattgcaaaatttgaaaaagggctttgtgaattatgagttattatggtgtgatcccatacacaggaaacaagcaatcgctattacctgaactattcaagctgttccccgaaagaagttcatacatgcgtttcattgattgtttttgcggtggccttagtgtgtcgctaaacgtccctaaacccgttctaagcaacgattatgataagacgctgattgatatgtatgagcgtcttaaaacgcttcctgacctgtctccggtgcgagaattgatttcatcgaaggggctggggaaagacaagaaagaagagtatctgaaattccgtgatgaatacaaccagaacaaagatcctttatggctctatgtcctgatcctgcattcattcagcaacgttaaccggacaaacgacaaaggcgattttaacgctgctgtaggaaaacgaaccctcaactttatgacagaaaaacgtttcgaacatttcaaaaagaatgtgacaggaattgaatttcgttctggttcatactctgatattgaaatcaacgataacgattttgtttattgcgatcctccgtatctgatcactgatgcggtgtataacaaattctggaacgcagatcacgaacgcgagttatatgctttccttgactccctgcatgagcggggtatcaagtttggtttatcaaacgtgacacatcatgcaggaaagcaaaatgatatcctgatcgagtggatgcaaaaatataatgtgcataacctcgataaaaagtatctgttaggccagcatactgattcttacgaacaaaataaaacgcaagaagtctacgtgtgtaactaccagaaacgcgacgtaaatacataccctgaaacactggatgacttaatgtaaggtaacatatgtttaagatttttggttatatcccttctgtttataattgcgctccatgcctgaattctaaacgtctcctggacgcaaaacgaaaagaatatgagtttgtttctgtagccgatgaaaaagacgcagacggcaaaccgatcctgaatgaaacggtcatttctgaactcgaaagcctgttaggtactcgtagactgaccatgccccaaattttccacgatggtaagcacatcggcggctttgaccaactgcgtgagtacgttcgcacgttgggataaatattaacacctttatttgattggtgttattatgctcactaaacgtattactaagaaagattatccatccattaaacaagctctttttgaacagcaaaacggcttgtgcgcgttatgtggtcgccctttagagggtgaccttgaaaaacatcaccttgaccatgatcatgctctatctggctctaatgccggacgtgtgcgcggcctcctatgtaacctatgcaacggtacagaaggtattgtaaagcacaaatttaatcgttctggtctggtttcccgtgatgttgattatatcgaatggctagaaagcctggtagcatacctcaaacgcgactattcacaaaaccgtatgcacgacaaatttatacccgataaggttaaatggtttacacgccttactaaatcggatatgatagccgaaatgatttctatgggctttgagtacgccgacaaagacgaacgcaaagccttaaccgcaaaatatagaaagcaattaatgaaggcaacgaaatgaaatatctaaacgctcgattatcaacgcaacagaagaaaaagctgatgatgttgatatcctccactgacaaaaagatcatatctctacatgattggatgcttggaaggggtgactctgatttgtgttatgtcaaaccgaaagaccgaacgatgtttgatgatcgcggtcgcacattgactaatttttctcctatcaccgttattgatatgtgggaactccttgagattgtaggacgggatatacctgttgacggggttgaactgatcaaatatcttaacgagattggacacaatttagatattatccataaggcaacgaaatgaaagtagaaaaacgcgacggcaaaaccgtcgatttcgatcaagaaaaaattcgcaatgctgtgtataaagctggcggtacgatgacggatgctgactccgcgatcatgcttgtgttgcgtagtcagatccgcaacggtaaagcaatgaagatttcacaaattcaagaacttgttgaagaatctttaatgaagacaaatccgactgttgcccgtgcatatatcgaatatcgtcatgatcgtgatatcgcccgtgaacaaaacggaaaattattccgtgatatcaagggtttgatgactcttagtaacaaagaattaaccaacgaaaacgcaaacaaagattctcgcgtattcccgactaaacgcgatcttctggctggtatcgtttctaaacatatggcgcgtaaccatattctaccgaaacatattgttgcggcgcatgattccggtgatattcattatcacgatctggattacagcccgttcacgccatacacaaactgctgtctggtggatttgaaaggtatgctggctaatggcttcaagatgggtaacgcagacatcgaacccccgaaatcaatcggtgttgcgacggctctcatggcacagatcaccgcacagattgcttctcaccagtacggcggaactacctttgctaacgtcgatttagtattggctccttatgtggagaagacattcgctaaacatgtacgtgatgctcgcaaatatcaagtagcattagtaaaagattatgctatttcaaaaacagaaaaagacgtatttgatgctttccaatcgtatgaatacgaagttaacacgctgcatactgccaacggacaaacacctttcgttactattactttcggtactggtacgggaatgtttgaacgcatgatccagaaagcgattctgaaaaaccgtattcgtggactgggtaaaaagggcattacccctgtattcccgaaactggttatgtttatggaaaaaggaattaaccttgatccagaggatcaaaactatgacatcaaacaacttgccctggaatgttcttcaaagcgtatgtatccggatattattagcgcggctaataaccgtcgtattactggttctagcgttcctgtatctcctatgggttgtcgtagtttccttagcgtgtggaatgatgagcacggtaatgaaattcttgatggacgtaataacctgggcgttgtgacgatcaaccttcctcgtattgcgattgaagccgaagcacaggaagatgaagacgcgcatgatgcattttggcgtatccttgatgaacgtctggaactgtgttttgaagccctgatgactcgtattgatagtctcagaggtgttaaagccagtgtagccccgatcctttatacagaaggtgcgtttggtgtacggttgaaacccgatgatgaaattctggaactgttcaaaaatgggcgtagttctatcagtctgggatacatcggattgcatgaaactctgatgcttttcggatctggacaacacccattcgaccggatcggttctcagaacatgggtagactgattctggaatatctacgcgctgcgaccgaagcatggaaaaagaaaaccggatttgggtttagtctgtattcaacccctgctgaatctctatgtcatcgtttctgcaaactggactatgagaaattcggaagtatcaaagggatcacagataaaggctggtacactaacagttttcatctggacgttgaccgcaaggtaacaccgttcgagaaaatcgactatgaagccgattatcattacatcgctactgcgggtcatatcagttacgttgaattccctgatatgaaaaacaacctgcaagccctggaaaaagtctgggattatgcgatggaaaaactggactacttcggaactaaccttccggtcgataagtgctttgtatgtggctctgatgacgagttcacgcctacagaagaaggtttccactgtaagcactgcggtaatcacgatccggctaaaatgaatgtaactcgtcgtacttgcggatatctgggcgctgctgaacgtccgatgaacaaaggtaaacaaaacgaaatcattcaccgtgtgaaacataactaagaacacctagtattagcgccttcaataaataaagaaaaattgagggcgctaatatgttttacacaatctacaaaataaccaacactatcaatgggcgtgaatatatcggcgctcataaaactgataatctcgatgatcgatacatgggttctggaaagaacatcaaacatgctattgatttctatggcattgaatctttcgtaaaggaaatattgtatgtttttgatacggaagaggaaatgtatctaaaagaagctgaactcgtaacagacgagtatatttcgcttcctcacacatacaacatcaaacccggtggtaaaggcggaacggcctacgaacaaagcgaagaacatcgacgcaaaaacagtaatgcgctaaaaggaagagaaatcactccattacatcgcgatcggatctcccgtgcattgaaaaatcatgtccgtagtgaagaacatcaacggaaactgagtgaagcatcaaagattgctgttagtacacccgaacataaagaaaagatgtctgctcattttacagaactgtataaatctcgtcctgaattgaaacagcaaatatcatcttctgtcaaagcacattatgctaatgaaacagaagaagagaaaaatcaacgtcgattgcgtcatacagggaaggttcggtcggaagaaaccaaacaaaaactatccattgctcataaaggaaaacatacaggagagaaaaatcctatgttcggcaaacctgcatcgaatcgccgtatggtttctggtgatggtgttgtgtatggttccgtcaaagaagctgcggaaacactggggttgtcgcaaggaacaatcgttgctcgatgcaaatcacagaaaaatgtaaattggttctatgtaggtgttgacttgccgaatcaaatcgattagtattttctacatcgaagcaaatcaatttgaaatcaaataaggcaaaattatgttcaagaaactcgtatcgttcgtgactggtaaagttgaaactgcaatcgaacaaaacacttccccagaagaagcatggcgcagtgctgcacgtatcctgatcaaagagatcgaccgtctgcaacatactcgcgtttctgctgttcaggaaatcgcgaagctgaaaaagaaagttaccgaacacaaaaaccttcacactggtaaagaatcagagatcaaaaaactgctggcggcggggcaggaagtgtccaacagtcattatgtgctggcgctgcaacatcgtaacatctggcagggcttgcagacgaagatcgaagaactggaagggatgaacaaagagattgatctctctgtcgttgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgagaattctcgtagatgggaatgttccacagcgagtttttcaggaaatggttgatcatgcgtgttctgaatgggataaaaagtattgcgaagaactgacgcatgatagtatagtaaacagcaaccttaaagacgcttacgaacgaagaagtgtatatgacatttacgaaaaagagaggaaagaaatgatgttcgaagacggcaacagtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcgtgtgatatcgttgaagatattcgtattccttcaatcaacgtttctcggtatagttctcctggtaacatccgcggggatcgttatgcgaacctggcaagcactacggataagctgaacttccataaaatcaatgaaaaaggatttgatggttgtgttctgatctcaatggtggttgtcacgacacaaggcgagtacaaactgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaattttctgctacacgaactgattgaaaacggtatcagatttgaattcgttgatccgattaacggtgatgatcgtcatctgctccgctgggtgtctggtagcaatcctctggattcagtctcccaggttgtagagtctgcacttaaacatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaactctttgcaacgaaattgcagaaatgtactggagtaaaggtcacttagaggctatgaaagagtttcaaaagtggtgtgatacccaaaagttagctaaatgggaatacatcgttattgttgaacggatcaaagaactgatcctcgtgaagaaaggtaatatgaaatgattcaactgaaattagacacaaatgcggtgttaagcctgtttccggaaggttcaaccgcccgcgtagacctccaatctgctatcatcaaaaacgtggtgaatagcgtagttggtaagcgtgttagcgaagaaatcaacaaacggatccaggaacagttagctgttctaatgccgaactcatccgaaattacacagatcatcaaatctgaattctcggattacgtcgaaaaacgttatggttattcgaatgttttcgatgtcaactatggcaatgttcgcgaactgtctggtaaaatcaaagaatcggtaaaacagcaatgccaaaccattcttaaagatatcgagaaagaggcgattgctcatgcaacagaaaacattattgcagacgaagccgcgtttatcgctcgcgtctcgaataacctggaagttactgtacgcaaagcagtaatgcaacgggttaacactcagttcccagacattattgacgaagcgatcagagaacgtctgtttggtgaaaaagcatgaattacgaccgcatctataatatggatgtggtcaacggaaaagggatccgtgttgttttgtttgtgactggttgcaatcataaatgcgaaggttgttataacaaatcgacgtggaatccttgcaacggaacaccgtacacggaagagacagaaaaccatctgatttctctgttgagtaatccgcatgttgatggacttacattaactggcggcgatccgctttaccgtgacaactatcctactatcctaaaactgcttgagcgcgtttctaaggaacttccaaagaaaaacgtatggttatggacaggatataccctggaggctttacaggccgacccagaacgttctaagctacttccttacattgatgttctgattgatggtaagtatgaaaaagatttgccaacgaaaaagccgtttcgcggttcagataatcaacgtatgatcgaattcgctaaaaattcgatagaaattaaaaatattgcttgacctaatgtgtaactatggtaatcttaccacatcgtaaatgacgattaactttaattgagagataatatcatgatcctgaatttcaaaacccgtaaagaagcacgtaactattgctggaagtggaacattcccctgaaaaccatccgtaatacagggcgcggttcttgcccgtggacagttcaagcaaatgaactgaaaacgttcgtggttggtaaaacttacaaactggttgaccgtgaagggtttactaccaattcacatggcggatctaacatagcaaacactatccaggcgaagcagatcgaaaaattcctgaataacgaggtaaaaattatctcgaaaccccattcagatactttcaaaattgatcatcctcctgaaatgacttatatctctctgcgttcgtgggaagctcgttatttcgtcgaagttggcgcggctccagctaagaaaaagaaagccaaaccgaaaaaagccaacgttgcggcttcggttgcgcctgttgcaccagcaaccgaagatcttgatcaaatgcttgatggtggttcggcaatgtcggttgaactggatccgactaaatttgttgaaggccgttcgtatgttctggttaaaccgcagcaatttaaaaatcgttgtggcgctaaccctgggatcaaatcatataccgatgaacacagtaatggtgtatacaccgtttaccatacgaattctctcggtcatcatcaattgagcaaaacggtagaaaccattgattccccaaccggaattgttggttactatctgcttgattctgaacgttcgttcttccgtgaactggcgaccggaactgttgatgaacctgttagcgtttccggtaatagcgctatcgctatcaatgtagacgaagcggctaagaaagaagaaatcgcaaaagcaatggtacagcttgaagaagcggttaaagcccatgaggacgcgcttcaaaatctgcgtactgcttccgacctggttcgcaaagctgctcgaaaagtagcagaagtaagcaagtaaattaaactgggtgctccggcacccttttttatgaggtgacacatggaattattagaaggtaaatcttataccctgaacatcgacgctaaagaatttgcagaaaaaacctggcgaaatgctttagctgaattgatcaaaaacaacggctatattacaatcgatcgtattgcgattggggatactgaggacattgcttatgttctgcaagatgatttcgaatatgagatccctagccatatctggaaatacttcaaaccatatgatttaccggaagaagaaccgaagattgctactaaagaagaaatcgccgcgcctgatttaaatttcgtatcttccgatcctaaaatgtggatgactgtaaaacctgttcaacaagatatcaatgatctgcgatttgattatccttttgtcaagcggatcacttcgatttctgtactatcagcgccgacggattcacaggcacttgaatttgcattacagcatgttttcggtgataataagctgtacgcgattgacaaggaagctgctattgatgaacagaaaaaggaaatcatcaaccttctttctctgcatcaacaacttgaagcggtggaattgattgagcgtatgctttctgatacaaagaaagatatcattagcaaaatcactccggcacgaaggaaagcaattgatgaaaatcgagatttacggtattcccgaatcgcttcataaatgttatggttgtattgaagctcggaaattacttgatgagcatggattagaatacgaattttattctgttctaaagccagcaaataacagtgtggggtttgattacgatagaccacgcattgaagagttagcgaaacgtgttcgtagtcgaagcatggcatttacttaccctcggatctttgtagatggtaattttattggcggttatatgcaattgaaagagtatttgggtgaagcatgaataaagaatacattcgcaaagtagcaaacgctattcacgcaacaacgattgattttctggaagggtttgatcatattatccatcctgaaacgctggatagttgggaagccaaactgtttaaaagtatcaatgaacagtttccggaaaaggttaagcgctggtttatcagacaggaaatcgtagcaacgatccttaatgaacgtggtgttgaggcgttcggtgtaacccctctatataagcgaaaccagattacagacgaaacaatcaagaaatataaaaagatggttcggaagtaataaataatcagttaaatggccttcgggccattttttgtatataaatattggtattgaatacaatataggaaaaaagataatggtagctaaatcattccgcgcacgaagtggccttgatgctgctggtgaaaaagttatcaacgttgggaaggctgatcgtaatacgctgagtgacggcgttaacgttgactttttcaatgaatttaacggaatccagcagtatgacccgacccgtggctattctcaagacatggcgatcatttatgcgcgtcgtatctggtacgcaaaacagaatattgcttcccctgctggggctttcgacgaatccaaatggatcgcaactcgtaatgacccgaaatgggtttatagtaacgtaaccactccagacggtagcattattgaatctggtagttacattatggctgatggacgctttactgaacttctgtacctgctgccggacaacccgacagagggcgacgtaatcacgtttaaagattgcggtggtttagtaggtgtgaacagtatccttgttaagtctaacacccgtcagatccgtttacgtactgtacaatcggcacagtatcgactgacccacccgtacatgatcgcaacgtttatctataacggtaacgtatggcgtgttgctgaaactctggataaccgcgattctgagatcgtaaacgcaaccggaacaggttcattccagttacaatctggcatgacagttttccgtaacagtgctacaggtaaaatcactctccagttgccgaaatatgcaaatgatggtgatgtgatcacaacctatgacgctgataaaatgaactctatcaacgtagccgttttgcagatttatccaggtagtggacacactatttctgacggcgcaattactggtgttacttctgtaactagccagaaatccggctttggtatgttcatctttgatgcacagaatagccaatggaaagtatatgatgctgataaccgtgttcgtctgcgtcgtatctatagtgatttaaacgcagttcctaacgattacgtttttgttactgcaaacccttctgggactataccaaacgttacagttacccttccaactgatgttgctgatggtgatcgcgtttacgtatccctttatatgatgggtaaaaaccagaactgcacaatcaaagttaaagatggtacaacggacaagatccgcaccaacaaaaatatgatgcagttcccgcagcgcaaagactatccgcctgatgattggtttagtgtaacttcattagcatttaatgctgctagtgattacctcccgtatatcgagttttcttacatgaaagctacgaaagaatgggttgttgctaattatcgtccgatcgttgaacgtgttgacgcaactaacagatcgcgtactggtgttattgctctggctgcacaggcagaagtaaacaaaaacttggaagacaacccgaacgacgaaactgctattactccgatgacgttagcaaataaaactgctacagaaacccgtcgtggtattgcacggttagcaacaactgctgaggttaacaaactttcaaccgatacctatctggatgatgtgattgttacccctaagaagctgaacgaaagaacagcgactgaaacccgtcgtggattggcagaaatcgcaactcaggcagaaacaaacggaagcaccgatgatattacgattgtaaccccgaaaaagttgcataaccgtattgcatcgccgaccttaactggtatccttgcccttgttgctacaggtggtgctcctaacaccaacacggatcgtgctcaggctggtactggggtttatgatcattcagattatcagaaagcggtaacgcctaaaactcttcgtgagtataaagcgactcagttacaatctggcgctgtatggctggcttctgaaaccgaagttattaatggtactgttgcaagtgcaaacattccgaccgtagttactccggaaatgctgcacaagaaaacctctactgatggtcgtattggtttgatcgagattgcaactcaggcagaaacaaacgctggtactgattacacgcgagcggtaacgcctaaaacgcttaacgatcgtgctgcaacggaaacgctgacaggtatcattgcaattgcaaccactgccgaagtatcagcgggtactgtaactaataaagcgatcgtaccgtctaaactgaaaggttatctggacgatacaagccatattactgttgctactgctgacgggttaactcaatctgggactatctggactacggttaacatcggtattcaatcagcaactgaaacacaacgtggtactttacgcgtagctacacagtctgaaacgaacgcagggacattagatacagtatttgtcacccctaagaagttacacgctaagaaagcgactgagagcgcagaaggtatcattcaggtggctacggctgctgaaactactgctggcaccgtcacaaacaaggctgtttctcctaagaacttgaaaaatacaattcaggttgatacttcatggcaagctaccgatctggtacgcggtactgtgaaactgtctaaggggcttggtacttggtctggtaatgatgtggctggttctactcttccggatgatggttatgccgctgtaggtgttgctgtttctccttatgaattgaacctgacgctgaaacattatctgccgatcggggctaaagcggttgatgctgataaactggataacctggattcttcccagttcattcgtcgtgatgttgatcagacggtcaacggggcgttgactctaacgagaacaaccactgtacaggccaacattgattcaagcgctgatgcaacattccgcgtaatgaatgttaatggagatctgaacgttggtgatggttcgtcaatgggtaaacttcgtttgaatggtggttcatctaacgactggtcaattcaagcaagttcagcctctgggcgtattgcaatgatctcgacgggtaacactagcacagttcatctttctgtgtataatgatactcgtggcgttgtagctaacgttaaattccaggctcctgaaattcaggcgattagcaaagtgactctgggtaatgataccgtgatcactgctgctggttctgttctatctatgggtacgaacaacaagacaactaagatcctgacctctgatgctggcaacatcgtagcggaagaatctgcgaactcttataaagtctttactgagaagaacgcgcaaaccttgctgaatcctacgtatgtacgtaaagcaggtgatacgatgtctgggcgcttgacggtaagcaacagttcaattatcattgcaggtcaagcggcttggtcaacgctggatgcagtaacagaagcatctaggggcaactggacggctgagatcacagcatcggcacaatacaacttgcttcctggttatgcggttccggttcttgaaccagatccgattaatccagaaatcatgattgtgacccgttatacctatgttaaagcacctggtactttaacgcagtttggtaacggaactgcattcacttatcagatttgggcacctcgtccgacctctggtactggtgttgatgcgctggcgcaatccttctggatccgtcaaatgaacccaattacgggtaaatttgatggttggggccgcatgtatactagcaacaacccgcctactgctggtgagattggtgcaacgtctgctgtcggtactacggttaaaaacatgactgttaccgattggatcaaagttggtaacgttaagatttacccagatccggttactcagacagttaaatttgagtgggtggcataatgtcaaacttaatggcggggttcggccccgattttgtagaaacgcaaattctatcggaaacaaacagcgtaacttacagaataaccgcaaaggcaacacatcccaatgcggttcctaatcagtatgagtttacactaaatcaaaaggcggtagggacaccgcctagtgttgggatcaacgtatggagaattaacaatgctgtagttgatccaattaaaaccttcacattatcgaatgataattcagcaactgcaaataaagcgtttgttgaatatatggatgctcaaccttctgggctgtatttgataatgactaacggtgaatacaaaacaagccaaatcgttgatgattggtttgctaaaaacagatccgttatgtggcaaggcgctgatttcgctcagagattcccaaattctgcatatgttgcattgtatggggcatcaaaatctcgtatactgattgaatcgttttacgctaacgatggaattttaaaagaagattcacgcgcatcaatcgatcttgtctatgataacgttggtgatgttggtcgaactggtgtacctttcaggtctgttgaagatacggaagaatacaattcaaccaatggatctgaatataaagtgtatcctgttgcaaacccagtgatctctaaactagctgattacggtatggctcctggattggctatgatgattactggtgatttttacgccagtaaagaactattggatgctggatcaacaacaagggttactgttcgatggtttacgggtactgctcaaacttcatcatcggtgattgaagttcctgcaaataaacctgatgagtggttacgatttgaacagttctatacgatccccagtggttgtgatggatttaacgttgctgtatctcgttatcctaaacccgctacggatagtttatctgcgatccgtaacttcgtgatggttcaggtatctgctgccgaagctggtcaaaactttgctgcacagtttggggttaacggtatcagaatgaacagcatgatcgatggtggaacaccgtatatatttgaattgccgaatactaaggtttatcctggtggcgattattctgcttccgaattccgtgaagttgatgcataaacaaaggctcggatcatcgggccttataaatatgtaaaaaggggttattatggcagatttaaaagctggttctacagtcgggggtttacctatttggcactccggcacatttccgctggttccggttggtaatactctaacctatcgcggatataaggtttatactgaaaacgataaaccgcaagcatcaaataacgacttcgtttctaaagcaagcggtggtcaatatttgggtgtagttgcctttaaacaggggctacaaattaacgctactttcacaggcggaagtgaccagaacggtttatattctggtgatggtgatggcgcgggattatcaaaagccaacatggatcttgtatcatggtatggtattggtattcgttcatcttccggtactaatggtcgcgtattagtcatcaacgctcgaaatggtgatttaatcactcagggtaatattacggttgaaaagcaaatcagtattacaaccgctaaccctactgacgcaagtcatgcaacacgaaaaagttatgttgatggacagataaataatgtcacaacaaatgctaatagcagggtattacgcgctggcgatacaatgacagggctgttaactgccccgcaattcgcgagcacaggcgcggcttcccgtcccgaacacgtaccacggctcgaccaggtaattactaaagggactatcatagattttggatcttattaaggtgaaacatggctgatttagaaaaaattcaattcctacgtagcacagttgcggggaaaacacctactacaagtcagcttgcagatggtgaactggcgatcaacatggctgattatgccatttacacgaaaaatggttcttcgatcgttcagttagcgggtaaaggtatcccagaaacaaataccaaaaaattaacagttgatgggcctagtgctcttaatgataccgttaccgtagcggaaggtaaaactattactttcaccaacgagaatttaagtggtgaaataactcgtcatatcgtcggtaaatgtgccagcaatgatggatggtacatcggttccggtggtacaagcaataacggcatttttgaaatcggtactattgacgatggtactgaaacaatccagtttgtacaacgcggtgctggtaacgtagaagccagaaaattagtcttacttgatagctctggtaatactactcttcctggggatttaagattatccactaataaaaccgttaaaattagtaatggaagcactcttacgttagaaatgggtgtaggagctaacgatgtctatattaaaaacttgagaggctcgggtgttcttcaattaactaatgatggtaatctgtcgttcagaaattaccaggtttattatgccatgagtggaaaaggccctggtaaagatggtactcttctgactaatgtagaaaacgcgcgtcagcttgagcaagataatttccctatatcttcaggcaccgaagctcggtggactaaagttgctcttttaaaagatcctggatcaaaccagagtcgcctgcaattaatggtgactaacggcggtaactatggttctacgcgtggatctatcgactttatcgattgtagcgctagaaactttccatccactttaacaagcgctaatattcgtaatcatctacaggttcgtcgaatcggtgatcctggaattgataacactaaccaaatgcgttatagtctggttcgtacctctgagggtttagaactgtggtttatgcaacgcgcattcattagtagtgttaaagttgctctgctgtctattgctggcggtactgaatattatctgcctaacggttacacgactacttcaactgcgcccgaaggtttagttgagagtgtggctattcgtatctatgacgaaattaataaacctaaccttgacaatggtactgatggtattctgtctattgctaaaggtggtacaggtgcaagtacagcggatgctgctcgtacaaacttagggttgggtactgctgcaacccgtgatgtcggcgaaggtgctggtaatgttttagaaaacggcgcttatggcttaggtggtaacggtggtaaatcaatcgaaaacattatctctaatgtagatatgatgacccgtttaaaagcatacggcggtactttctggcgtggttttactaaatctggggttagtgttcaaaatggtctttatgaccatggctctggtatttttatgaatgccggggataccatgtcagctattaatatcgactacgctagcgctaaggttcgtgtatatgcagctaccaacaatggtcttgctgcaggaattgttagatacaacgaactttatggtacagcaaataagccatctaaggccgacgtagggcttggtaatctgacaaatgacgctcaggttaaaaaagccggtgatacaatgtctggtgatttgcttatcagtaaagagtcacctgggttatttttgaatgccactaatgataccggaaactctgtaatttggtttagaaacaaaggagttgagacaggtgctgtatgggcaatacctaacaccgagtcttcgggtgaggttcgaattcgtgctagaacgactgctggggtcacaggcggcgagttcaaatttaaatctgacggtacatttacatcaccaggtgatgtaaatatcaccagcggtgctttcaacggtaaaagtatcaacactcagtatgcgaactttaataacacaagttcaaccacaaccgaacaaaccgttactattagtggttcgcagcacactccgctgttactgaatagatcgactgactcgaacttgtctatcggattcaaactttccggaatgaacatgaaacgtttgggtattgatgtaaacggtgatattcgttacggtgaagcagaaaaccagacaaacaacgcatggctgttgacttcggatacagtaaacagatggattgttaactttggtcgtgatattaacgttgctggtgtggttaattcgactggtggatttgctggccctgtcgcagcgtatgatttggctgatgttaaactagatcttaatgatttaacgctaactggcgctaccccaggccatgttaaagtttattcatgccctagtatgggtggcggtaataacatcaccaataaaccttctggcgtcggtggtaactttattgttattgttgaatgtctccgcaaaataaacgataccgattacactaaccgtcaagtattacgcacatctgatagtaaactcagttgggaacgttggttaaatgttagcggtactactaaaacctggacaccgtggagaatgaacgtcgttagcggaaacgatgatgatgtatcatttaaatctgttaccacgactacaggaaacctgaacagcggaaatgatctgattgttgctaaaaacgcccgagttaatggcaacttagggttaggtggtgcttcttctactacttactctgataaaggtgttgtgatcggtagtggtagtgctctgttagaaactacagatggacgcgtgattattggtagttctggtggtggtaatgctgttgaattgcgtcctggaggcccaacacagaccaacaacttggtcaaagtaactgctaccgctggaagtggtggagatactgcgatcgagtatgcacaaggggcgaaaattcgtgctaataacggcggtgcattaattatttctgctaaagcaggtcaagcaatttatctgcgaccgcaaggtgatgcatccagcacaaacgaaacccgtattgatgcaaacggtagtatcacggttaacggtaatattaacgccaacggtacattaacttgtactggtggtgctgttaacggagacttgactgtatcaggaaaagtagatatcactggaaaccagttaaaaactacatcactttgggttacgggagacgctgctgttaatggtgttttaactgttggcggtaatgttgttagtacttacggtattggtagctttgttggtgctgtagatgttaaggctcctgctgcggataatggtacaacacacctttggttccgacattctaacggtggtgagcgtggtgtgatttatatgccgcgtgacaataataccatgatgggtttaagagccggtggaagtgaatggcaattacatggctctgcaggccaaatggtagggccaggcgcacgctggagaattcatcctgatggcaacatacagggtgatgtttatggtggttatatcactaactatatcaacgataggtttaaccaatgtgctcaatgggttcgtactggtgctcaacaagactttggcccaattggtcgaccggcacctggtaaaactgttcctgctggttgggtacttgttggtcttaacggtaacagcaacgaagctaaccagaacatgcaacttatcggcggacggttacaagtatggaaaccgggcgttcaatgggttgattctgctacttgataataaggggcttcggcccctttaaacttaaaggtaaaataatgattgttaaacaaatgaaaggtattaaatggcatcacaattttgaaggtggtgcttactatcgagattgtaatgataagtgttggtattcttttagaaactctcttgataaaaattcccatattattatcgttgatgctaaaacaaataagataattaattactacaacggtgaagatcctactatgataggtttgtttgctgataaagaaatgattttggatgtatatcagctcgacgattttcctgttgattcgtgggatgaattctcaaaaaggaagttcgaatttatcgatggcaagaccataatgactaaagatgttgaagttgaaaaagaaagaaccaaagaagacatactggcggatctaatcaagctacaaaaagaattagaatctatgtaattttaaaggctaccatacaggtagcctttttgttgtatcctaaatatacgtatagtaacctaagaagagtcttataaaaatggctgagagaaatcccgtagataaactagccttatttgatcgggtaatctcgtttgtgatgggtgtgaaaacatggaaacaattgctgataaaaataattctaataatggttatgtttcttatggtagtaacttggtacaaatggactgatatattcccgatgataaaaggtgcccttgtagtcgatacaagggctatcgaaatggaaagaactgaaaagtttaatcaatccgcgttggaacagttgagcatagttcatcttacttccaacgcggatttttcagcggtattggcattcagaccaaagaatataaactattttgttgacattgtagaatatcagggaaaactaccatcccagatcgatcctaaaaacctcggcggttatccgatcgataaaacatccgaagagtacacgaatcatataaatggcttgtattattcatccactaaagcaagttcctacctaccgacgcgtgattttgtgccagtagcttatacttttagttgcccttattttaatcttgataactactattctggatcggttttgatggaatggtacgcaaagcggcctaatataccagatatgaagctaaacatcatatgtggacaggccgcgcgtattttaggtcgagtgaggtgattaacgtaatgctggtgttaaattgtgtgttcttccaatagcccgtttgattgctttaaagaagttcatcaccgggctatttttctcgtaaatatcccaaactttcaatttgtcccacggatccggaacataatcttcattccttgccgaaacccccaacgtaacccgcctgtatccagcgctgtcgtgataatacacgaagaatggcctacctattggcgcaactttacaacctctcttagcggctctcatagcctcatcgaacgtcattgatacccccaaaaatttctatgcatgaatggtcgaattccgatagtttcactcaaaatgaatatcggatgatctagctcatcgtggttttcttcgtcaatgacgatatcccaatcagtagccttttgttcttctaccgtggcaatgaatacctggtttacttcacacttgcggtgtgtacgtctgatgattgtatccccttcacgaaacacaatcatatcagggttggtagtgcggtacgcggttttacccgcgcacacttcattaagcatatcttcgtatgtcattataaaacctttacacgttgaacgatggtttgtttaacgtctttgtattctccgtgctctttaacggttgctttgaacgtgatttcatcaccttcgtttgcaatgttattaccgaagtaaacaacaacattaccatcaacattaattttggtcatgaacctttctacagaagtgtagtaagaaacttgagtatatcccagtgaaatcactttctcaacggttccggtcatttccagacgttgtttgatttcaccgatgtggttagctttagaaatgcgttcctggcgctcttgttcccactgttcgcggatttcttcgcgtttggcgatataatccttctccagtgcaacacccatgcagtaagcgcacacggcgtcaaatacagggctgtttttgttgtcttctttagactggtcagcccaccaaagaacagtaaacattggcatttctgcaattacttcgcctttacgcttgccaatcggcatgatccctttttccagcagttccagtttttcagtatcgaacactgacagtttaccgcgacgttcgaacagatcgaaatctgcaaagccctggaataccattttgaaagtatcagtttcagttaaacgggctgaaacacggtcgaaatactcacgcgctttcgcttccgctttctccggatcggtagataagttgcagatatagttatcagaagtataaccgccacctctacgctcaacacgcaaggtgtacattgcatttttacgaccagaagaaatgaagtaagtggtagtaactacggttgcgttagtcatggtatttctccttaaagggtatctcgtttcgatatggctaatatagcaaaagcccctgaccgaagtcaagggctttttcatcattcattcgaatctttcattgttttatgaagatgaatatcaaaaattttccagtacgcctttccgcgaggataaatttttgctttgtcaatatcgttgttgcttccccatgtgttgtttgggccacgacatcgattttttatataatctgtatgccagaataagcgctgaaccgatgattccgtacctaatggatcttctttactgaacagaatttgtatactcataagaagaaccctgttctaactactaaatcgatctgtttttccggtatcagtggcacatctgcatcaacgttgcactgataatacatcccgacatactcatgaggaatgttggattcactcgcccatgccaggttgtcgtctgtacgcggccctaacatgaggttaacgatatcgacagcgcgatcctgttctggggtgttgttgcatccgttcacataatgcccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttaatccatgcatgtttcgctaccagattgttcatcgaggatataatggcacatgatgttgaatactgacttcaccatacatttttacgatagttaagctatcagatcctttaacaattctgtatttttctggaacaacgcggtcgatttcttttttgacgaagttaagcaatccgaagtcatctatatcttttggtgctttggaaatagaagacagtgatactcgttgacgcgaatcatagtacgaagaaattacaaacatatattattttccttattggggcttttcagccccattttagagaattaatccagcaatttgcggatcttgtctgcgatacgtccggcacgggttgcgctttcggtatgattgctttctttggtagccagttcagccagcttacgctgatgttcttcttctgctgcttggcgatctgctgcaacctgtgcaacctgctcattatcgtgagcaatacgcgcttccagttcagacagggttttgtcgaaagttgctacgatttcatctacagaacgaattttattaaacagtttcataatttatctcaattggttagttttaatcagtatacatcaatacggctggaattcaaaatcataaatgtcattcagtgcgcggttccactcggtgtagttttcaccagcaccataacgcatttgaatagcactttcgaacgttgatccgttgaggttcgggaaaccgaacaggtttttgattttgtcatgtgctacatagtacagagaagcactttccagcatcgcaaccatcgcagacggttcgtgttcgcggcgcttgatacgtaacagagtacgactagcaccagttttacggcgttgatttggtgctacgtagaaacggaatactacgcgccctgttttatcatcaactaccaggtaaaacccgttttctttcagatccacgccttcgaatttcttgaaggttccgcgtttcatgtcaccaattttaattgcgtatttgtgaatgtcaagtcttgtcagaattcttttcatattttttagataccagtttgcctaattttgtaatttcgcctgtttttacgttaacaaacaaggcgatgctcagaaatgggatgctaatcactacgctgatcaatgtaaacagaaaacgtatcacaaaaagaacagcacgttcaagatatcgttgcatccacgcgattcctaaacaactataccctactataaaggtggttgcaacataaaatgcaccaaatcctttacgaaatacgtaacctttcccggattctacccggtcgtcggcccacatttcacgggcagttttcagaatagattcaccactagcgcgagtttcgttagccgaaggcatgtttttaaatttcatgatagtctcctatgcgcccagaactctccaggcgcggttgtttagttagtaatggctaaaaccatatgtaacatcaatcatgactttataacggcatacacgcatttttgcgttattgtaatccactgggatcgctaccacgtcagcaggatccacctttacctgaatgactctaccaacaccgcccccgtagtgtggaaggtatgatttagccgcaacgtgtaggccagtagaacaggtgcgcgttttatcttcgtctaccatgtttcgaggcatggagacagtcacaccaggactattatcaaatttgccagtagcgagatctttatagttatcgcgtacacgtttccaggcaagaaaacaaccatcatcggtcagttcaatgtcattatgtacaaggaacccataaagctggtatacagcatcgcgtgaagggtttcgcatcaaccgttcaaagaagttcaccagatgttcatacggacgatcgttatacatttcgcgaatgattcgttgagtgatatcagaatcaaacactacatctttatatagaagctgatgaccaatgattttaatgttgcctttgctataggttcggatcgcttcttgagtatccaaacaagttacagcacctttgacatcaccagctttcagcatttcatgcgctttcttaaagttcggatgtgtttcacccgccatgaaaacgcgcccttcgtatacaaccgtaatgaacgattcagatccgatcatacgcggtacagtgtctgatactttaggcttttgttttacatcccttttcttagggaattccgctaacttgcggttgataacgcgcccaatggttcgggcgcttacgttgaactgttgggccagtgctgttttacttgcccccgtcaaccatccattatagatagctttctgttgtacttcgtcaagaattttgaccattatttccaccgtattaatttcttaaactcactgagattcttttcgttgttgtaaatcggacgaattgaataagaatcgctatgttcaacaagtgaagccagtaacgggtttagtgatttaaagatttcccatgcctgatcaacacgttttttcatattgctgcgtttaacgcgcattgatgctacagattcacgcagaatcggacaacgcgccctggaaagatttttaccatctttctcatacccttccagacacactataagttcgagggtatcaacaatcttatacagtttttcattatatcggtttttcacaatccgatcaagcgatacaccaaaacggctatgcaatgcgtttgtttctgttgagtgttccttgccaatccatccaggcaagcaattatctttcaatgccttttcggatttaacatactgcttgcacagcatatcatcaaagcataccagatttgaatccgggatccacttccagaggctgttacggatagcaaacacaacagggatcccagtatggcgcatgatacgcgataaagtagattctttcattgctgaatccatagacaacctggaattttcaccatctaagcggctatattcatcaataccatacaaccgaacacctggggctttatccagtgataaaaactctgattttgtcataaacagagaagtttttgccagattgccgttactatccaactcataacgatatacggtcggggtttttgggcgcggttctgaatttttcggtgcatatagcgcttttgatttttcgcgatctgcatcatagatctctttttcttttgtcatttcactggtacggagatacacaatttccgattcatcaaaatgacctttccgaacgatatcattaacaatctcacgctttgaatcactatcgtaatatgcaacaaagctaacacggcttaggttatgcattttagcatacccgacgatatacggtttaaccgtgttggtatccacttttaacagaatgagtttcttctgtttccacggataataaatgcgtgtgatgtcctggcgtttggttgtttctggcttatacttgctccagcggcctccgctacccgttacctgataccatgcatctttaccgtcgtattcgttcgcccaatacccagcaatataatcatcattatatttgtttggtttgactagttcgctatggatccagccaatagaatcaccgttgatgcgaaaattagcatctttaccaacaaagttttgtaccattgaaggcagagaatggaaccacgtcagtttatcacgaacggtttgtaacttatcgaattctgatttaactcgattgaaatacacccggctgatttgtttcagacgttctttaataatccctactgtcattttatccatactcaactcttcgcgagaaggcatgaaatcaagttcaccgatcgggaagtcaataatatacgtatactggctttctgtatagcaatagaacatcgaggtatcatacaaatctttatccagaggataaatgatgttacccatgcgagcatatacaccgctagtgtatgctgatttatgacggatcaccccgctatcgttggttgcttctttcggctgatagttgattttgagaatagaagcaccaacaaagttaggacgaatatcagtaaatgattcgtatacccttgctgcttcgttttcccattctttgatatcttcaactttaaccggaacagtgatagtaaccccgttaggttcatcactttcaatctcatacagaggatcgcagaacggttccccatcatccatatagattgtgtaaccgcatttgataccgtcttttacagattcaactgtgaacgcatcggcatagcaaagcggagatttgcaacccagacccatagaaccgatcaggtcgtttgaatcatttttagttgattcgaagtaaacggtaaacgcatcactaacgaaatcaggagacataccgatcccgtagtcacgaataacaaaacgaggatcaacagcagttggcaactggacatcaaacgggttctgatttcccgcttctttgtgtccatcgatcgcattacaagacagttcgcgaatgattgcgcggatcttgtatttgtatactgtcgaagaaaggatcttatacgctttcttgtttgcgcgtagagatagtttgtttcgtcccttgctggtatctgtaccaactcggtagattgtttgcggtgtatcttcgcgtaatttcattgtttatttctcacttaacattaaaaataacttggtcacaagagtacttcgttggctttttgttcaggccatattctactacttcgcaataagtgtcaaggaattttaccaatttttcttcctcgacctgctgtttcttcatatcaagtataccccacacgatagccccgataatgatagaaaagaacgcacaaaatccgaatatggtcagatattttcccaacttaggcgcattacaacgtgtcataccttacccctctttgcgaatgtatgcaagttcttcatgggttactggacggatatacagacggccttttgtatatgccttgcgcccactgatccaaatgtttttcatatccttaacaccgttcatcacatcgttgtaaaacttcttatcagctttagcctgatagacttcacggccttgataatctttcatgaacaaacagtaaaggatctcattcttatcaaccagattagcatcctttgtagttgttttactcggtgaaggtttagcacccaggcgcaaggccatagcttgccacactttaccatgttcataaccgcgcccgacaagagcatgagcgatttcgtgtaaaagagtgtctaaaatatcctcgtagatatcttccgcaacatgacgaccagatagttcgatcaattttttggtataactgcaacggcccagagtttttgtaatgcgtccattgatccggaatgtccaaccattactgatcaaaccgtgtttttccatcatggtgcgcgcccagtgggttacttccattgcactacgagttttcaacattttagaatctcctttgcttggtacaaaaccaatatagcaaaaagccccctgcattgcaagaggctttgttattatttcaacttcttagaaagttcttttaaatcattgagatactcaattttaggggttgtttcttcccagtatttcaactgtttacgcaattcttcggcttcgtcttccagctttttgctttcgtccgtggttagatggtagatgttcatagccactaacatttcggcatgattctcgcaacctatccacgtagacacgaatttaaccgcttcgctgcgactaaggccacgcagagaatcaggagattctaccatttgagcaataaacgcaacctttgccagtgctttatctaacgcttccttagtttcctggatacgcttattgatacgctgttgatatacattcatacgaatatcaacgaaatcctttagaagcgtttcagggcgttcatatgagtatagtttgccctcaaagataacgttaatgtttgggtttgaattttcaatcaacccgaaatctttcaggatcttttcgcgggttaacccattggcatactctcgcttgagcgttacttcataacgaaaatcttctttcgatagatccttgtagctaacgataacgcctttttcttccagcttgtcaaggattgcaatgtatttcacacggtcatacttcactgggatctcggtgatcaccaatttggttttaccttgcaattcatacgtgccgtaaattgtcccgtctgtgatttcacctttaaagtaagggtatttcagatccagtgtgaaatctttatcattcagatatgcaatgcacccgttaacaaccgatttaggatcatgaggcggaatgtttgttgcatatgcttttgcaatcccgctaaacccgttaaccagtaccatcgggatgatcgggagatagtaagctggcggtacatgttccggatcttcatgaactggcgttaaatcaccatccatataaattgctttgaatattggcgatagtttacacttgatgtaacgaggtgcgccaggtttcttaaccaaacgggaaccaaagaacccatcacggtcgaataacggaatgttattgcaccagtgcgccgccataagggataacgcttcttctacagaggtttccccgtggtgatacccatacatagcaacaccgccagcgatagaagctactttctgaaatcccgttccgccctgcatagcagagtgaataaagaaacggtgaacgggtttaaacccgtctaccaggtgcgggatcgcacgtgaataaatcgtgtaaagggcaaacgttagtccttccacctgtacaacatctttaatacttctttccattagtcaaccttagaaaatttgtgttttccattaacccaatctttacgcggatcagattcgtcgccgaagcatagttctaacacttctttgtattcgtcgtcaagtacgatgacatcatacttcaactgatcacccagaacacgatcgtaatcttctttgcgtaaagaacccagccccttgatatatcgtacatcttttgctttatcgcggaacggtgcaaactcatcaagagaatagaaccatttttcctcgcgcccaactttagcgataacgatcggggttcgaatatatcggatccgtttctctgtgaacaaagaaggccaacgactaaagaatgcaagcaacagggttaaaatgtcgccgccgtcaacgtcagcatcgaccatgataccgatattatcataagtcattccggaagtatcaccaggatgaatattgaggatagccattagctcaaacagttctttgtttttgataatgtctgtaaaactcataccccatgtattcagaggcttaccacgtagcgggaaagcgccttgtgtttcttcattacggcattcgatgaactgaccaacagcggaatcgccttctgtcagaaacaatgttgtttctaccccaggggtatcaataccggaagccggaacgtgtttagcaatttttgcctttttcgctttctttttcgctttggtgatcgcggcggcttctgctgcttgtttacgaatcaatgcggattcaatgatcggagtaatgatttctggggtatccataatcatttttgcgatctttttgtagttcaaattcgcatgattgttaaactcacctgctgtatttgctaatcgctcttttgtttggctatcgaatgcaggtgcattaaagttatgcaggaataccacaagagttaagcattcttttacacgtgctttcgggatctcgatactatgctttttcttgatcatcggttcaagttcagaatagataccatcaatcatacactcaacatgaacaccgccgtttttcgtatccagaccgttaacaaaggatttctgtttaaacccgtcctcagtgctcgccagaatgaagctgaggcgattatttgtctggacaatggttttatccccatacatggaagcgtacagcgggaagcgattagagagcgtttcgccgttatatgtgaatttcacagacgggaaagcaacggcaagggccattaagcgatccttaatcacttctttggtttcttcatcgataccagttacaccaaacatagagaagtctggagtaaacttaacagtagtaccctgttctttactggggctggttcggtaatcgatgttctgtgcgccgtccgtacagttaatggttactttgcgtttcccgtttgcagtctcgccaataaaaatcgagctataacagtttgtcaggaaagaaccaacaccattcatacccatcgttacgcggtttttatcatcgaagttagaacccgattttgccatagtccatgccgcaactggtttaggaactattttcccatctggggtttttacatcatcctggggaataccgcgcccgttatcagagattttaaccagattatgatcaatggttacatcaatcttattagcatgtttgaattcagttcggatcgcttcatcaatcgagttatcaaggatttcgttgatgattttaaccaacccttccacgtactcaaccttgcgatattggcccattatgaaacgttcatgcgcttctttgttaaccgatccgacgtacatatttggacgcaaccgaatatgatcgcgatcgctcatacaaaatgattcgtcaacctttgcgccttttttggctggttgtggtttctgttctggttcatcatctgccagaagaaaatctaaactcatattcacctctttgtttaatcactgacattatatagggttctatgaaaaagaaaacccctttcggggtttacttgttataagggaaaccatcacgaaccatttgaggtttatcaaccgttcgttttgcttcgcctccgcaatcgcaatctttcggtgcatcacgggtagcaatgcttgccatttttggaaattctttattacacttggtgcatttataggtataggtaggcattaataaatctcttttaaacttaacatcttaactaaacgggctttgtctatgtcaaaaacacattgacgtgcgcccggatacaacttttcaacttcgtataccatgcagacgaaaccaacattgtgcatgtactcgcgttcatatgcattgaaccaacgagaaaggcgctgtattgactgaaaaccaaagtataacccagccgcttgaaagtctatgttatctttttcaaggttgcgcatcaatcgattatcgtcatccggcgctggatgtcggttatcatccatatcaatatagatatcaggattcatacagaattgatccaaccattcagcagtatccattgacacataacgattgacatatgggccgctttttgtttgccatttttctgtacaatcattccagaaagaacaagaaaattccacacgatatacgaacatgatataatcctcacaagtaaactcaaggtttacaagtacgataccacttatctaatttttctgcaagcatttcgttgataatttttgcaatttcgtaccgtccgtgagtagtacccagttccaggtaaatcacatcaagtgcgcacacaatcgcatcaacactttcttcaacgatattaccgccgcgttgaggctgaatgaggcattcgctgatctcgccaacttccgctgataggtgatgaaccacatcactcttcgtgcgtttcttcactttatgagcgatttcgaaaaacttatcaagtacgatcgccgtttcttctcgcgttgcagtattctcggatgtcgtctccgtttgttgaacaacgtattttgtaaaatagttttcaaacacgttgaaagggatcacatgaggaacaccattcaaaaacaccccttctttacaaacataatggatttggcgcggaatagacaacccgccgctgcgttccaaatgtcgtttaacgcttgctacaaaatcgaactctttcccgtatccagccgacatactgtgatacgtgagtaggccaaatgcagaaacatagagatcattttctttatacagattcatttacaatacctttatggtagccaaaaatataacaatcaattgaaggacgttcaccagggaagtgaatgcattgcatgatgcgttcagccattagatcttctcccatgtataccgaagtagtttcttcgttgtaatgggtatcatacgacgttttaagcgtcatgcccggaagccctgcaatgtgcatgaatttagaattggtgcaaggttttcctacttcaccgttaatcatcaacactgcattagttttacgtgcttttctcatttgaatttcaccccgatttgcgatacgttccattcttttacttcatcaacaatatcataatggttgatgtatggtaaagcaatttttaaattactcgcgtcttgaatgttgcgtaagaaacgagtaggagaaagaagacacaaccgctcggatccgttgtttcctttagcggcaaatgatagggtttctcccccgtcaatcttcatatcaacagaaatcgttttgaattctggtgcgtatgacgtgattttgccgttgtctctcggcgtactatagaaacatacactttgtgggacattataacgatctgtttcaatgtacatgtaatcgccgtcagtcattccccacgcggtataaagggatccggtatagtcaccaaaggaatttttaaaatcttccttcgtggtatatcccagcgagcgcaattgcataagctggctatgctgttcgattgcgtcggctttttgttgttcctgtacttgcgcatcaatcgtttcttgccaggaattatacgcatagtaacccacaacagcgattacagccataacccctacagctttccagattttagcgtcttcgtttttgttactcatgctatattccttttaagaaaaagggccgaagcccctttgttaacgaagataaaccacataaccgctttggtcaatcgcgcggtctgcgtcattgaagatattaccacgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactataccaaagctatcccgtgaagtctttagcaaaaagtgctatttgttaaacccgtttcccttgataccatttcgggaaagtaaccctctcgataaaatttctccccaggttgaaactatcaccgaacaggagaacaccaaacagcggatcacgcttgatgtcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccatcgctactgcgtctttttcattgaacccgttcttaaccaggactttaactactttggcttctaagtttttcatgatgcgttccttttgtctgtttcgtttcgatgtgtgtaatatacaaaaaagcctcctgcattgcaagaggctagtttaacaaaaagtgctattttaatgatttaagtgttctacggattcccccgttttgggtgatatcgtaaagctcttttgctttggaaagagataccgtgatgtcataatcggttcccttctgtgagaatgagaatctaacctggtttagctccgtgtatacgtgggtacacactgcttccattcgaaaatgttttataaacgctttcttcgtgtagtagtcgctaaaccattctcttgctatggattggtcgattgctttgaagatgacaaacagcacaaccaacacaaaaattactataagtggaattgctgtgctcattatttgcccctgttcacagattgacggtgtaacgcacggttaacgcgtggcgcttgataaggtttcattttgtacggtgttggatcagagtattcgatccggttaggtaatgaatacagttcaacgcttggttgaatccagcggattgagtcgattaacccttgagttaacgcacgaccgaaacctacaccaactaaacataaacgcataatatccccttactgtgccagaatgtgaagccattcgcccaaccacacgatcgcctgataagacaaccacaccgcaccggacacacaagcaatcacaccaatgatcgcgaatccgattaaaatgttcaaaccttctttcaaatcaccaaacatgttttatcctcttttgtttcagtccctacaaaataacaaagcccttgcacgaatgcaagggctttttatcataattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttaccaaccatcttacgcacgatatcaaccaggataccgcgatcgaattcaggaccacgaacataatcgagtgattgccaacggctcacaccgtccgctttcaggtcttcaaagaattgtctgtgtcctgcatacagttccagatcttccggcgacggtttcaggatttgacgggcttcttcgctttgttgtttccaccaggcgattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaagggccaaccgtttcataatcccatacgtaatctacgggtaaatgactcatgaagttctccgcttataatcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaatcgcttccgcgtggaggcgtgggatctggatagatatatcttttttcatgatattaatgtccatatgtctttatcttcacgaatgtttcgtgccattcgaaggatcagcacgataacgccatattcatcataagtcagttcaatttcttttgcaataggactccatgaataacttggcccgttcggagaatacagaacatcgttagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttacccagacggtctttcatcaccggatcaacaacaacctgaatctgtgcttcggtttcctcttcgagcgataccgttttcagaagatagaattcaagttcgatcttctcgtcgcacttctccgccttgataacttcccgacgcgggatgatttctaagactcggattttttcgttgttgttataaacaatctcggtgaagatttgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccttgaaacctgaataatcgggttcccttctgcctgacgcatgattttatccatacggataacatcaaagatttcttcatcaaagaacggggagagttcaacacgtccatcggcgtttaccggacggatctgatctttatcacccagtcccagaataacagcgttgcttggaatactgcgccggatgattcggaacagatccatatcaaccatcgagacttcttcaacaacgaacacgcgacaggtagacagatcaggcgctttcttgcctttctgctgttcgaacacacgcagttcttcgttagtcacagggctaatcttcaatgcagaatgaatcgttgttgcgtccattccggtagccgctgctaacacgtttttcgcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagtgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtcagtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacctcagaaagtgcaagctgtccaccagtgatagcgccagcattatcaacaaacaggctatctaatggcccctcaagaagataaaccgtttttagcggatctatcgtatcctgtccgtaaatcttggttgattcttcacaggctttgattgtgatatatttcgactttgccccgtcgcgtaaagcacgaccctggaaagattcaattttccctttcttatcgaagatagggatcactaatctcggttctggttttgcgatcggataggtatccggattcaccgtattaaccagttgttgccattcgcgagtaaaccacaaccgatcccacttgtcacgggggatacaacgattctgcacatattttatgatcggatgttcatccggcaaggtatctaacctttcgcagaattgaagagtaggaataaatttcttctcttccttcggttgttctgtatgcgttggctttaacgaattgcgatccttaaacgattccatgagataatcacggtaatcgtctggataatattctttcaggaatacgctaaacggtacaccataaccacagttaaaacaaccacaattcatatgatcaccctttttagaagggtagatccaaaatcgttttttgtacttgtctttcattgagtcgccgcaaataggacaacgcgcattgatgcttaatgcccccgatttacgaacgatttcgctttgaggcagtgatcccatgattcgggttgcaaattctatatcaagatacatttcttacctcagttgactatctttagatcctcgtcgattataccccgcgctgatcatttcgtcatgttctttttggcattcaatacaataacggcaacccttcacgatagccctacgtttttcgggtatcggatccccacaatcaaaacaatgcgttaatgattctccgtttctgatttgagaacgtgcaaaatctatcgcattgtctattgttgcctgaatggtatcttgaacaccgtcagcagggccaaatccaaccgccattgtaaatcctcctaatcaaatgatttcaatatcatagactaagaggatttttctgtcaagaacttacttgcttttctgttccgtcaagcattaacttccaaccacgaaatgcctgtttaaacgaataatttattgcaatatcaattttatcagaaccttttcgacgattctgataaacggtcgcgttgtcactcatatacatgatacaaattggaaaccatgtataatcgttagcagtagcccagatagtgatattcagcggaggaattatcatttctttttccttttccctgcacgggtaacgcctaatactttcggcccgatgttggttactgctccagtagtcacaccagaagcaatcttttctatatcgccgccagaatcaccagcgaccatatcctctaacatacgccccttatcataatattctttgaggcgcggaacgttcatcatgatttcttcatgctcttgttctgtcagattgtagcgattgcgtagggtatcatatgaacttgttaagttcataaacccagtcatatacggaacagaattcattctacgcttgatatggcgtactgaacgatgaaaaggagaatacgcttctaactcttcttttgttttggggttacgaattacttcgccttgtccatcaaggatccccagtttataagcagtccattcagtccagggctttttgagtagccggatcatccggacgctatatgttaaatccatatttttaactaattgatcactcatgattattactctattgtgaaagtgaataaatcagatttggtttcaggttcaaactccatacaaacaacctcgcatagtggtttaacccctttccaatcctccaggtaatacccagtatctataccgcatccaggattcataacgaggccagtttcatcaagaaactttttgcatttacttgatgtggtgctgtcatcttgtcggaaacagtgtgttttcgaataccggaaatttgcagacatttgagggattatgaaagttccctgacgagcgatctgtgatgcacgttcgattactttatactcaaattctgcccctgtatacttacccttaaaatcagatgttttgattttaccaaaaggcggattactgatcgccatatcaaacacctgattaaattcagttgttaaggcgtctccatgcacccaggaggcttctggtacgatacgcttacctaactcatagtatgtgtgatttaactcaacacagacgatttcacgcggcgtattgtacatcatgtaatgaaccatagcgaaagataacccaccgataccagcacacaggtcaataacacttccacctgtgcaagcatcgattgtgaaatcgcgagcaagtccaataggggtaaagaacgcccctaattcagaattgtttgtaaacgcgccttcatgaaagttttcaataatgaacaacttctcttcgtaagttagcgctttgtcagagtgaaccagatccattatctgattgtgtttcttggtttccgctttcgttaactttgccattttcccagctatacaataatgttgattcgttagggtagaattcccatccgtctacatatccggtttcccagtcagtagtttgttcaaaaccacagatccattcatatacaccaggaggcatttcgacagaatcaggaagcccgatatcttccgcgctgcgtccacattcaaagaatgcatcatgaatgaatggtcgagataataccgtaacataaccttcatcgtcaacagctacgatccagcgcgaactgtgaggactatcgaacttcggttcttcttcgtctgcgtcagcttgcatttcggccttacaaaaatctaaatttatcatttcaaaccctctttaacaccctctttcatggctttccaggtagaacctgcttcaccattcagggcggcgaatacaaatagtaagatagcaaggacaagattcacaccagcaatcaccatgattttgctatacacgaaaatgtaaggcattgccaccacccaccaactaaaagaattaccagttacgatgttgagtgctgcaagtaagaaagtgataacgaatgcgattttcataatgtcctcctttgttatgattaaggtatcatcttttgcgaaagaatgcaatacctacagatacaaaaaagcccctttcggggcttaatttttatgcgttattgatgagataccgaagaacgtttttcgcttgttcctcattacaaccaactttgaaaccaggttcgatagggaggaagttccagaggaaatcaacacttccttcaacgtcatctttgcctttttccagcatcgctaacagtaaacctttgtttttgatgctgtttacgattgcgtcaaaataaccatcgctgaaatcaacattcgggttcagcatttcgttgtaagggttgttgaatacgttcattttgaatctcctttgtttaactcagtatcttgtctacgtgagttatattaccacaatggagattcaggtcaatacctttttacgattttttgaaaaatttttcgtatttggcttttacccagcgatacatatcttcggccttgtcactggcaatcagtgagaacagcagatagatcgcaacacccaccaacacaacgcctactacaatgtagacgggtaatagaactgggaagagaacccagaaccatgacatatgcgagaagccaaatactttagccgctgcaaaaatcagtgtcagtccagtcagaagtttgatagccggaatcggaatcgttatagtcttagtcatttcattaccttacattctttatggggctattcgccccagtcaattaaaattgaatgtcagattttgcaatctgtgccattttttcacgtcgggtagattcagcctgtttaatcatcgggccttgtgtctgttctactgttttaggcatagtgttgccgtggtagtcagatttaaacccgtattcgctgttgtcggtatccatccagcgctgattaccttttcgaacttccaacttgaacttgttgaaagtgttcttatcgccataacgggatttgatttgcttgaacagttgcataccctgatcagctaactcttccgtctcgattacagctaacataaaatcagccgtagcaggtaaaccagcggattccgcaacatcacccatactcacatccgaactatcccatgcagaacgcccaacctgtgcgcctgtccacattacggtattagtttcaacagcaagaccgcgtagttcttcggcaattgctttaaccagaatataggtattttcagcacctttaacgcgggttgaagtacagatccccaggtaatcgacaatgatcacatccggcacaaactgtttcttcaatttaagctctttcacaagcgctctaaagtggtttgcacctgcacccgatgtagggtactgcttgaccaccaaacgcccaaccttacccgctttaaggcgctccattttgttcttatagtctgcgtatgtaatgttcccttcgtcgatgtcatccatagtcacatcaagaaggttagcatcgatacgcttagagcaaacatgctctgccatttccatagaaatgtaaagaacgtttttaccctgttgcagataatcagccgcaagagaacataagcccagtgatttaccaacgttaacaccagccatgatgatattcagtgtaccacgttccgcgccgcctttggtgattgcgttcaggatcgggataccaaacggaattttcatcgccttcgattggtaaagcatccaccgtttttcataatcttcgaaatagtcatgacctactgaactatcgaatgaaattgctaatgcttcctccatgatttcagggatagccccaacaccaggaagtttcttgttctgttctgccagtggtttttctgcgttagcctggatctcgattgcgcgagaaagagcacgatacattgctttgtctttgcaatatgtttccgtttccttcattagccaatctaaatcttctggcgcatttttcagcgactgaatcgcctttttcgtgtcttcgtagactacatcacttagatttcgtttgtcaagcgcaacctctaaagcagtttttgacggaataccgttgaattcctgtacatgtttatcaatgaggtcaaacaaaacttgtgcattgccttcaaaatattcctttttcagatgaggccatgcttggacaaaatacgtcccgttataaatcaggttagaaaatattgtatcaacgatcattgtattgccttataccaggttgctgaacatcatgaaaaagttgtaaaccttttgtttgaatacatcccataatgtcagcttaggctttgggacaactgaacccttttcaagctctttaatctgtgcataaattgcatcatgcaccagcgggatcaacgcttctttgtcttcgtctggggtactgaattctactttcagaccatgatcccaaaacaccttatgaatataaaccagatgcgcaacacctttttcatcgttaatcagaagttcctgaataacatctttcatcgcttcatcaatataattctttgctttgctctcgatatccatacattgcctcggttatggggccgaagccccatattttataaaatttcgtcgttttcttcgatatcatcaaatgattctgggatatcgtcatcacccagatcaggatctgggatgctatcagtgctgtataaatcttccagcgcggaaccatcactgatttcacgatcagggatcttatacttttcttcgatagctttcaagaatggttgatgagtaaacagaggacgccagaattcaacgctatttgtttctgactcacgccatttcttttcttcaacttcgagttcgccagtctcggtattcaggaaagcacggttgcgccagcctttggttacggtctgtacaaagttcatttccattgccagatccagaaggccagaatacatactaataccgccttcataggtaacatgcagcgggaattttgatttctctttcacgaatcgagatttttcgatgttcatgatgaaatcataacccactacctcagtaccttctttcacctgttgtttacccaggatgatcgcagtatcagcggaatacattaaaccagtaccaccggaaataactttcttgctgtacatttcttgtgtgtcataggtatgacagatacaaaccatcgggatatccaggtcagccagataaggcgtaaccatacggaacataccttttaatgcttttgctcgcgtcatatcctgtttatcgttatcagacagcgcgtcagcaagttcttttttacttgccgtgttgcctactgagtcaacgaatacaatcaccttatcaccgcgttcaagcgcgttaagctggcttacaacgtcattacgcaactgctcgaccgtcgtgatacgagtatacacaacacgatccggatcaacacccattgatttcagataggatttagtaacacctttttctgaatcgtagaacaggcacacagcatcttcatacgttttgagataagccgctacagtcagcaaacctaagttggatttgaagtgtttggacgggccagcgaaaagggtaagaccagaagttaggccaccgttaaacgcaccggacaacgccagattcagaatcggcacacgggttcgcgtgatggtaatattgttgaatacgtcgctttcagaaagtacagatgcagtttggctattcgagtttttgatcagtttttttagtagtgctttgtttgacatttaatttttccgatttattcattctcattctatatatctcactagttaatgaaaggggccgaagcccctagagtttaccagtcaccgaacaggtcgtttaaactggcacgtttttcataatcaattttacatacttccgtgatattagtcaatggactaataacatgtttttcaaacatacccggataatctacccatgccagaatatcactttcgatctctgacggtagtttatttccggattgccacgcgatgcaatcggcttgccacgggtttttatcccttagtggtagaaccattaccttttcaccttccatgattggcgtaacaccatcaataccagcagtgaaacggttaaagaacagcacccctttaatatggtttggtgttccttttattggatatccagccccatcacgatatttcgaaatgttgttggcagatgatacaccagcaatttccctgtagtcaagttccttatattcttcttcgaactttttataatgttcgtgtaaagataattcaccttcttgcaggatacggcggatcgcttctttcaggaatactttcacagaggtcggagtactcgaacgctgtgtttccatacccatgattttcaatttcggtttttcatagcgagttccttcggagtcccacacgttagccgcatatcgttttttagcagtccagaaacttcccaacccttcggaacccaacggaggcccagaaatgatttcacgatccataaacatcaggtgttccacgttgttcatgtattcgcaaagttcacgataccctttatcgatcattggttccattctttctttagcaaagcgatccaggaagtcaacccaatggttattatccttaaatttagcctcaccaccaacttttgcaatcacgttatccatacaaacataaatggagtcagtatcacagtatcgaacatatgcatgatccgtagtaccgcacaggtcgttaagatattcgtttaccttacgttcaatccactggatagccaactgcccgaacatggtgatcgcgctggcgtttcgtagatcgaagtatcggaagtgttcgttacccaacgcaccataaagggagttgatagaaatcttacggttaagctgtgctgtgttcgcttgtgcgatcttcttctcacatacgcgcttaactgctttaagcatttgttttgtaagagttttcagaactgctttcgattcatcactgaaatctgtatagaaatcaaagtcaggatcaatcatttggttatgcgcgtctgttaagtgttcgagttcgtgcttgatgagttcaagatttcgctcacccgccatcattcgttttttccacatcttacgctgatcaaatactttcttgatctctactgggatcacgcctttgatatcacggcggaacatccacccgttaggagaacagctaaattcatcgctagggcgcggcgcggtcttattaatatactcttcaagagcacgtaccgcaaaacttcccataatcgtttcagggcttatattcacctgtcggatgatggaagggtacaggcttgttaagtcaaacgataccatgtatttgtaaggcccaggaactggatccttcacaaatgccccagggtaaggggttttagtatggcgtctgttttccggaataacaaccttatcttcacgcagagagttataaatgatcgcgtcccacgttttcagcggagacataacccctgggaagttaatttttgcatagtacgctacagacagaaccagttcaataaagtttcgtttaccgtcgatatcaagtacgcggataacgtcaacaatgttgtacgtgatgtacagttggtgatcgcgctggcgtagttcagacagggaaccttcatactcaactttatttttaccagtttcgtattccgcgatcgcgtccagacggtaagacggttgcggggtaaagctgaatttcttatacagcgccataccatccatttgagcaacgccgaaaatatcatatcctaattgttcgttgccgtaagcgtcagtagtggttctggcggttactttaccaaatgggctaaaatgccttaccacgttttgaccgaaaatgttcaggtatcgcgtgatgatatatgcaatatcgaatttgtcagagttccatcctgttacaataacaggggttcgctctttccaatctttgatatacgcagacaataacgacttctcggtctggaaagaccgataaacaattttgtttaaatcttcttcgctaatgtctttgcgatcaacgttttccgcgcaccattccgcaaggccaccctcaaccagatcgtatacatagaatttatcttcaatgctatcgtaatgggtaatcgcatcgattggatattttgcttcacgcggatccggaaattctggggcggtcacctcgatatcgatagaagcaatgcgaatgtgttcgcggttgtattcgatttcattccggtacatgtcagaaatgtaagccagtcgataatcgtccatacctagcgcttccatcccaacatcgcgcatacgctgcatccagtttttagcttctttgatgctgtcaaactgttttttgaggcaaggcttgccataaatgtctttgtatggggtttctacgccgttcatagcgtgttgatacattacgggcgcatatttcgtcttacgtacctgttcggtgccgttagagtcaacgaagcgctcgtaaatggtatctcccatttgttcaactgataggtaaaattcattcattggatcttgtcttctccattaatataatgttccattgtaacaccacctacagcaaattcaagtttactcgatgttctaaaaccaacaacccttctgctaacaagtcacggatctttctcagttgaacaagctggcgttcaagtttaaacccgtcgaataacatgctaaaaatactggaattgatactatgatattttgcttctgcaatgccctgattaaccatcatgatagctttgttaaccagtagtttcctttccgttactgtatgttcatccagttgacaggttgcaagggaaaccagatcatcataagcacgttgatcaataacgttatccatacgggccgcgaaaattttattcatgtaagtgcggatcattgcgcgacctccattcttttcataaagacttcttttgcttgttggatcaattccagagattttttaatacgctcatagaaatgagtggtttcaacttgattgcataacaatgtgtactctgaaatgttacgatcgtaaaatccaggaaagtagtgttgtgcatagctataagtgcgggtatctgacagattgcaagttaacgataacaagatgtcatcttttacaatcgggatgatcaaagtttcgttggatttgattgaatccatgatttcgttaatagtcataatatatccctctcaatggtgtacacccaatataacaaagcccctgcacgaatgcaagggctttttgattagtgaccgatccggtacttgtacttgaggatccaatctgctttttgcgagtgagtcagtacgcggaagttgttttcttctgcaaacttcaacccaggggttacgatcttaaccatgccccactcttcgagaagtcgcgcaatgttgttccggcgtagttcgtcttcttccgtcatatcgacttgacgaccatcgagtttcaacagttctttaaaatgcacgataaaatacttaccttgctttttcagaatgtggcacgattgccagagcattttctttttgttgtttgcaataccaatacgggttagcgtttcacggatctttaaaaaagaatcgtcgctgattagttgaatttctaacatacatcaccattgtttaatcaatttttccaatttcttttgttcagctttgtttttcacaatacccaacaaagacagagcgacctttgcgtgttttcttttccaatcctcgaacattccgaggtctttaagttcctgcaaatattccatcgctgtacgtgtatttacactgtatttttcgcgaaggatttcgataataattttctcttcaaaatcttccgatagtttagcccatgcaccgaagcgtttagccttcctaacagagttgagataatagttatagtgcatttggtcagagatactaccgcctaccagattcatcacatacgcgttgtatatcgtgtctatgtgctggctcattgcgttgtctacaaagtacttatcatacacttcatcgataaccaacggcgttttgccgttgttgatttcgtctatgatgttaaacaaggtgttttctttatccttgccgtactctttgaccagttcttcaaccttatcccaatctttagaaagccaagcggattcatgcggggataactcttcttcatccagaaattccgccaggctcatgattacgcctcccagaccatagaaagcatcaggttcatcaacagatattgcagatgaatttctttattcatcgccagcccgtattgcgcgttgttttcgcctacaatctgaatcagtgcgattttagaatcctgattcacgataggataaatcgtatcagtcaattttccgataaaggtatcgtattctgacgcatatttaataacctcagagcgcaaccctttatagttcttttctttcaacagggtaatgatatgagacacatcagaaccaacgatctcatttaggatccccgcatcaatttcaccacgtttcgagtagaacccaatcgctttgataatagaacgcgcatccggataatgctctttaacaaacgctgcaatgactttaggatcatacttgatattctcgatttcaaggataccgaaacaacgcttgattaactgtttcatcagttcgatacgttcagcatcagacggaacaccgaatttaacaggaggacaacgagaaagcagagcactatgcacaccgttaatgttgttcgctgttacaataacagaaacgtttttactgtatgcttcgataaagctacgcaagtgtttctgtgcttccgccataccagaacgatcgaattcatcaatgatgataatctttccgcctggtttctgcgtcattgatgaagcaaaacgatccagttcattacgaatgaagtttacaccacagttcgaaccgttgacaaagaacacctcagcatcaacctcacgggccaacacaagcgcgagggtcgttttaccagtgccaggggaatcagatacaagggtcatgttctcaacacgcccagatttgattatgccccgcatagcggctttgtcaccagaaggtaaaatacactcttcaatcgttgttgggcgatagcgctgatcccatgcaaattcatcaggagatcgagagattttaccgtatttggtttcgatgatttcaatattttcactaagttccataatataccttcaaaataaatggtgtaaaagaaaggggccgtagccccttaaaactatcttacttgaatgtgctacttgcttcaagtacgacgacgtaagcaacgccgttatcagaagagaattttgcggcccctttggaggaaatctctactttgtaatcgctgttgatgaactgcatgttatcaatcttcatatcaaaattgaaaacattgtcgccttcatactcaccgacttcaacggagaaagttgattgactttctttgcttttcgcggtgatgaccagtttaccatcaatcggttcaacggacaggtcggtcagtttcatcatgcgagacgctttgatcagtttttcgaaatcgttagaggtaatctggaaaatcagatctgctactggcatcaccagacgttttttcggtttcgggatcgttgttgcgtctgctgaacgttcgatgatcttcatcttgtcgccgcgaatcacgatttcaccagttgaaatatcatgagtgatttccgcgtcagtgccgacgatgttcagcatgttcaggaatgagttgagatcgtagataccaacatcttcatcaatcacatcagcaatttcagcttctgcgtatacaacgctgttgattgatttcgtcatgatgaatgaacctttggtcagcatgatcgaagagttgatttgagaaaagtttttcaggatatcaatagtttgtttagagaatttcatattcagcctttagttttcaataagtgttacttaataagtgattttacaacggtttccgctgctgtgtcaagcatatcagccatttctttaacggttgtacgcttcggatcttcgcgtcgttcgctggtaagtttacgatgttccgcaaccactttttcatcaatgtcacgatagtgtttaaaacgttcctcttgaggcatagctttaaacagttcttttgtttcgtccgagagtttagcaacccaggatttacggacgcggttcatgtagtcaacaaaaacattactttcattcatatatttcttctctaacttagaattctttgagtgggggccgaagcccccgcttgtattacatgtctaacagtttatccaggtcatcatcaccggagctatcagaatcatccagatcgaacggtacgccgtcatcttcgcctaccggaaccgatgcaacaccaccagatgatttcacatcagatgtctgattgtcaaacttagccatttcgttatcgaagttgctcagttcgctatcaaggtcagcggaagcgctggaaccagcagaaccgatcgaactacccataactttattgaagcgagtggtcaggtcagccagcggtttaaattcgctttcagcggtaatcgggcggagatcgctcataccttcgaaaattgctttctgaacttcttcatcgtctatgtttttgatcttagccggaacaccaaacgagctatcgtcatagttaggccaatcaccaacttttttcgctttcagggtgaagttagcaccatcaaacggacaggttacagcaatacccggttcatcaagttctggattaccgttaattgcggcggtgatcttgtccatgattttcttaccgaagcggtatttgaacaccttaccttcgttttctggagcgcctgggtctttaacgatcaggacgttagcccagaaactttgtttacgaccgatctggctcagtagcttatcttctggcccgtttttgttggctttagccttctcatacagatcgttttcggaaatgtacttacatgcaggacagccgtcataatcgccgtgggtagaggaacagttctcaatgtaccactggttgtttttcttgaaagagtggctcacgatacggacgaacgccagttcatcatcggaacgtgctgggaggaatcgaataacggcggaaccgtttttctgtgcgtccagggtcagtttccattctttctcatctttctggaagccggaaccacctttcagatttgctacctgtgcctggagtttagcgggatcttgacgtttaaaaatgctgctcatattctgttttctcgtttagtttagtttgattaacgtttgtttcattaagtttcgatattttatgatatctttttcagtaaggtcaaatatttttctgtatgcctttaacttaatgctaaagtcagaccaaataatatcatcagctacttgatcgtgtttatttatgatacctaaaaatgagtcaaaaatcaaaaacgattcgtaagatatcacatttgacaggacaagtttgcttatgtaggacgttgatgatttttcgctgtacttgaacaccagagacacggggatctctttcattttggcgaattcgtacacgtttttaacgtcatccacaaacacgttatctagtctttgtaactttcctatgtactgcctgtaaaagacaatactatcttcatcaacatcgcctacccagaaatccggattggctacgaagttggagaggaatataaaatagatttctttgaatgtaaagcgttgagctaattttacaaagaaatatctatcctttcgcttgttaaaggcgttttcactaactttgatctgccagttgtattgaaggacatcaaaacgcccctggaaatgagttttcatcgccagatataacttgtatacagacaaaggcacaagccgtgaattcgcctcgctatcagcaaacggagctttgaatctcacatgaagccgtccagagtggttgatgaactatgttcaagcgcaaccgatgggcgaagcatgtttcctttgatcgcttcgtcgctaatcttatcaaggatcgcgcgaggaaccgttttattcagcatcgcataatcaatagaattttcatccatccattgtagcgttgcttccatgtaggttgccccctcagaggcaaccagattttcgatatacaaaccgacttcggtcttatttccgatcatgctttacgccttatcgatcatatcatacagttcgatcagttcgttgttttcttcttcgaaagcggtacgggcctgttcgtgatacagtttgaacagtttcccgaaggtttttccatcgataccgaaatcagtttttgctttggatttgatatccttgaacgtaccgttgaagatctcaacttgagttttcacgttggatgcttctttgatcagttcttttacctgttttgctacatcagggtttgtttgtaaaaattctacactcattttgttacctcaaaaatcactcagtttttcgaacatacgggaaagtttgttatccatgaagtaacgttccattttggctttacttccggattttggagtattatacgcttcaataatcgaattttcaatatcttttggtataaattcgaaatcgcgtagttcctcattttctttgtaacgtgcggcccattcaggggtcatcaatgttgtcggatcgtctgcctccagccatgcctctaactcagaggattttaccgctggggcgcgttcaccttcaaccttcgtcacaatataatcatttctaattttaatgcaagcgatactatcttttttatcgcctttgatatttttgtatcgcagatcgttacgtggcgaaccgtacttaggcgttacccattttttctggggaggcgaccattgacgaacaccgttatatttctgtagttgtgtaaagtcgctatcagcagaaaccactaatactcgtctaccttcaccaacagcttttttcgtaacaacagcaattatatcatcagcttccgcgaattcaacctttaatccgagataaggcatattctgacggatttcttcgaacacaggattaaggaagttgttcagacgatcccaatcccattctgattcttcgtgttcgatctgacgacgttttttgtagtaccaggctttttgcctacgccagtaatttctgtcatcgaaggcaatcacgatttctggatactcacctttaaattttacaacgttaaaccgtaaagtgtcaagcaccagatgacgaatcatttcgatcgtgatggatgcttgttcctttggtttgaagttgttcatcagtgtagcgatggaaatgttagagatatcgatgaccatagtatcatcgggttccccttcatcttgcatcagcttgttcaagttaaacatgcttgcaaaactgctcatacatacctcaatttttcaaagaacggggttattgtagtaacttacgaaatgaagtcaatacaaaagaccataaaaattttgatcaataatacttgatctgatcaaatttatgatctataatttattaattaataattattttactacaatgatcattgtaggtcaagtactaaaatcaataaattttatataatttagatctgatctatagatcattagatctactttaaccttaaataatatagaatgaaatttgattttgtctacagttattatataatattcttaacttcaaagaggaaatatgaatactatgactaaagaaacaaccaatatctacgcagacaatgaaaaattataccctatcctctgtgcatggaaaaagcaaatcgccgaaacaggtgatcgcaaaatgcctaatgagttgggggctgctattatggatattgcaaacgggctatcacgtcgttacaacttcaaccgttattccgaagattggaaaatggatatgatcgatgacggaatttccgctgcaatctcaggactgcataacttcgatgaaactcgttataccaacgtttacggttacattaacaaagcatgttggcaagcattcgtaacacgtattctgtacgagaaaaaagagaacgcgaagaaatataaattcttccttgagcacgtttacgactgtgaagattcagatatggttagtattgcagacgaaggtttcattcaagatctacatgacaaactatctcagtacgaggcttccgccaccaaaaccaaagacaaggaagcggaagtattcccaacattggaagattttctatgaaagcaataattgacttaaacaaaatattaactgatatcgattacgaaattgacttgctaccctacttcgtaaaattagagttgcaaaacgtgggaatcccggttatcatcgatccaactgacgtaagaaaccccgatttcgaagtagaagaaggggttttgtcttatatgataaacgccgaaactatgatcatggagatcacttatgattgatgaagagaaagaagtactaaccagtgtggaagaagtggatccagaagaggaaattcaacaaaagatccaggaacgtgtagaagccgacgcattgaagcgagcacaaaaattcattaagaagaaccggactgagatcaaacgcctccgtagacatgcagaggaagccctattcaggggtaataaagttcagtatgtgtatgcggttaagaaacttcgtgatatgctcaaacagccgtatacagaggatttcattgatacgatgtggaacacttcactagcatcaattcgaaatatcgtagcttcacaacagaagcactaacaaacaagtagccccgaaaggggctatgagggtcttatgagaaagtacttaatgatcggggatactcacgctggcttgcgtcaggacaacccctggaatgaagaaaacctatacaatgtattcgtacaaatcgtagaacactgcaaagcaaacggcattaccgaggctttccatgctggtgatttctttgatgtgcgcaaggccaccacacaaaccacgatgaaattcattcgtgaacgtattgtgccactactggaagaagccggattacatatctatgttctggttgggaaccacgattgccagtttaaagacaagatccgccctaactcaccgcgagagattcttgatcagtatgattgcttcacggttgttgatgaaccgatgacagtaaatcttgatacttctccgctgcaatcaatcgatttgatcccgtggatttgtcaagaaaacacacagcagatttttgatttcatcaaaaagtcaaaatctcaatactgcttaggacactttgaactgtccggatactatttctataagaacagtaaagctgaacatgggcttgaacctgatttcttaaagaaatatgatatcgtgtattcaggccactatcatcacgctaacgaaggcgctaacgttttctatatcggtacacctcttaccatgagcgcgaacgatgaggacgaaaccaggggcttctatgagctatcttatggcgacggtaaacgtgaattaactttcattgctaacccagtatgccaccatcgccggatcacctatccggatcaaaaagatgttgatgttgcagattacaaaaattgctctgttcgcttgattgtacgcgaagttgataacgatttgcctaagtttcaaacaaaactggaagaaacagtttatgagttgaacattgtcgatcgtgtgatcactgattcagaagttgatactgactttgaaatcaaaagcgtatctggattgattagtgagtacatcaacaacatgcagatcactccagaagaaaagaccgaagtatctgcaataatgagtgcattgtatgcagaggttacgagcaatggaaatagttgattacgttaatattttaaacgaagaagggcgatataaagccctttataaaatgtttggatttgatgtgattgttgcagtacagcaggattcctataacgagtatgtgtcattggggttcactctgattaaagacaactatcacgaaacaaaggtttggacatttactgtcctgaatagcatggatgaagattccgtgatatactgctttgatagcacgattacaaacatgattagtgatatatcccaaaggataattgatgaaactcaaatttaaaacattgacttatcaaaatatcttgtcggttggtaacgtaccgatcgtcattgattttgattcagcaaagaaaaccctcattacgggtaaaaacggcggtggtaaatccaccatgatcgaagcgcttacatatgctctctttggtaagtcatttcgcgatctgaaagtcggacaactggtgaacagtatcaacaagaaaaaatgtctggttgaactgttgatcgaatacggcaatgatgaatataaaatcatccgtggacaaaagccgaaagtatttgagatctggaagaatggcgaaaaactgccggaagattcagccgctggtgattatcagtcacagcttgaatcaatgttgaatattaacctggtgggctttaaacaggttatcgttctgggtactgctggttatgtacctttcatggaactgaaaacaccagatcgccgtaaactggttgaagatttgttgtctttgtctatcatcagtgaaatggacaaactgaacaaatcatacatccgtggtgttaaccgtgaactggatacgctttcaatgcagattggacacgtacaacagcagatcgcaacacatcaaaagttcattgacgaacaacgggcaaaagcaaatcagaatacggcgcgttaccaggatatctacgattcccacgtagaaacagcaaaacagattaaagcgcaattagttgaacttcaaacccagatcgcagaatgtgtgatcaatggtgaagaccaaacagcaaatattcaaaaactgcgtgatggctatacacgcctctcaatgaacgtagaacagttgcagcgtcttgaggtgatgtatcgcaagggtggtgaatgtccggcctgtaaacagccaattagccccactcctgaacgcatggaagaaattgccgagaacattaaaaacggtactcagaaacttacgctgattaagaacaagcaagatcagctacagaaaatcatggatgatttactaacacaacaacgtacactaaatgggctgaaatccaaatacgaatcactacgcggtacacttcaaaatgaagttgcagcggctaaacgtgttcgggctgtcatggataaagcacaggaagacgtggtgatcgacgaatccccagttgaaaaactccgtgaagatgaaaaggaacttgattctaaacgttctggatttgtcaaggaaaaatatttcagaggtattgttacggatctgctgaaagattccggcgttaaagcgagcatcgttaaacgttatattccttacttcaataaacagattgcgtactatctggatctgttgggtgctgattatcagttcactctggatgacgaatttaacgaatcgattaaatcgctgggtcgtaatgattttagttacgcatcgttcagtcaaggcgaaagagcacgtattaaccttgcgttgcttatgacgtggcgtgatgtaaccagtaaaatttctggtgttgatttatctctcctgattcttgatgaaatttttgatggtgcaatggatcgtgaaggtgggtttgctgtgagaaaattacttgatgatattgaaggtaatgttatagttatcagtcatcaagaactggatccgcaagatttcaacaggcatattactatggctaaagttggtcgatttactaaatgtacgattgtaaacaatgattactaaaaaatgggacgacgaatttcaagccgagattcgtcgtcggttttaccatgtaggcgggattttgtatcataaaacagagagtagaccaacggtgtctgttcctgctggttactattttaaacccggtgatgtggtaaaattcaataaaacgagaaaaaagaatccgtacttacagatttgtatgaggtatgaagggaaatctaactatctgtacgtgcatagagttgtctggtttttagaatacgggtatcaagttgatcttattgaccatattgatatgaatccattcaataacgatccttctaacctacgagaagccacgacgcaacaaaatcactacaataaaaaaggaaaatctaacacatcctcaatatataaaggtgtatcatgggataaaccaacttgtaaatggaaagttggtatacaatacaataggaaaaagatccatttaggatattttgacgatgaaatagaagctgcaaaggcatatgatgctaaagctatagaaatcagcggaaaatacgcgaggttgaacttttcatgaatatgttagaaaaatcttttgaattagaaaccgctccggaaatagagcggttttatctccacaacaattttcttgaagaaaaacatatagttactatgaaagatgttgaggaagcattcaaagataaccctatagagttgacgcgaatcaagaacaacaaaagttctgtttggttcctcgaaaaaatctattgaccgaaatccataaatacagtaaagtagcccatgtaacgaaacgtgggctttgtttttatttgaggaacaataaatgatcactgaatccaaaatgacttatcaggaagcactgaaagttttgggcgcaactggtagcgaaaccagcgctgaaatgtccagactcttcaaacgtgcatccttacgcaatcaccccgaccgtggtggtagcaatgaattaatgcagaaaattaaccaggcttacgacgtagttacaaaaactgggcctagtggcgcacgttctgagactgctggtgatgttcgcgcacgttatgcacgtcaaaagaaagaatgggaagaaaaagttgatgcttactttgtagtggcgaaaaactatttcagcaccaaatttaacgcacaggaatttgcggaatacttcaccaaatacactggattgcctaccactttcaaacaggaagtaacaaaaggtagtcacggtgtttatgcttcgttccgtttcacttctggtgatgcttactttgatttcggtttcaactgcacccctccgaatggacaagggttagccgctccggattcatctgcactgggtaacgtttctgttagtacctttgtactggttggaactaaaaaacataaaatggcaagccgtgattatcaatggggcaaaaacccagataagatcactccggaaagcctgttcccgtctaaaaaactggaaagcattttcagccctgtacagaaaaatatcaaatacaaacgtgctgactacctggcgtcattccgtaagctgttaggcgctgacgttagcggaaacgatatctttgttgaagttggtacactgaaagttcgtttctatcgtcacgtattcatgcgcaaaggtgcttatgtgtttagcgcggtgtatgatcctgctgtatctaagtatcgtccggctgcacaacttcgcggaaccatgttcgaagacgaagacggcgcttgcctggatatgatcgttgatacgttcaaagagttgcagaaactgaaaccgagtgttcaaggcgttgtgaacgctatagataaaatgaacgcagagtttgcagcggggcatcgttcagcatcttttgttaaacgtgtagctgctcaggaagccgcaccaaaaccagaagagaagcctaagcgcacagttaaccgtgtgggtaaagaagaatactacgcagcactcaaagatattggtgctcgtgtaatgcctacaagcggttatgttgaatttgataacggtgctggtgttactatcaacttcaagcgtattgttgtaaaccgtaaagcatactactcattcagtagctttaatttcacgtactctggtcagaaacacattgagtggttgaaaggaatcgatatcgcagaagataccaaaggcgcaagcattagcctactcactgatactctgaaatctttacgtgggatctctgactggaacactgttaagagcgctttagatcaaatgaattctaacttcaaggcgggtaaattctccgcacctcatgtgaagaaggaagcagagcaaaaagcaccgaaacagaaagacgaaatcggcgcacagcctaccaaaccacaggcggctaagaaagatacaccagaagtggaaaaatcacaggctgttcatgcagcacgtgagaaagcgaatatgaacaacactattcgtaaaatgatgactatgttagtcaaagcacagcgcaaagacactccggaagatatcaagaaggaagttgatgcagcaattcaattgtggcgcttgacttattaatcaaatgaactataatgggaactgttaacgcagttccctttttatttgaggaaaatattatgagttgtccaacatggttacgtttggaaaatctgaaagaaggtacacaaaaacggatttatattaatcttggttgggttcctcctaccgattttcaaatggctgagattttaatcaatgctgttaaagaagtaagcgacacttacgaatgggaaaggctctattttcctttgattggtttgtatatgacgcgaaataaatttgaagaaatgaaacttgctgttattcgcgctacgattattaattcccaacaaagatttactttgaaaaatgcatggagttctgaatgattattcaagtatctgtacagggtgacactctgactgtcaccgaatccatcaataccgctcttgctgtatgtcgtgaccatatctcacaaaatcctccagtgactgagatcctggaaattgatgtttgggatcagattgggatgatcgacgcatcatatggatttaccccgcgagatgaagaactatctcgtatcgaatcatggctgaatgaacaggaaacggaatgaaactccctaagaacacaacactactaacccgcgaaaaacttcactctgttgattggtgtcctctggatatcatgatttttgatattgaatctcgcgtgatcaatgcaaaatatcaggggtgtagtattttctctgttgaattcgagaagattcgcgggtatgatgagaagtacaaagaaaaactgaaagttatgattgaagcattgggctatattgtaactgttgaagacaacaaaatgtggatcgcaatatgagcatagtaaaagcggtgtttgcgctggggcatgatatctaccacgatgatttcgcttttggatatcagcaaggcttgccgtggggccactgtaaagaagatttacagaacttcaaagaagaaaccgccgatagcgttctgattatgggtgcaaatacgtttacctctcttccgggtaaactacttggtagaattcattgcgttctgtctggttccggtagttttttgaaaaccaaaaaaggcgaggttgctgattacgtgatccacggtggcgggttgtctgctgctattggtacaatgcaagcaacacacccagataaaaatgtgtgtgtcattggtggtaaggggttgcttttagattcaatcaataataaaatggttgatgaagtagttttgacacacatttacggacatcatgtgtataacgcaccagcgtttaaacgtgatgttgcatttactctttctgaactgggtggcgcattattaaaatatgaattttctgatttaaaaactcagtacataaaagaacatgaacgcattgaaaaaatcgtagttgaacgatataaaaaggtataaaatgaaacaatatctggatattattaaacttgtacttgataacggtgttgaatcaactgatcgcactggtgtaggtactattcgtattttcggcgcacaagcccgatgggatctaaacagaggtttccccgcaactacctgtaaaaaactattcttcaaaccgtgcaagcatgaattgcaatggttcctgtccggttcaaccaacgttgaagaacttcgccggatgacctggggtgaaaatagcgataagcgcacaatctgggatgataactatgaaaaacaagctattgatttaggatatgattctggttatctggggccaatctacggtcatcaatggcgttcgtttggttctctttatggggatgatgatagttattatggcggtagtggtgttgaccagatagcaaaagtcattgaacaactgaaatcaaccccagacgatcgtgggatcatcgtttcggcatggaaccccgttgatcttgatgatatggcattgcgtccgtgtcactgtttctttcagttcgttgtaatcaacggtaaactgtctctacagtggtatcagcgttcagttgatgtcttcttagggttgccgttcaatatcgcctcctatgctctcctgacgcatattatcgctgatatttgcgggtacgaagtgggcgatctggtttggactggtggtgatgtccatatctataaaaatgcggttgaacaagcaaaagaacttttacagcctaaccgttcaccaatgccattaccgattctaaaaatgccgaaggtaaatagcttacttgatttagatcaagaattctttgactcgataaccttagaagggtatcataatcacggctctctaaaagctgaaatggcagtatgaaaaatggggcttcggcccctttcttaacaaggtaagagaatgaatgacattaaagtagtagtaaaatcctctggtgtacgccagccgtttgacaaagaaaaaatatacaaagtgctcaagtgggcctgtgatggtcataatatcgatgttcgtgcattccttgaaaatgtattagaactgatccgcgatggtatgactaccaaacaaattcaacgtatcgctatcaagtatgcagcagatcatatttctgttaaagaaccggattggcaatacgtagcatcgaatcttgaaatgtttgcattgcgtaaagacgtttacggtcagttcgatcctatcccgttctacgatcacatcgttaaaatggttgaagcggggaaatacgataaagagatcctggaaaaatacagcaagcaagatattcaagttttcgaacgtgcaattgatcatgataaggattttgaattttcgtatgctggttcccaacagttaatcgggaaatatctggttcaggatcgcgatactggcgaaatctttgaaacccctcagtatgcgtttatgcttattgcgatgtgtctgcatcaggaagaaactgggttagcacaggttacgcatatcgttgatttttataacgcaatttccgatcgcaaactgtctctaccgactccaattatggcgggtgtacgtactcctacgcgccagttctccagttgtgtagtaattgaatcgggtgattctcttggttctcttaacgctgtaacctctgcgatcgtgaagtatatttcacaacgtgctggtattggggttaacgcgggacatattcgcgcaatgggttctaaaatccgtggtggtgaagctgttcatactggtgtgattcctttctggaaacatattcaaaccgctgttaaatcctgttcacagggtggcgttcgtggtggtgctgcaacactgtattatcctttctggcatctggaagttgaaaaccttctggtgttgaagaacaacaaaggcgtagaagaaaaccgcgttcgtcatcttgattatggtgtacagcttaaccagttgatgtataaacgcttaatgaatcgtgattacattactctgtttagtccggatgttgctaacgatcgtctgtatgatctgttctatgaagctgatcagactgcatttgaagaactgtatgaaagcctggaaaaagatccaactgttcgtaagaaacgcatcaaagcggttgacctgttccaacttttagcacaggaacgcgcacagacaggacgcaaatacattttcaacactcatcacgtcaaccaacagggtagttttacggttcctgttcgtatgtctaacctgtgttgtgagattgcgatcccaacgtcgccgctggatgacgatgataaaatggctggtgaaatcggattgtgtacgctaatggctatcgttctggataacgctgatatcagcgaattcccgaaactcacgcgtattgcagtacgtgcgcttgataacctgctggattaccagaactatcctgtaaaagccgctctgaaagctaaacagcgtcgttctctgggtgttggtatcaccaactatgcatcatggttagcaagcaactattgcgactactcagaagcgtataccgacaaagttcatgagttaatggaagcgtttcagtttaaccttctcgttgcttctatggaactggcgaaagaacgtggtgcgtgtggattgtacaacgataccaaatacgctcgcggattactgcctatcgattggtattgcaaaaccgttgatgaactggtagcacctgtttataattgcgattgggaatggctacgtagtcagattaagaaatacggcttgcgcaactctactctttctgctttaatgccttgtgaaagtagttcacaggttagtaactctaccaacgggatcgaacctccgcgcggtttagtgagtatcaaatcttcgaaagaaggacactataaccaggttgtgcctaaccagaataaccagattgatttctatgatctgctctgggatatggctaaacgcggtaacaaagggtatctgtctcatgtagcagttatgcagaagtttgtcgatcagtctatttctgcaaacaccaactatgacccggcaaactatgaagacgggaaagttaaaacagaagacatcattgatgatctgctgtatgctaactactacggtgttaaaactctgtactatcataatacgcgtgatggtgctggtgatgaagaagaagccgcagaagattgcgcgggttgtaagatttgattaatgccccttcgggggctttttaaaggtaaagacatgttaacagtaatgaatacaaacccagatcataaccacttagaacaacctatgttttttggtgaagatactggtgttgcacgttatgaatcgcagaaacacaaagttttcgaaagcctgacgcaaaaacagctttctttcttctggcgtccggaagaagtcgatctgtctactgaccgtatgcagtatgcaaaacttcctgaacatgaaaaaatcattttcgattctaacctacagtatcaaaccctgttagataccattcagggacgtgggcctaacctcgcatttttgccaattgcatccgatgtgagcatggaaacctggatcgaaacgtgggcgtttagtgaaaccatccacagccgtagttacacgcatattcaacgtaacttgcacattgatccttctgtacagttcgaccaaatccttcgcaatgaagcgattatgaaacgttctgcatcaatgacacggtattatgatactctgattgatgaatgtcataagctgaaaaccatcatgatgctacaggaacaggttagcggttataaaccaaatgatccggctgtcgtgtattataacgagcaatacgctaaacaggccactaagtgcaaagaagcgctgtacctgtgtatgcacgctgtgaacgctctggaagcgatccgtttctatgtgtcgtttagtttcacctttaactttgctgaacagggcaagatggaaggcaacgctaaaattatgcgcctgattgcgcgtgatgaagcattgcatcagaaaggtactcagagtaaaatccgtttgtggcaaatgggtaaagatgatccagaaatggttgaaatctcccgtaggctgaaaaaagaagcaacggctatcttcctggaagtatatgaacaggaaaaagaatgggctgaacatttattctctgttggtgatgtagaaggtgtatcgctgaaaagcactatcgcttatattgaacaccttacagatcagcgtatgcgagcggtagggcttgattcgccattcaccccgatccctaacccgtatccgtggatgaataaatggctcaaaagtgataacgtacaggttgccccgcaagaggttgaagtaagttcttacctcgtcggaaacttgaatactgaaatcagtgatgaagcgtatgcaaaatgggccagcaaatacgcgtgattgtcgggtagtaaacaagtacaaaactgattgggatgtcgatattcaaagaggtacgaagttcggcaacccttatcacacaggaaccaggggagaaaacattttagcgtttatcccctggttccagaatcaggttcgtactggggcgatcacgattgaagaattgaaagaacttgatggaaagaggcttggttgtacctgtgcgcctcttccctgtcacggtgattacatcgcgcatgtggttaatgttttgtgtggtaagaaaagatcacttgactttttggatatataatgtatgaaatctgaattcaacttaacccttgataaatgtggtcgcatcgatcgaagttttgttaagtgtggtgaacttaggcattgtgtttattttattgcaattaacgatgaaatagtatatgttggtaagtgtagggatatgtggaagcgtttagatacatatcgcaatgcaaagtattggagagaagccaaccccagcaacatcttaaaaacgtgtcgattggaaatggctatcaaaaaacgaaaaactgtgaaacttatcgtgactactcacgatgaaaatacatatcatgattatgaaatcaacatgatacgaaaatacaaccctgaatggaataaacagcactatgacaaaggcacaaactaaaattatcaataccctttacaaacaactcatgcagttgtgtggtgaatccgaaacatttttcttcgttgatcaagtaaccgtgatgggtacacctgttcgaatctttaactatcgcatggcctcatatacagactggctaaagcctggtgctctggaatgtcgcggtatcatgtttgaaatggatggagatacccccgtatcaatcatcagccgccctatggagaagttttttaactatgccgaggtaaaggcatgggaagcgcttaacgagtctcctattgaattaggcgaagttttagacgtgatgattaaagaagatggttccttgatctcaactttccttgacggtggatttctggcggtcaagtctaaaggttcggttaaatcagaacaagctatggatgcgcacagcgtgttaatggcaaatcgtgaattgctgacccgcttaactgagatcgctaaagaaaactatacggtgaacatggaatacgtttccccgaaaaaccgtattgtcgttggttatgattctcctgatctgcgtatcctgaacgttcgtcacaacatcacgggtgaatacatcccttatgatgaactctttgctgacgcgctgttacgtgcgtatctggttaagcgtgagaatatcgaagtactggatctggatgcattcgcaaaagaagcatatcagaatgaaggattcgaaggctatgttgttctgacaacgaaagggtttgtaaaaatcaaaacaaactggtatgtcaacctgcatcgcacaaaagatagcatcaccaacaataaggatcttttcctaaatattgttgagaatacggtcgatgacctgaaacagctattcagttcggatctggtctctctgaaaaagattgacgatttcgaaaaacttttccttgatagtctcaatcgtttgagtgcaaaagcattcaaagctattgaagataataaagggaaatcgcgtaaagattttgctatcagtctaagcgcggatttgtcaaacgacggtcggatcatcttcgggcctcttatgaagtacttcgaagaaaccgatccacaaaaactggtcgatcgcatcattgaaatgatggttaaaaattacgatcagttcattcctgaacaatataaatgaggttcataatgcctaagatatcatcttgggtatggcctgtaatcgtggggctatctttgatagcccttttttacattgcagtcgataccaaaattgaaaatgcatcattacgcaaggatataaaatctttgcaagacgatgtgaagaaagtaaaagagacaaatacaagcaatactgtgatctatgtcgaacaaaaaggtaaggatcagcagttggtcaaggatgccggacgtaaagatctgctgtttaaaaaaccaggactgatcgaaatcaagatcaacaaatccttcgaagagtatatggcggaatacgacaaatgaaaattgcaacgttagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtaatgccctatgacggaaatccttatgttgcattatcatatccagattcattgatttttcgtagctggatgaacgacgttaaaagacaaaaggatcagaccgataatgttctgtgtactttgggataccctgagaaatgcaaatcaaaataaccaaaacattttttcgtgacataacagaaggaaaagtttatactgcgaaaaaggataaagaaggtctatggatagaaaacgattggaatcgtgatatatggctcaatctgacgaatgagtataacaaagaactaattgaatatgagatagtgaaatgaatctgtttatgactattggcgttccgggtagtggaaaaactacctgggcgcatgagaaagcccgtgaattgggtaatactgttacgatctctcgcgatgatctgcgtagctctttgtataatgcgggtaaaggtgctggcggatacaaatacaccaaagcgaaagaagacatgattgcagaaatgcaggatcacgttgttatctccactctgaaagatggtaaaaacgtgatcatacacaacacacatctgaaagaaagtgataaaaatcactggcgtgaaattgcgttggaacacaaagctgattttcatattgaatattttgatgtgtctattgttgaactgcttcgccgtaaccacaaacgcggtcgtgatgcattacccgtttcgcgtctttgggaaatgtttaaccagtatcgtaagatccgtgggttcgtaccagcaatggaaattgttaatccccacaatcagaagtgtgtgatctttgatgtcgatggtactctaaccaaagtgggacaacgtagcccgtatgactttaccaaagtgatcaatgatccgccaaatatcccgatccagcaactgtttcacctgtacaaaaatgcagggtataagtgtgttgttgtgtctgggcgtgaaggtaatccgcaatgcgcacatgatacatgggttagcctgttgagttatggcgttgaaccggatgaaatttttatgcgtcaagaaggtgataccaggacagattttgaagtaaaagaagaaattttgtttgacaagattttagataagtattatcctgttattgcagtggacgatagagacactccggtcggaatgtggcgagcaaacgggattccgtgcttacaagtcgattatggtgatttctgattgacatataatgtgggtatgttaaagtacccacacaaaagaggattatattatgaacgttattcgtgaagataaacacatcatggttgaacttggcgatcgcattcgcgtagaaaatctgggcgattttaaccaaaaagttcgtttgttgtgccaaaaaattgctaacaaaattcaggaacagggtaaagctccgggcgggtttgaagttagcgccactccggtttctcagtactcctatattgtgtatattcatgacgtggatactaacagcacccaatctttcgggctggtgttaaatcctattactggctacgttacatgggcggctgtattatgaacgtaaaaattattgatagagcggtaattacggacgaatctgtatacccggatcctcgttattatggcggtgttttcggatacatcaaaggaactgatattgatgtagtaacaagtccgattgcagaatatgatatcaacaaaaatcagacagaagttcgcgttactacaatcaacggttcagaatatatcgttgaagcgactcctgattttatcaaacagctactaaaggtgatgaaagatgcttgatcatcctggctctatgagtatggtgctcctggaagcattaaaagcatatgatatcccttgtcatttcggtgaagtaactgttaatactatcattgacgaaatcgacaacccaaatactttcattgcttgtcttgttcgaaaatttacaagttgttttcgaccgagtccagaaaaagtagtaatcagttctgtttctgctcatcatcgagtgttagatgatggaaagattcaactttactggaaagttctttatcacgtggtgtatcatgaaaattgatgatattatgtttatgcttagagcaataagcgcttctaagttctctcaatgtgtctctgttaatgtcggtgctgcattgagaaatggtaacgggcgtgtgtttgtaggcgcaaataatacggttgatcctagtcatcgttgtacagatcagtgcaatcacttattagatgataacgggaaactgagtgaagaaaagcgccctgaacattcacaatggtcagatcgcaacgaagtacacgcagaaatgcgcgttattatgctggcggcgtctcatgaacaaatcaaagacgcaactttgtatacaactcattccccttgctcacaatgtgcgaaaaatatcgaattttgtgttgcaacaggtatgattaagcgtgtagtatatctacataaatacgatcgtggtggcatcgagtggatatggcgtctacagcaatacggtgccgaagtagtacaacttgaccccgaagaaatgaataaacatttccggatcaaataacaaatgagtaaatgtatgtctgaactgagtgtaaaagcatcctttgaatatgttttgattgaaaccaacgctaaagcggctggaactgaaattgtatcaccttctggtattgtgactggtgttcgtcaacacggcgaggaaccgatctacggcacagtgttatcatgtgggccggatgtaccggaagaatataaaaccctgcttatgggtaagcgcgtaccgcttcctcatgcacaaatggcaaacgtgccggatcctgaactgattgcaggaaaggcaacaaaagaagaagctcgcaagtatccggttaaatatgtaaccgcacactataaagcgattcaagcaatttacgaataagagatccaacatggctaaacaaattcaagcaatcatcgccgataccgtcgcaaaatctaaaaaacttttcgacaaaggcgacatcctcgaagcaccgacccgcatcgatgtaatgacttcaatgatcattgatgctcaccagggaaaactaaattcccgtgcttcggaagtaatggaatacatcgtacagttcgaggatgtatgcaaatacgccaaagctgttgatccggctgttcgcgaaatctaccgcaaacagttctaaaaatatcggccccttagctcaataggtagagctaatcactcataatggttaggttcccggttcaagtcacgggaggggccaccaaacaaggcaaggcacttagagaagcgggaggaacagaatctgattctgttggttgtaggtgcaaatcctacccttgccaccaaattagggtgcgtagcgcaatgccgttaaatggttcggaatatgcaacctttctcacggagaaggctctgttggtatccggtaataggttccccggaatgcggggtgaagtaaagaaactcccagcccactaattttaatgaggtttatatgaaatttcgtgaaactgtgaaataccataacgcggtcgaatatacacagatttttgttgatatgtctcccgcaaaattcaaagaacgttatggcatgacatttaatgaatggaaagatggattgcccgatggggactaccgaaaaaacttcaaattcaatgaatgttatgtggatgatgatccttacgatctggatatttttggtaaaacaacgcctctcattgagaattcgccagaacagctttacgaatcttgtattgactctgcatacgaaatttaaagagataacatgaaaaatttacaaaaactgtttgaaatgtctccggcaattagaaaaatcatcggagaaaatagcaatccaacgaatcgcaataaaaaattgatggaactttttgcaaaagagttcgatgattttgattctgaacttcataaagcgcttgaggcatattctaaacaagggttctttgcatcgccgcaagtaaatagcaagaaagagtatagcgaacgattctttgattgggagattgtcaatctcgttcgtagaacaaatatatctcctagcaatcaccaattgatttctcttgatacttcggtattctttatccagtatcttatcagcggtggtttcaaaaatcctgaaattccgtttacaaatgaagcggttagcagtgaatttgatgaatcatttgtatacatcaacacaaacaaataatcaaatggctatcttcggatagccttatttttggggtgtctatgcgctttttaaagtatgcaagttggatcgtactcgtccctcttgacattattactggagtattagcaattctgtttgccccgtttgttgtaccattctacaacgagaaaacagggcatcttcctaaaggcttccggtggatggaaaccttcgataaccctattgatggtgatggtggacatatccgccgttgggcgtccatacgctatcatctgggggattttggggtgtacatgcaacgtgttggctggttgtggagaaacaaggcttataacttcgcatatcacgttttaggacgtgaagcgacaagcaaattcaactggaaaggcaacccaaaaacagaaggtgggccgaaccctgtaaatcatgggtatctgctcatgtggaacgaatcagcatggggtttgtacgtttacaaaccgtggctacggatccacaaagtgcaattctgtttgcgcgtttatgctggatggaaactgaaacaagaagttagcgacccagttaacctggatcgtgcaatgctggcgtttcatttcaacccgttcaggtattatgtaatcaagtaaaggtaatacaatgaaagcatttcaaattttagaaggtttgcatactggtacgatctatctggaagaaggtaacgacgttcggatcgtagtatcaaaaacattaactatggattctgtgatcggtaaagctcgcgttactccgtttgaaaagcgagagattgagatcgaatatcaaccaactgttaaggtggaaggtggacagcatttaaacgtaaacgtgttgcgccgcgaaactctcctggatgcggttgaacatcctgaaaaatacccacagttaacgatccgtgtttctggttatgcagtgcgttttaactcactgacccctgaacagcaacgcgacgttatcgcccgaacctttacagagagtctataatggcaatttctgatattacgggttataaaccccatactgataaaaaagtagaaacagtaaaccgtatcaaagatgctgaaaatgcattaggtgcaatcctggaagatatcgaacagcgcctatcaaattcagatattgattcgctgatagatgaagaattagatgaggtgcttgaacgtatccatcaaattcaactggcgaaagaccgactgaaagaagcctctatgtgggcgtgtcgtgcggtgtttcagcctgacgaaaagtattaaaaatcaagccgttgccgaaaggtagcggcttttcttttttggtgtaaaaagttgttgactcccttctcacattcccttatagttaatcccgtagacaagaaaacacttttatgaggatgacattatgaaacgctcttacaacatgaatgaactggttttcttcaaaactcgtcgtgaagcacgtgcttacgttctggcggctggtaaaaatacttctgctgctatcgatatgggtactgataaagctgttggtgctcgttgggccgctgttatcgttatcgctgctccggttactccggttaaaactctggtacttggtgcgcgtcacgccgaaactcttaacactgctgcaagcggtaggggccacgaagttaaagtgttcaagaagcgttcttatctttcatgtgcaaggggttaactatggcacgattcatatataaagtggaatacgaaaatactgagttatctgatacctttttgaaaatgattcgtgatcacgggcaacgtctggaaagagtaacgattgatactgcgtttgattgtcctgttgggttggttctaacattatcttgcagccccgcaaaagaatcagcccgtgtcgaaatgttacataaactaaatgcattttatgaaggtggtagtgtatggcgagtattgtaaaatttttcaccgactcagtgaaagaaattaaaagcgctctggaacaatggaacactcgttgtgatgtatccattaaatcagagtacgaaacaacttatgatcgttatgatccggcccgtggtttgcacaataacccccatgaggtggaagtgtgaaatactacggattcaaaacgagtcattttggtaaagcgtatcgtacagaaaacatcgatcgcaaacgtccgtactatgattctttagtacgcgcgggacgcaaacgcgctcgccaggaagggaagaaggaagcagaaaatgaactttgatcaacccattgcaatgataatcggtgctgtcctgggaatgcttcttttgtttggcggaatcccattaactgcatatatcatgaggttattctaaaatggacatcggatcaggtagtcagtatccctcatgcgctttaagcaactttgccccgcatccgtttacgttcgacggggtagaatgcgcatcgatggaggggcttttacaaagcctgaaattcagcaatccagacatgcaagcgcatgtatgtacgctggttggtaaagccgccaagttcaaaggcaagaaaaagaaatggtatcgcgatcagaccttgtactggaaaggtacaccgatccatcgcgaatccgaagcgtaccagattcttattgaaaatgcgtacaatgctcttttcctgaatgacgggttccgccgtgcgctggcagcaaccggaaaaagtaccttgacacattcaatggggaaatctcgtatgaacgaaactattctgacagaacgagaatttattagaaatttgaacaggttgagaaatttgttatgaaaagcgctgataacctaaaaaaagaaattgaaggaatcaagaaattattgcattatatcgatgttgatatagagactggaatatgtacttggaaaagacccagaaaatctataaatgttggtgatgttgctggatgtaagaaagaaaaatatcatgttatttgtttcgattataggttgtatagacgacacaggattgtgttctattttgctaaaggttacttacctcaagtagtagaccacattcatggtgttgaacatggcgacggtattgataatttacaagaggcatcgcaaagacaaaacgttattaaaaagaaaggacagaaaaacaacaaaagtggttatcgaggggtgtgttggtcgtctcgtgctgaaaagtatcgagcaactataggtattgatggaaaacaaatacatttaggatatttcgatactccagaagaagcaagtaaagcatatcatcaaaaagcgaaagaaacttttggtgatttttataatccattggttaaatgagatctgttatgagtgaaaaagaaagagtagaatgcgtgtttctgttcaaaggcgcgattaatccattagcgttactgtatgcgcaacatgcattacgttcaacgttgattcagagtgttatctataaagcaggtgtgtattatgttaccatcggcgcaaataacatggttgttattgaatcctacgttaaggaatgtgcattaaacggcgttgtctttgataaagtcgattttgatgctggggtagatgctgtttatatgtataagggttgatatgagttacgtagtttatttcgattgttcggatctcgatccgttcgtgcttcaacaggcaaagaaatatcatcaagatgtcgttggcattggtgtaacaaatgatgatatgttgtgcatcgaatttgaatattatcggacatttgagcgtgaacaattcctgggtgaattgaatgcattcaaaagtacccttttctttgatcgttatgaggttatatcttgaaacctgttattcttaccgatattgacgggatcgccgtaaaatggcaaagcggcctcccgttctttttgtctaagcacaacatgcctactgatattgcattggaaatggttacggatgaaaaatttcgtgatatgaccgaaatcttcggatgtgatcagcagttggctaaaatccttatggaagaatacaataacagttctttcattcgttatctgaatgcgtatgatgatgcattgattgtgatcaaccgtctgaaaacgcagtatgatttcgttgccgttaccgctctgggaacaaccccaacagcaagccttaaccgaattgctaacctgaatactcttttcccgtctgcgtttaaagaggtgatggtcgtgggccacggtgaaacaaaaactcatcgttacctggaagcaaaagcaaagtatggtaatcgtctggtttgctttgttgatgatctcgcgataaacttaaacgaatgtcataacgtcattagtcaattgccgttattccatatgttacgtggtgaacgtgaagaaacaaatgcacctcaccagttagtaaaatcgtggtttgaaattgaagagaaactaaatgatcttgtcaatccttaatgaacttgcgtctactctgaaaaccaaagagaaagaagcaattttaaaacgtaatgccgataatgaattattgaaagaagttttccgcattacgtatacaaaacagattatgttttatgtgcgtcaatttcctctggtagaagggaaaccaggcacaacaccgctttccgatgcaatcaaagcattactggaagatttagcaagccggaaatatacaggcaatgcagcgcgtgatcgtttactggatattgtatcatcagtgaacattaacgatcgtgaagtgctacgccgtatcattaaccgcgatctggaatgtggtgctggcacaaccttaccaaacagggtatggaagaaactcattcctgaacagcctcaatgcctcgctacgccgtttagtgaaaaggctttacgtcgcatcattttccctgcttactcgcagcttaaagccgatggtgcgcgttgcatggctgatttgctggaagcattaaaccgtaaggtatcgagagcgggtaacgagtacgaagggttaactcagcttgatatcgatctgaaaaagattcgcgattatctgggatatgatgtagttctggatggagaattgatttatgttccttccggaaccgtaccaacattacctgaacctgaaacagacatgcctttttctttatctgctttcatggacgatgatgataacgacattgcgttatttgcggaagaagttcgcaaagtatcgaccccagaagaagaacaggccgaagcaaaacgcgaagaagggaacgggatcgtaaacaaatctctgaaagggacgatcaccgaagaagaacagcgaaacattgtttatgttgtttgggatattattccatatgaggtgtattacggcgaagctgaaagtgttcagacttatgatgagcggtttagcctgttgcgtgatatcctcctggatctttctctgccttctgttcgtttgattcagtctaagctggttaataacattgcagaagcgaagcaggactataacaattaccgcaatgatggtaaagaaggttctattctcaaaaacagaaacttcaaatggaaagattcgcgagtagccgatcaggttaagctgaaaaacaaaaccccgattgaactacggatcattgatatctacgcgcacactaaagaagaccataaggtcggcgggtttgtggtggaagatttatccggaatggctcgaacgaataccggatctgggttaactgataccgattatcgttacgatgatgatggtattacccgtgtatacattccattagatgaacgtggtgaactggatcgcgaatacatcatggcgcataaagatgaatacattggggccattgtagaaatggaagttgacggcctccagaagtcgaaaacgcgtaagaaaggggaaccggaatacagtttcttccttcctattatcaagaagataagacgcgataagaccgaacccgacgatattcatattgtctttgcagatctattttaataaaaagcccttgactccggtcgggggctttgttatattgcatatcgaaacgtaaatcactgagagaatatattatgactagtagttatcagaaacacaaaacccttatggcaaacctgtccggtaaacatatcgacgaagtaaaatctctgctgacagtaaccgaaggttcccgcttcgaaaccaatcacattatcaaaccttctgtgaagaaagtactgaaagtgatttaccgacatccggtgtatcagtgcgttcatatcatgaacagcaacgcatttattttcgtatataacgaatccgatgataagtgtgttggtattttccgaaaacctaactttgaatgcatgagcgaagcggctgttgcaaccccgatcgttgaagaatatccggattatgttcaacgcaacatgcgttatgtgcaatcccgacttgattatgcatacgatttcaattctgacgcggtagaagcgctggcggatatcctttgcaaaaaccagaaagatcgtcaaatgacaaaatatctgactgatccaacaccgccaacaattcgaatttctgttgaagttccgtttgaaaatcatttcatggcagttgaagcgcttgctaaacttggtttagaagtgaaaacagaagccgtttaatagcactttttgttaaagaagcctcttgcaatgcagggggcttttttgtatattgcacacatcgaaacgaaacagacaaaaggaacatcccatgcaaatcactaaagaactcgaaggcaaagtaatcgttctggtaaatgaagaccgtttggcacaactgggtaacggtggtgaaaaactgccagcggacgcactcgaaagcctttctaaaatgcgcgtgatgcgcgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgtgttctgggtaatgtaatggtacattacctacatcgaaacgaaaggagaaacatcatgaaagttatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagacccgaatcttcgctggtgctgtgcgaaaactgggtttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgttctgttcttgttggtaaatgctgcgataatccaaatatagttgtgatggaaaaggaacaagtatcccccgaaacatgggatcagatccaggaaatcattaaaaaccctccagcgccaactaagaaattacgtgaattgatgacaaggaaaatgaaatatgagcaaatttaaattgagtgcaaccgttcgccttattcgttggaatggtgaagagatccgttatgatgaccctgaattcgcccatgaaattctttcgcatcgtttgggattgaaaaacgcgtcattggttcaaactgttaaaacatcagcagagccggaaatttggcgttgtgttattctggatctcgataacaacattgattatgatgatcctaagaactatccgcttctggaagcacaagttgagaatgctccagaagacagacagtgttttttggttgagttgccacgcgaacattacgaaaacatcataaaggcccgtaaaaaggtcaataacaatgttttcgatctccacctcggattgtttgaggattaagtactgctagttgtgttcgtagtagcggcgctggtaggttcccccacctgtatacattcaagtgtttgcaggtggaaatcttttgatacgtctcgaacacattcaacgatcagatattttcctgcatactcttccccaaatacctcaatgattgcccctaccttaacatctaaacgaccctgctttatatcgaatcggatccggcgttcatagctggataacaattgcattttagacgcctggaaaggtttaccttctgaatctgggttctgaaagttggtatcatagattgcattacggtttgtgaagatccatgtattctctgtgtctgtatcagccagtatatcaccgtacatctttttatcagtcaatgacaaactaaagaaactggcgtctttaaacagcgttgtgttatccttatgggtaatgtactgggcttctgtgaatatgacagtatcgccaacaaacacgttatcaacgttaaatttgtatgctgggatcggtgtctgggccagaatgtcagttgaacttttaaggaaaataccggaaccatcttcccacagataacagaaatcagaagaaactacactttgcccgttgtccctgatataatcgaatatatcctgatatgtaccatttagacatccaggagggatacgtatgttaccgccgtcaacttcgggggtaagtagtttcattttgctatacagtgccgtcatacactctgtaatcgtctgtacggcgttgttactaaatgaacgggcaaacttacgtctgaacgttttatgcagcggagagaggttcatacgcagcacagagcggtttttatcgtcagtatctacgttagagtaaagcaatccgtaataatgttgttcctgtgtaccgttatactggaaagatacctgtatgatcggctggataagttgctgatagattaactgtgcgtcgtatatctgcatcagcgtttccgatgagccgttaatcatcgtcttttcactaaacgagacaagagcgggtagcaattcagtatatgcgttatcaatatatttttcgtatgatgtatataatttaatcgatgttattcgattgacgattttttcagccataaaaatccctcctaatatatcctatttactaaatagtaaataatgacccaggttcaatttgaggcaataatgaaaaataaaactcttgataaatttatgactacacggcttgaaatcaagaagactaacgttaaaaccgttcatcttccggatggaacagccattgagatccctaagatgtcgtatcgtcattttgtaaagattaagactctgaaagatgacccagttgcgatcatgcgattcatcattgatgacatcaaaccgcgtgaactgacagcagcggaaattgaatttgtgttgatccatatgtatgcacacaataacgctgattatgccaatacgcttaaagaaattgggctaaatcttgatgacctcaaaatctccgaaccttgctatgattttacgtttgacaatgtgcggttagtctttgacaaacccagcctgttaaatgctcaccttccgttcctcatcaaagaggcatatgttgacggtaagccagtagaattaactgaggataaacgagacgaattaattaattgcctgtaccgattcgaatatgatcaggtatcgcgtggtgtcctccaggaagtatacattattcatgaggggaaaaccatcaaagggcttaacatcattggtgaatgataatggctaactcttatttcaacgaagaacaaaagaaaaagtttctgaacagaaacaacaacaaacaaccagcggtcaccaaagtaacagcctcccttgatgctgaaagcgcccgtgacctaaaggaaatcaacgataacacccttgaaagtgcaatcaatactcttgatatcaaagaggggttgaaatcgttcgaagaaaaattccgtgacaaattcgcggggttcaaagaacaatacgaagaggataaaaaggaatcattagccgaacaactacctgatttcgttggcccgatccgtcctatatccttaaccgatgataactcaaaaactgttgacaatacagtaaacgttaaccaaaatggtcagttcggtaagctggaagaaaacaccgaatctatttttcatgctattaacaaacttgttgatttatatgaaaatactgataagcataagcctcttcctgaaccagtggaagaacctgatccgtatgtagacactaagaaaaaacgcatcattgatgatgaagacaaaagaagcaaaactctggatagcattgctaaaagtctggtttctattaaaggctttacatcgcagatccttagccgtttcattggttactctctggaagcaatggcaaagtttgctaaatggacgctccttattggttcgttaatctttacattcgatgtgttgcgcgtcacaatacgcaaatggttcgaagatatcctgaaagaaggggaatcctcaaaaaaactatttggtacatatctgggtaacgtaaaggctatcgtaacaaagatcgaagaaggtttgaacaactttaatatgaacaacttaggcgaatcacttcgtgacttgttcgttgagcctatgaagttattgggacaaactgtacaaacggcaatcactgagggtatcggtcgtcttattcaatcattgggtgaatcaactggtatagacagcattaccaatgccggacgcggaatgcagatcaccgctttacgtgataaacagaaatttggtcttgaattgactaaagaagatattcttatgatcaagaaacaggaactagaagaccaaaaagcggcattagaaaaagaagataaagctattgcagcacgtcatgcattaacaataactccttctcaaattcctaatggttctatctataaagttgctcctactgattatcaagaaagaaatcagaaaaccgtagatgctgataaagaacggcttgataatatgaagaaagcaacggaagaaatgcagaaacaatacgatttagctaaaagcagcgaagaggaagcacaaaaattagccgatgaggaaaacaaacgcaaccgcgcacgtatagaagaagcaaaaaggttagaacaagcgaggaaggaaggaaaacagccgccagaaggtgaagagaaaaagggtgatgatctgttgggtaaagcaaccaactatgctaactctgaaaatctggatgcagccgatatcaaatacattaacgatgaactgttggatcagcttgaaaaacgtcgtaatgaaggtaatctggacgatgtacagaaggatagaatctctgaccttatcgagcaattgcaaaacaagattgcagcccgtacagaatccagcaccccgatcgacgcacagccaccgttagcagcaaataaaccggatgctgataaagcaagcaacattcaggttaacaacaaaactgttaacaacaacgtaactcattcagtacaacgcacagagcataaaccgctcgtagcgctggcataaggaacatataatgaagttttctattattgatgacagtataaacactctcaaaaatattaaaaatcgcggtatcccctctgggggtgccgcaatcacagaatcagtattaaagcaaactatcgttaccgccgaatttccggcccaacgtgcagcaggtatcgataacgcttataatgcttcgagtctgtataataacggccttctgttcactgcatatgattttaatggtgttggtagtaaagacaactatcgttcattacgtcaggcagcacagaacccaaaacaaatactatcatctgcgacgggtaatgttaagtacaaacaagtgttgaatagttctattggtactatggaacctgtttgccagatcctgctaccgcgaagcctgaacgataacgaagtaaacagccaccgctatcaagatgcaaacgatagtttcttaaccaaagggttgagccgtgttgtttcaaacatggtatggggcgctgtagaatccatttcaggcggtattatggcagaccgaagagaagcccttgatgttggtactaaagccgctttccagggttctgacaagcgaacaaagatgtattacaatacattcgtgatcgaaagccgtaatgatttgctggaactgattaaaatctactatctgtttactgttctgggatatggtacaacttctggcggtactgctaaagaggttgctgcattggttaaacagtattacggtgttctgggtgctaaaaccgctaacgcaattagcccttccagtaacccagtaacagcgtcagattttgataatagtctgggtaatgacgtggttgatttcatttcaaacgtagaggttattaaatcgcctcctgtctggtttattcgtgatttccagtctggggattccttgcgtttacctcattcaacctttgggccagcaggtattaccagtgttcgctttggtcgttctattgataatattgtaaatacattaagagaatcaccaaataccccgatctcacttgaggtcgaaattcaatttatggaactgatcgatatgcgtcaggattctatttttgatacaaattactaaggagatatgatgttttacaacgtagatgaatttttatcaggtatggctaatcgcgattttcagcgtagcaacctgtttagcgttgtatttgcaaccagccctgcatcacgtatccttgacaacacgatcggtagtattcgagatactttgattgatggatctattagttctatcaacgcaaacaacccgaacgaattcattaatgctatcactggcggtgtgagtaaattgtttagttacaccgtcgataaggcgattatgtcgctgaacaaaacaggatttagcaaaatcatcggggcaattagcccccgtttgattacttccctgtttggtgataacatgtatggacaactgctatctgaattccgtgatgaaatgatgtataatatgggtttaagcattatgggagttaacctccctggtaaatccattgggtacgaatacgtttataatggtggcgtacctcaaatcagattcactcgccctgagaatggggaattgtcattgacgttccgcaccgattcagaagcccgtaacctgaaaatctttaacgaatggatttccgctattcgcgatgatgtaacaggacaatacgccttcattgatgaagtgacaagtactattcaggttaacttacacgatcgtgatggttcaccgcatacaacatacgtatttcagaagtgcttgcccgtcaaaatcagtaacagtgaattgagctatgagaacaacaacgaaatctggacatttactgttgattttgcctataaaacatcatgggttgttgaggctgataaagaaggctgggaagggttcaaacaatccgtagaggaaggtttagccattgcagcacgtaccgcaattacaggacaataaaggggctacggccccttttgaggatcttatgtttgatattattcgagtaacattaccatcagggatcaaacgattccctatgtttacagttaaagatcagtttaaattaatgctgacccgtattgatatggaaggtcggccccttaaagagcaacaggaaatactggatgaagtgctggatctgctttatcctgggtattccaaaacagaacaggaatacattttcagccgggtgtattgtggttcgttcggtaaaaacgttatcaaggttgtgataggcggtaaaggtgggggccactccgaagccttcatggtgattaatgatattcaactggaaaacgaatacaagctgaatgatgaaatcacattagggtttaacttcccccgtacacgcaatacaagcgaagagttgtttcttgaatgtatcagttatgtaatatacaacgaacagcgctatgaatggacatcactaaccgaagaaacgaaagagaatattcttgatatagtcgaacttgatgatgtcgaaaaaatagttactatgctaacgaaatcggttgatgtgtctatgcgcggtaaatcatttagtggtatgttaaccctgttcaagatcctgtttagtcgcggggatctggatgaatttgtgaagaccaactatctgctaaataaaaacggcctgaacctggaacctatcatgaatagtagcccaatggaaaggcaaatttatactgcattgcttgcagaagacttgaaaaaacaaggtgttgttaaatgagaaagcatgaatataaacacgttgagaaatataatgttgattatcgtcctctgacacatacagagtttacccccaatgcagattttatcaaaggggatgtttacctgtatcaaagagaatatcttttcattctggcacttctggaaagtaaaaatattgatacccgtcaactgttcatcaactgtgaagaatgtcaggaaagaattgaattccagcttaaacgcaatcaaataatggttgaagatttcgacgataaactatacgggaatgacgggatcgcgttatctgttcaccctcgtaagactggcgatgaagagatccccgatcttatcgattacgtaatgatagacggcgaacagatcatgtggagtgattgcagcgacaaagataaagaaatggtgttggatgcaatcgactatgcaacctataaatcgatttctaccgccctggataagccagcagtggtcgcaaacattccggtaaggtgttcgtgtggacatagccatatcgtctctctgagaggcttacagcaatttttaaaggtggtctaaatgggtgtaaatctgaggttgctatatagcgatatagaacctaacatgcaa

SEQ ID NO: 130 - DNA, 38962 bp, Unknown
  source: /note="Description of Unknown: 1.2-3b Bacteriophage Sequence"
ttaaagatgccctgtagttcgtaatggtcttacagggtcttctggtgtctcctagctatcccttcgggatgcgcctatggtctcacctatggtgtggccttacctaaagtggttgcctaaagagaccctttaagaatttactacaaaaatctgaatgggtatctcacagttcaagaacccaaagtacccccccatagccctcctaaagccacctaaagccagccctacccctctggtttaaccttcggttaaccttgggtatctcctcaagtggcctataggatagcctaaagtgttgcctaaagtcaatacctaaagtggtggatggcttaaggaggccgtagagaggccttaaagagtgtcctagtgtaccagttcgatagtacatctctatgtgtccctatctgttagccattcctaaagtaaaccctaaagccactacctaaagccactacctaaagcctccacctaaagagcgacgctatcttaaagacaaccagactgatagacccactgttagcctgtagtgacgccttgtagttatctgtagttatttcgttaaccctcactaaagggaataagggatacttaaagagggaataagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacgcaaggtaacaagtagtaagatgcacaacgtaacgtcaaccagcaaatcggtgtcttctaggtgacttaagcgcaccacggcacataaagcgaaacaaaatggttgacaacatgaagtaagcacggtacgatgtaccacatgaaagacaccgagtgtcgtaggtgtaaaaacgcgacatagtggatagatggcgaaagcacaagcgaccacgataataaagagcttgtcgcacttataatgcaagtgacggctaacactgaaatagcctcggctcgacgaaactgtagcctaaagttctttaacaatctggataatagctcttgagtgtaccgacgtataagcgaataactcaaggtcgcactgaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgcttcacgattgatgagttcggtcgccgctggcaagtacaataagtgttaaactcaaggtcgctccatgcgagtggcctttatgattgacattacaggaggattagcaatggttatatttatcactatcgcactctttgcggtcgctggctggtactctgagtcacgcaaggccgctcgctatcatcgcaagatggttaaactcatggaacacttggacgcagaagggcgaggctgcgaggctatcgaactggtgaaacacgcatgatgattctctttatcgcactggtctatctgtgcatcgctatgtactttatgcgagactttaagcgcggtctggtaatacacaaggcaacgctgagttactttaagtggggattcatcccacggtttacggttcgtgaacgtaacggacgatttaaggccaacaaggtaggagtattctacattgctacgcactaactcaaagcacgtaaagaccgcactgtatgcgatggcgtatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctgccgattgagcgcctgaacgaacgccagcccatgctggtggctcttgcggctgctatcgtgaacgatgagactcaagacggcgaactgacgcaggccaaaggtaattggggcttggagtctatggactactggcagacactggctgagcgtatgcgtgatgttggatttgtacgcttgggcaacggtcactttagcgcagcatatgagcacgcattgttaccgggcaaggttatcaaggtaggctttaagaaagaggattcaggcgctgcctatgctgcattctgccgtatgaaccaaggccgggaaggtatccctacggtgtacgacattcagcgtcatacaggctgctacacggtggtcttggactatctgacaccgcttaacgattggtgccacggtgaaagcgataagattcgccaccacttccacgctgcaagggaaatcattgaggaggattgcttcgataccgccgaagagtacccgataagcgagggcttcattgagacctgcaaggatatccgcaagttcttcttaggcatcgcatcgttcgattgtcacagcgggaacatgatgaaagaccagatgggacgcctgattatcacagacccggtatcgttcagcgcagacgacaagttaaagccgggtgagttccactgtgacccggatgaactcatcgctgagattgaggcgctgagagcgcaggaagcgattgaccgctgcaaggcacgtaaggcacgccgtgaccctaaaggagactttcaggtagcacgtaaagcccgtgccaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttggatgcaccacaataacctaaactttgcagaactggagcgccgcgctgctgcggcaatgatgatgcatgacgaggtgcgcattcagtggggcaaaccgttacacatagacgcataccttgacaggagactgcaaggctgatagagtcttttcttacaggtcatcatgaggtggcctgaataggaacgatttattcacaacgaggtaagcaatgaacatcatcgaaactatcgaaaagaatgacttctccgaaatcgaactggctgctatcccgttcaatacactggcagaccactacggcagcgcattggctcgtgaacaactggctttagagcatgagtcttatgagctaggcgagcgccgcttcctcaagatgcttgagcgtcaagctaaagctggtgagattgcagacaacgcagccgctaagccattactcgctactcttctccctaagttaaccgcacgtatcgtggagtggctcgaagagtacgcctcgaagaaaggccgcaagccagtagcctatgcaccactccagttactcaagccggaggcgtccgcgtttatcacactcaaggtcatccttgcgtcactgaccagcacgaacatgacaaccattcaggccgctgctggtatgctggggaaggccattgaggatgaggcacgtttcgggcgcatccgtgacctcgaagcgaagcacttcaagaagcacgttgaggaacagcttaacaagcgccacgggcaagtctacaagaaagcctttatgcaggtggtcgaggccgatatgattggtcgtgggctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcacagaacaccgcatggaaaatcaacaagaaagttcttgcggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatctggttcccttacaacatggactggcgcggtcgtgtgtacgctgtgccgatgttcaaccctcaaggcaacgacatgacgaaaggtctgctgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgtgcggttcactggactacgccggacggcttcccggtctggcaggaataccgcaagccactccagaagcgtctcgatatgattttcttagggcaattccgtctgcaaccgacgattaataccctcaaggattcaggcattgacgcacacaagcaggagtctggcatcgcgcctaactttgttcactcacaggacggtagccacctccgcatgacagtagtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccaattgcacgagacccaactggacaagatgcccccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttctttaagaacatctttaagctaaaccgcttgacttccgttaagttctacgcttggatgcccggtagtgatgacctccgcaagactgaatttaagttaggcttagggccgtgcggcaaggtggtcacgaagttggaatgttactcaacgtcctccgggatggtcatcttccagaccactgaggacaacgaaacgaaatccttctactacccgaaaggttcaacgtgtggtcgtatcgaacggacatacagttaaccctcactaacgggagagttaaacttaaggtcatcaacaacggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcattttccctgatggcttcatgctggatggtgaactgattgtcaaaggcgtagacttcaacacagggtctggcctgctgcgtaccaagtggctcaagaagaacaacttcatgtttgaccgtggtggtgttgagccgctgaaaggttccaaagtagcctttgagttagaccctaagcgcctgagtgtgcgcctgtatgctgtcatgccgattcacattgcggagtctggcgaggactacaatgtacagaacctgctgatgccgtatcatgtggaagccatgcgctctcttctggttgaatacttcccagaaatcgagtggcttattgctgagacctatgaggtctacgatatggattcgctgactgaactgtacgaggccaagcgtgccgaaggtcacgagggtctcattgtgaaagacccgcaaggcatctacaagcgaggcaagaagtctggctggttcaagctcaaaccagaatgtgaagctgatggcatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccatggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttcacgggtgggcctttcttcgttccggggggaattaaccctcactaacaggagacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatccccttgcgttcacctgctgattactcgcggtgagttcgtcaaggcgatgaacaaagagcgtccgcatctggaagccgtggtcacttactggcctcgcgttcgtctgttcgttaaatggcttaaggaggtactgtaatgttacaggaatattatgatatgcgtagccgcttcccggttaactctgccgttcgttattcaggagcgaaccctttgttcaagggtctgaccggaacagtgcagggctactctcacactggtcgagtcaaggttcgcttcggtattcgtgaggctgaggtgcatccatccgtactaatcccgctacctaaagtcggcccgaacgtggaagcaccgaagacagaagtcaagtctgacgtgacccatccgaaccactacatgctgttcgacaacgtggaagccattgaggttatcgcccggtcaatgaccgtcgaggcgttccgtgggtactgccttgggaacatcctgaaataccgcctgcgtgctggtaagaaatccgaactggcaacgatggagaaagaccttaagaaagcggctttctatcaggaactgtttgacaaacataaggggctgtgttatgacgcttcgtgaatgctgcgattggtgtgccgctaagtggaaccaagctattgaggatggtgacaaggcggctgctgacgcttaccaacaactgtacgcgctgtgggagcggcgctttaaggaggcccaaagtggagcaacgtgaacagaaataccttctgacaatggaaggtaacaccgagtcctttgagattccggtattcgcccggtctctcgaagaggcaacgctacaggctgaacattacgaggacgcagggttcgtagtgactcgcatccgtccagaagtgaaagcctaattaccctcactaaagggaacaacccaatcattaaccacaaaggagaaatactatggctggtttcaagaagaaaatctacacctccggtcttggcactgctgagccttatgcttacctgagtaagccggattatggcaacgaagagcgtggcttcggcaaccctcgtggtatctataaggtagacctgactctttccaataaagacccgcgctgtcaggcgatggtcgatgaaatcgtgaagactcacgaagaggcttatgctgctgccgtggaagagttcgaggctaacccgccgcaggtacagcgtggtaagaaaccactgaaaccttacgagggcgacatgccgttcttcgataatggtgacggtacgactaccttcaagttcaaatgctatgcgtctttccaagataagaagaccaaagagaccaagcacatcaatctggtcgtggtcgatagcaagggtaagaagattcaggaagtgccgattatcggtggcggctccaagctgaaagtgaaatactctctggtgccgtacaagtggaacaccgctgtgggcgcaagcgtcaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgaggatgaggacttttgagtcgcctgagccgcgaacaactgcaagctaagattcgtgccaatgtagaactggatggcgactgctggatttggcagaagtccttcggttctcatgggtacggtaacataggcactggtggcggtcgaaatgagaccgtccatcgggtgtctcatgaagtgtttaacggagagatacccaagggtctgattgtcctacatagctgcgacaacaggaagtgctgcaacccggcacatcttcgagcgggaactagggttgacaacatgaaggatgccttgcaccgctccccaataaagcgcaagctgacactggaggaagcacaggagatttatgattctaagctgtcacaaagaaaactcgctgaactctatggtgtatctcagagattaatctggaacataaagagaggtgcagcatggcagcatatggtgcaaaaggaatacgaaaagtaggaaccttccggtcaggactggaggacaaagtacataaacaactggaggctcgtggtataaaggctgaatatgaaatgtggaagattccatatgttgtgccagccagtaatcacacgtaccgaccagattttattttacccaatggaatcattgtcgagaccaagggactgtgggaagctgatgaccggaagaagcacttgctaatccgtgagcagtatcctgaactggacattcgtctggtgttctcttcgagtcgtaccaaaatctacaaagggtctccaacttcttacgccgagttctgcgagaagaaagggattctctttgccgacaaactgatacccgtcgagtggctcaaggagcctaagcgggacgtaccgtgggagaaactaattcgtgtaaaggagaaaaagtaaatggctaaagttcaattcaaaccacgagcaaccacggaggcaatctttgtgcattgctcagcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgtgaaaggttacaaccacaactccgtaggcgtatgccttgtaggtggcatcgacgataaaggtaagtttgacgccaactttacacctgcgcaaatgcaagcgctgcgtagtctgctggtcacgctgctggcgaagtatgagggttcaatccttcgtgctcaccatgacgttgcacccaaagcctgcccgtccttcgatttgaagcgctggtgggagaagaacgaactggttacatctgaccgagggtgataccatgaggatgatttgtattcgctgtgataagccgttgaagagtcgcgtaccgtcacgccagtgtcagtgcaaagacccaatcaaggctgaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacgaagagcgtgaagcaaagttatcaacgagaagacgtacaggaggcagcaagcctatgagctatgacgtatggaatttcggtgacagcaacggtcggtactctgacctgactgcccgtggcatctcaaaggagacgtgccaaaaggctggctactggctggcgaaagtggacaaccgaatgtatcaggttgcggattaccgtgaccagaatggttccatcgtgtcacagaaggtgcgcgataaggacaagaactttaagaccaccggaagtcacaagagcgatgcgttattcttgaagcacctctggtctggcggtaagaagattgtggtcactgagggcgagattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggacgtaaggcagtcgaagaggccgcacaggttctcccggctggtaaggttcgtgttgccgtgttgccgtgtaaggacgccaatgagtgtcacatcatgggtgaagacaaagcaatcttggagcaggtctggaatgcaaacccttgggtgcctgacggtgttgtctctgcgttgtcactcaaagaccgcgttaaggaagctatgacctccgaggacgctgtaggtctgctgttcgatggctgtcaaggcctgaacgatagaaccttgggtgcccgtggaggtgaagtcatcatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgatgaactattcggagatgatacgttccacctttatgactcctttgcggaggccgaagctgacaggctgttagcgaagctggcctacatgcgaacaggcttagggtgtgatgttatagtgctcgaccacatatcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaaccacatgaagaaggacgcgctgtttctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgccggatacatggaatacaacagagaaaccgggtggcttgaaccgtctagctacactggcgaagaaggagaaggagatactggctggactgaacaagacggacagtcagacttctaagtaccagtgccactgcggtcatccagactgtgatggcggaatgtaccactaattaaccctcactaacgggaacaacctcaaaccataggagacacatcatgtttaaattcattaacgctttaggtaagctggtagtcaaactgtacttcatcgaagccaagaagctggacaagaaggccaaagcagattcacagcgagccattgagttggcgaaacagtcccgtgagaaatcagatgcggctgttagtggcatccacaagtcggcagcgattgcagccaaagcacagtccatgagcaaattctttgagtaaggagcgaacactatgagcaagtcaatcactcacgcaaacaccatccgtcttccagacaccgccgaccagttctcccgccgagtacacatcaatgtacgtggcgagaaggtcacgatggtctaccgctggaaagaccacaagtctccgaaagcacacactcaacgaatgacattggatgacaagcaggtcggtcgccttatgggtgccctgactatggctgctgacaaggtggtcggagataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccacgtgagaattgtattgacacattggtactctcgcgtttacttcatgcgaaccttaaagacacagacatggggcttcttcgttccgggaaactacccggtcgtcgcttcgggtctcacgctcttgaggcatggggttatcgcttgggcgagatgaaaggtgaatacaaggacgacttcgaggctatgctggaagagcagggcgaagagtatgttgaaggtgccgagtgggtttcattcaacgagccgatgatggcgtataacgttcaagacgttgtggtcactgtcaagctcttagagaaattccttacagacctccactacttccctgcgggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcagccgaaaggtggtaaggaactcttcaagcacccacggacaggcaaaccacttccgagttatcctcgcgtggtctatccgaaacagggtggcgtgtacaagaagcctcgtaataaggcacagcgtgaaggtcttgaaccttgcgacttggacacgagggattacatggagggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaagcgtggttacgttatgttcaagatgatggtaagattcatggagccgttaaccctaacggtgcagttactggtcgtgctactcatagtttcccaaaccttgcacaagtacccggagttcgttctccttacggggagcagtgtcgtagcgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccaacgcgcgacaacgccaagaccttcatttacgggttcctttacggagccggagatgagaagattggtcagattgttggggcagggaaggagcgcgggaaggaactcaagaagaaattcttagagaacaccccggcgattgcagcactacgagaagctatccaacattctctcgttaagtcttccgcttggattggtggtgagcagaaagtccagtggaaacgccgttggattaagggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgtacatggcttgggttcacgatgagattcaggtggcctgccgtacagagcacatcgctcagattgttattgacaccgcgcaggaagctatgcgttgggtcggagagcattgggctttccgttgtcgtttagataccgagggtaagatggggccgaattgggctgtctgccactaattctataggagaaattattatggctatgaccaagaaatttaaagtgtcattcgacgttaccgctaagatggcatctgacgttcaggaaatcttggagaaagacattctgcacctgtgtaagcaggttggctcaggcgctattgtccccactggtaaacagaaagagatgattgtccagttcctgacgtatggcatggaggggctgatggccttccttgtgcgaacgtctttccgtgaggccattaaagatatgcacgaagagtatgccgataaggacagcttcaagctgtctcccgctactgtacgggaggtgttctaatgagtgaatacctgaaagtgctggcagctatcaaaggttgccctaagtcctttcagtcgaactatgtgcgaaacaatgcggctctcgtagctgaggccgcttctcgtggacacattagctgtttgactgtgggtggtcgcaatggtggagcatgggaggtcacagcctctggtgtgcgcttcctgaaacgaatgggaggttgcgtatgattatgccaaagagtgacaccgtaacgatgacccgtgatgcgtggaacgatgttagtgcgtacattgataagctggagaaagacctagagttcctgaatgcgcttaaggcgtgtggtgtggataattgggacggatactctgatgcagtagaaatggtttacggggaggatgacgaatgagcctaatcacattgaaagacttcgcggagatgcgtgaaggtaagcctatggagaagggagtgctggtcatggatggtgactggttggtctatcagtcaatggctgctgccgaagttgagacggattggggagacgacatttggactcttgagtgtgaccacgccaaggcacggagcattctcgattctgcaatcgaatcgtaccgaacccgtaagaaggcttggagtgacgctatggttgttctggcgtatactgacgatgtgaactggcgtaaggtactggttgatgagacctataaggagaaccgtaaggcgacccgtaagcctgtaggataccgtgacttcctgtcgaagctgtgggagcgcgatgagttcattcacatcaaagaggacatgctggagggcgatgacgttatgggaatcgttgggtctggtcacgaggtcttcggcttcaagaaggctgtgttggtctcctgtgacaaggacttcaagactatcccggacgttgacttcctgtggtgtaccactggtaacatcctgacgcagaccaaagagaccgctgattggtggcatctcttccagactatcaagggtgatatgactgatggctactccgggattcccggctggggcgatacggcagaaggtttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggtcagatggctcgcattcttcgcttcgaggaatacaattacattgacaaggagatttacttatggacgccgcaaagctgattaccatcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgccgcgtgcagccaaagagtatctacaggtgcgcttcaatcaggcctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaatgatatgtgctggaaaccgaaggtgaaagtccctaagatggacactaaccagattcgcgctgccgaaccagcacctttgactgagccaccgaaatctgtggtatggggaggtgatgacgatgaggacaccagcgtgtcttcctctgaggtgccaacctcaccgagcagcggtaagagcagtctcaaggtaaagctggatgacagcgcagccaagaacaagagtaaatcctccattcgctccaaggcgtttgggtaactgagtcataacatagggagaaacatcatgggattcttcaagaaaatcaagaaggctgttaagaaagtcgtgaaggaagttggcaaaccgatcgagaaggctggtaaggaagtcggtaaagccgttgggggcgctctgggtgcaggtaagcaggagattatccaacaagaggctcctgcaccagtagtgactgcgccacctccagcacagcttgtagatgtacctgaacaggataaggctgagggtgaggatgaggcacaaaccgaaagcgcacgtaagaaagcacgcgctggcggtaagaagtctctgagtgtagcccgtagctccggcggtggcatcaacatctaaggaggactgaatggctgattcaaaacgtacaggattgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaaattaatgctggcactattcccgatgcagtcgtggatgaagctgaccattagtgagtatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtatgaggaagtagaggatgttgagattgatggctccgatgccacctatccgactgacgctatgccctacattccggttcgcatggttcgcattgatggcgagtcttacggtcgctcctactgtgaagaatacttaggtgacttaaggtctcttgagaatctccaagaggctatcgttaagatgagcatgattagcgctaaggtcatcggtctagttaatccggctggcattacgcagccacgtagattaaccaaagctcagactggtgacttcgttcccggtcgtcgagaagacattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcggtacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcgggcgtggtcaagacctcgataagctggagcgctgtatctccgcttgggctgctctggctcctatgcagggagacccggacattaacctcgctgtcattaagctgcgcattgcgaacgccattggtattgatacttctggtatcctactgacggacgagcagaagcaagccctgatgatgcaggatgcggcccaaacaggtatcgagaacgctgccgcaactggtggggctggcgtgggtgccctagcgacctcaagtccagacgctatgcagggtgccgcagcacaggctggcctcgacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgcggacgttgagtttgaaccgctgggtgacactccagaagaactaagccaagtgactgagcaattaggtcagcacgaagaaggctttcaggcgatggtcgagcaggccgttgagcgtggactgagcgcagagtctgtgactcgcatctacgaagagtacgaagccgatggtatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaaccaacccggctgcggctgagtcccttgaggctgccatgatgaaccgagacttggcgactatcaaagcgattatcaatctggctggtgagagttacacgaagaaattcggtaagcctgccaaccgtagtgttaccaagcgtgctactccggttaaacctgtagctcgtcagaaagagggctttacgaatcaggctgagatgattaaagctatgagtgacccgcgttaccgtagcgatgctgcctaccgtcaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaatcaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgcctccaatgagaacattgagggtctcggtaagccgaccgtactgactctggttaagccgaccactggcgacctgactgacccggttgagctgggtaaagcgattatcgctcagttgactatcgcgcgtgcgtctctgaccaagaactacgttccggctgctgaccgtaccttctacaccactcctgataactactccgcgattctggctgctctgatgccgaacgctgcaaactatcaggcactgattgaccctgagcgcggcactatccgtaacgtgatgggcttcgaagtggttgaggttccgcacctgactgctggtggtgctggtgatgaccgtgaggacactccggctggccagaagcacgctttcccggcgacttccagcactaccgttaaggttgctctggataacgttgttggcctgttccagcaccgctctgcggttggtacggtcaagctgaaagacttggctctggagcgcgctcgtcgtgcgaactatcaggctgaccagattatcgctaaatatgcgatgggtcacggcggtctgcgtccagaagctgctggcgctatcgttctcccaaaggtgtcggagtaattcccgaccccactggagttactcttagtcagaagactatgagcttagtcgttggggcttctaaagccctgactgctacggtaactccggctgatgcagtacagacagtgacctttacgtcttccgatgtgaagattgctacggtcgatgcctctggtactgtaactgctgtgggcgctggctccgctgacatcactgctactactgtgaatggcctgacggctgtctgcaaggtcactgtgaaagcagtagagcctcccgtagaaggctaaggtctttaccggggatttactttccttcattactttatgaaccccttgggtgccctctgagggtatctgaggggttttttgctttaaaccctcactaacaggaggtaacaccatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaacattgaggaaggtgtgactcttctaccggatgcgttctctggcatgattccatttagctctgactatctgtccgtaatggcaaccagcggtcagacccaatatgtcaaccgtggtggctatctctatgaccgctctgcgaagaccgacagattcccttctggtgttcaggtcaacctgattcgtctgagagagttcgatgagatgcctgagtgcttccgtaactacatcgttaccaaggcttcccgtcagttcaacaaccgattcttcggtgcgccggaggtagacggagtgttgcaggaagaggaacaggaagcgtggcgtgcgtgcttcgagtacgagctagactacggtaactacaacatgctggatggtgacgcattcacctctggtctacttaaccgctaatcataaggaggctctatggctcttattagccaatcaatcaaaaacctcaagggtggtatcagccaacagccagatattctccggttcgctgaacagggtagcgtacagattaacggttggtcttctgagtccgagggtctccagaagcgcccaccgatgattcaccttaagacccttggcgctgctgggtatgtgggtgcgcaaccttacgttcacctcatcaaccgtgatgagttcgagcagtatttcgttgtgttcactggtgaagacattaaggtgttcgacctcgatggtaaggagtatctagtacgtggagaccgctcttatgtgcgtacagctaacccacgggaagaccttcggatggtaactgtggcagactatacctttgtgactaaccgcaaggtggttgtgcagagtaacgaccaatcggtcaaccttccgggctttaaagaccaaggcgatgcgctgattaatgttcgtggtgggcaatatgggcgtaggctctcaatcgagttcaacggggctgagcgtgctgctattcaactaccagacggctcacaaccagcacacgtcaatgaggttgacggtcaggccatcgctgagaagctggcggctcagttgcggaataacctagggaaccccaacaacgagcaagacccgaataagtggcgcttcaacgttggccccggattcatccatatccttgcgccaaataacgataacgtttggggactacagactaaggatggttacgcagaccagctaatcaaccctgtaacccattacactcagtcgttccagaagttgcctattaacgctccagatgggtacatcgtgaagattgttggtgatacctcaaagactgccgaccagtattacgttaggttcgacctcaaccgtaaggtatgggtagaaacaatcggctggaacacaaggactcacctgcactaccacacgatgccttgggcgctggtacgtgcttctgacgggaactttgacttcaagtaccttgagtggggtgctcgtactgtgggcgatgatacaactaacccatacccatcgtttaccggacagacaatcaatgatattttcttcttccgtaaccgtttggggttccttagcggggagaacatcatcttgtctcgcacctcgaaatacttcaacttcttcccggcctccgtgtctaactactctgacgatgacccaatcgacgttgccgttagtcacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtgcaagacagggcgcgaccacacggtgtggggcgtaatgtatactttgcgtcacctcgctcttccttcacatccattaaccgatactatgcggtacaggatgtaagctctgtgaagaacgcagaggacatgacggctcacgttccgaactacataccgaatggagtattcagtatatcgggtacaaccgctgagaacttcgcggctatcctcacgagcggagcaccgaaccgggtgtatatctacaagttcctctatattgatgaagaaatcaggcagcagtcgtggtctcattgggactttggggacaacgttacggtgtttgcagcacaggtgataaactcaactatgactgtattgatgggcaatgaacatgctgtgtggatgggacgcttacacttcacgaagaactctatagacattccgggagagccttacagattatacatcgacgctaagaggaaatacatcatccctaccggggcatataatgatgatacctaccagacgtccataagcctcgcagcgatttatggaatgaacttcactaagggtagagtgtctgtggtcttccctgatggaaagattatagaggtagacccgccagtcaacgggtggagtagcgacccaatattgagactcgatgggaaccaagagggacaagtggtttacattgggttcaacatcccgttcacttatacgttctcgaagttcctaattaagaagactgctgaggacggctcgacggctaccgaggatattggtcgcttacagcttcggcgtgcgtgggtaaactatgaggattctggcgcgttcaccatccgtgtgaacaacctgtcccgtgagttcatctacacaatggctggtgctcgattgggttccgacaatctgcgtgttggcaggtctaacattggaacagggcagtaccgcttcccggtggtgggtaatgcgcagacgaacatagtaactatcgagtcagatgcgtcaactccactgaacatcattgggtgcggctgggaggggaactaccttcgtcgttcttctggcatttaacttaaagtctccctgcggtgaattaaccctcactaaagggagacactaatagatacgagggttaaagcattatgtatattacaaagtgtttacaaagccacgctgacaactttcagccgtccgtagaggacattctggaagctgaggcattgggtgtcgaaccaaaggtaattcctgatgataacactgtggcaatgcttagcgataacgctgtgttggcaattggtggcaatcagggagaccgagtgtggttccttacctctaagtacgtcccactgtttaccttgaaggagcgcttagagtttcgtaagttaataatcgaatatcgcgatatgatgctgaaccagtacgagtccatttggaacttcgtatgggtaggcaataagtcgcacattcgtttcctaaagacaatcggagcggtattccacaacgagtacactctcgatggtcggttccaactattcacaatctcaaggaggcaacgtgaagaactgtaagaaatgcggagagatgaaagctgtctccgagttctataaggacaagaagagtaaggacggcctacgaagtcactgtaagccatgtcactacacgtattacaagaaggactactcaaaggcgcgagagatgaaccttaagcgtctgtacggaatcactctggaagaatacgaagcgatgctccttaagcaagacggagtgtgtgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaaatgattatgtgttggatggcagcaattcctatcgccatgatgggtgcccaagctctaagtagccagaacagtgctgacaaggcacgggtggcacagaccgaagctggacgcagacaggcaatggagatggtcaaagagatgaatatccagaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggctaatagtgtcaccgagaattaccgccgagactacgcgagtatctttgcgcaacagttgggacgcactcagtcaacagcaagtcaagtcgatgcaatgtacaagagcgaggccaaaggtaagtctggtctgatgcgtgtactagaccctctgtcaattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggcatggactaccgggcagcaaccattcaggctgagcaaccaagagcgagtcttctggactccctaggtcgattcgctaaggctggtgccgatatgtacatggcgaaagatgaacgtgataggcaacgagccgatgagcgttccaacgagattatccgtaagctgacccctgagcaacgccgacaggctatccagaatggtacactgctgtatcaggatgacccatacgcaatgcaggccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaataccagaagggtttcaatgctaacatcaccgagcgtaacattgctctgtacggcgcacatgataccttcctgagtgaccaagcgcagaagggtgcaatcctgaactcgaaggttgaactcaatggcgtcctgtctgaccctgacctgctgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtgactcttaatggcgctacgactacctatcgtgaactgatgggtgatgagcagtggcaggcaatgatgattaaggcacagcacactcaattccagaacaacgcgaagttaaccgagaagttccgactggatattaactcagcgcttaaccaagcggacactggtaaaggctgggagactcttcaaggcatcaaggccgaactcgataagattcagccgggtgaagagatgactcctgagcgtgagtggctgatttccgcacaggaacagatgcgcacccgcttcaagcaggaacaagctgagacagccaagctgatggacaagcaacagaagaccatgaataaatctctggtcatcgacaagcagttccagaagcgcctcaatggtgaatacgtctcgaccaactataaggacatgccgaccaacgagaacactggtgagtttacccatagcgatatggtcaactacgcgaaccagaagttagcggaaatcgaagcgatggacttaacgccagaacagaaagacaaactgaaattggactacctacgggcagactccaaggagggtgctttccgtgcagcgtttggtgagatgattaccgacgcgggtaacgaatggcaggctgcggtgattaacggtaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgtgcacagaagaccaaggagatgcagtttgaggatgaccgagcgtgggctgctatgatgaacgattcaacgaatcctcaaatcaagtacatgccttcgagtgtccaagggtatgcccggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaggggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttgctccagcgtgagtaccagcgtaccgcacagatgcaagctgaggcagcacgagagaaagccctcaaagaggccaacaagcgtgccccaatcagccgtgtatcacaggcgcgtgaagaagcgcgtaaacgtgtccaagagaaacggaagaagactccgaagtacatctatggacgtaaagaagactaacagtgataaggaggctccatgagctacgataagaacaaacctagcgagttcgatgggttatttcaaaaagcggcagacaaacatggggtctcctatgacctgcttcgtaaattagcattcaatgagtccagcttcaatccaaaggccaaatcaccaactggcccgaagggtctcatgcagttcaccaagggtacagccactgcgctgggactcaaggtcactgatgcagacgatgatgaccgctacaaccctgagttggctgtggatgcagccgctcgccacctgagtgacctcattcgtaaatacgatggggacgaacttaaggcagccctagcgtacaaccaaggcgagggcagaaatggtgcccctcagatgcaggcctacgacaaaggtgattgggcttcaatctctgaggaaggtcgtaactatatgcgtaacctgatggacgtagctaacagtcctcgcaagggggacttggaggcgttcggcggtatcaccccaaaggctaagggcattccatcgggggatgcatttgctggaatagggaagaagcagacggtaggaaccgacctgccggagtcaactggattcaaagtggagggtaaagagcagaaagcacctaacgtgccttatgctaaggacttttgggaaaagactggaacaacactggacgagtttaactcacgctctaccttcttcggaattggagatgcaacaagtgcggagcttcacaactctgtacttggagttgctttccgtgcagcccgtagcgacgatggttttgatttgttcaaggacaccattacgcctacccgttggaatagccatacgtggactccagaagagttagagcgtatccgtaaggaagtgaagaaccccgcgtacatcaacgtagtcactggaggctctcctgagaatctggacgccctcattaagatggcgaatgacaactacgagatggacgcgcggtctgccgatgctggtgttggtgccaaacttactgctggtatcgtcggtgctggtgtagacccgcttagttacgtaccgctagtaggtgtagccgggaagggtctcaaggtggttaacaaggctttcattgttggtactcaaagtgctggcctcgctgttgcctctgagggtatccgtacatcaatcgctggcggagaagcccactatgctgatgctgctttaggcggtctgatattcggtgccgggatgagcgcaatcagtgacgctatcgctgctggtgttcgccgttcccgtgggactgaggtcgttaatgacttcgctcctatggcacaccgcttggaagcccgtgagaccgctctgaactctggtggggaagacctgacccgtatgcctagcgagaaccgtgtgttcgaccgtgagcacgctggcgttgagtattcacctctggagaccgagccgggtgccgttgtgttgcctcaaggtcaaatccttagcgacaccaacccgctgaaccctcagactcttagcgagttcgaggctgtcaaccctgagcgtgccgcacgtggtatctctttgggtggcttcacggagattggcttgaagactctccgctctgagaacccgactgttcgctccattgcgagtgaccttgtgcgttctccgacagggatggaatcaggctctaatggtaagttcggtgcgactgcttctgacattaaggagaggctacacgcgaacaatcagcgcacctacaaccagctttatgatgctgttcgtactgcaatgaaagaccctgagttctccacaggtggtgccacaatgagccgtaaggaaatccgacaggaaatctacaagcgtgcagccttagcgattgagcggcctgagcttcaagcaaacctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgagcaatcaagattgagatggttaaacgctacggtaatgatggcttacagcgagcaatcgcggagtcatggttgacgtcttatcgtgctcgtccagaagtcaaggcgagggtcgatgagtacctgatggaacttaacggtctcaaatccgtgcaggaagttacacctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctgactggtcgtgctcgtaggaacccggaaggcgcttggggtacagccctgcgctccgtaaatgacctcacgttctttgctaagaacgcctatatgggcgcacagaacgttactgaaatcgctggtatgctggcgaagggtaacgtctctgcgataactcatggcatccctatgattaacgattgggtcaaccgtggtaaaccgcttcgtgcctctgagattaaggagatacacgggatggtgttcggtaaggaactagaccaactaatccgtccgggacgtgaagaccacgtgcgccgactccgggagtctacggacaccagcgctgcggttgccaatgtggtcggtacgattcgtttcggcactcaagagttggctgcacgctctccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagaccatgcgactcgtggagaagacggtaagttcaccattcgtgacaaacaggctttcgctaacgaccctcgttcgatggacttgtggcgactggctgacaaggtggcggatgagactatactgcgccctcacaaggtttcatcacaggactccaaagcgttcggtgcaggggtgaagatggtgatgcagtttaagaacttcgtcatcaagtcccttaactcccggttcgtccgtagcttctacgaggcaactaagaacaaccgtgcgttagaccaagcgttgacgcatatcatctctttgggtctagctggtggttactacgttgcgcaggcgcaccttaaggccgcaagcctacaggagcacaaacgtaaggagtaccttaagaacgcacttgaccctaagatgattgctcatgcgtcaatctctcgtagttcacacttaggctcaccattgagtatctacgacatgttcgctgggatggttggtagcgatacctataagtacacccgctctactgtactccctaaagagtccgagaagcgtgaccctaacaaggcggtgacaggtagacaggtggcttcaactatcgcaggtgcagttggtgagcaggttccgggtttaggttttgtgggttctgtgggcgcaacagcaattaacgccgcttccctactgtcttctccaaacaaggctaccgctctggagttccgtacaggactcttcaacacctctcgtgagttgatccctaatgacccgctatcgcagcaactcattatgaaaatctacgaggccaacggtatccgtataaaggagacgccgaagaaacaataaaccctcactaaagggagagaggtcacattctggcctcttctctcctaatgctaatttacaaaggaggtcacatggctacaactattaagaccgtgatgacttacccgctggatggctccactacggacttcaatattccgtttgagtatctggctcgtaagttcgtccgagtgacccttatcggtgttgaccgaaaggaactcatcttgaatcaagactatcgttttgcaactaagaccacaatctccacaacgagagcgtgggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaacgatggcaaccttgatgctcgtggtcgtcgtatcgtaaacgtagctgatggtattgacctcggggatgctatcactttaggtcaagtcactcggtggaacgagtctgccctgaactctaagaacgccgctgctacctctcaggccgctgccaagacctcagagaccaacgctaagacctctgagaccaacgctaagacctctgagaccaacgctaagacctctgagaccaacgcgtaccaatgggcgcagagtgctgaggactctccggtacagggtagcgagttctctgcgtatcactactcccgcaaatccgctaagagtgctgccgccgcgagtgtttctgaagataatgctaaggtgtccgagaataactcgaagacctctgagaccaacgctaagacctctgagaccaacgctgcggcctctgctcagacagctaaggatgaggcggctaagctgaccaacatgaatggctttgctgccgctattgattcagtcaacggtaacaatgttgtcatgaagggtgacttcaccattaaaggaaacggtaaagtatcaatactgaaccacagtgggctataccaagataagaccgtgaatggcgtgaactatgccaacaggatttatatggatgatgcaggggccatgcacttcgagaactaccgtgtgtctggtacttcatccaccttacgtgctggttttgttattacagataccaacaggtttgactttacagggccaacgcgagttaatggtgatatcatcgcatgtgtggatgctccccctaatccatatcttggccaatatctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcgggttctgatattagaatcaaggatgatatcactaaacctcttgatggtgctggtgagcgtattgacgcaattggtatagtggaatacacagagattgtcaccggggaacgtaaacgtgggtggctggcccaacagcttgacacgattgacccgctgtacacatacctcacgaccaccgcagaaggtagtcttttgaataccaacgacagggcgttgcttgctgacgtaataactgagcttcaagcactgcgtcaacgcgttaaagaactcgaaggataatcaacaaagccagcggacggcacaacataaggagaacacaatgctttcttttgacttcaacaacgaggtcgttaaggctgcgccgattgttggcacaggggtcgctgatggtgcggcccgactcttttggggactatcgttaaacgaatggttctacgttgcagctatcgcctacacagtggttcagattggtgccaaggtagtcgataagatgattgactggaaacgtgcaaacaaggagtaacctatgagcgacaagactttaatcaagctgctggagatgctagacactgagatggcacagcgtatgcttgctgacctccaaagcgaggagcgccgaacgccgcagctttacaacgcaatcggcaaactgttagaccgccataagttccaaatcagtaagctgaccccggatgagaacatccttggcggtcttgcgtctggtctggaagactacaacaaagtggtcggccctaatggtctgactgatgatgaaacaatcacgctacagtaagtgacatactcaaggttctccacgcggggagcctttatggatgttatttggtgcatctacgtgaaatctaaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaggcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcatcgcgcagcttaagggtgacttcgtggccttcctgttcgtattgtggaaggctttggctctcccgccgccaactaagtgtcagattgatatggcccggtgtctggctaacggagacaacaagaagtttatcctacaggctttccgtggtatcggtaagtcattcatcacctgtgcgttcgttgtgtggacgttatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagtcgtgctgatatcatcatagcggatgacgttgagattccgtctaactccgcaactcaaggtgcccgtgagaagctgtggactctggtgcaggaatttgctgcgcttctgaaaccactgctgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcagcgcatcctcgtgattgacccaagtggtcgcggcaaggatgagactggttacgcagtgttgttcaccctgaacggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgcggtatgaaggaactacgcatttgtgatacgctggagcctgtactctctacgcaccgccttgtgattcgtgacgaggtgattcgtgaggactaccagactgcccgtgacgctgatggcaagcatgacgttcgctattcgctgttctaccagttgacccgtatggcccgtgagaagggcgctgtggcccatgatgaccgacttgatgcgttagcattgggtgtggagttcctacgctctacgatggaactggacgccgtgaaggtggaggctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagcgcataaggattcaattagaccacggatggtcgctttaagaaactccttaagaatcaatgagtttgcattaaccctcactaaagggagagaggggacttaaagctactatataggttagtcattcaggttatgcaatgaccctttatgcactttaagtctacctctgtgattggtgatattatcattgtataatcacccctaccttagagcaactgaaaggaggtggctcatgttacgcttgctgattgccctgctgcgtcatagagtcacttggcgatttcttctggtacttactgctacccttgggtacgcaggtcttactgaccacatcggtcaactggaagtggccttttgctctatactctcttgtggggattaaattattgttgatgaacgacaagcggctctgagggattcgtaggtatagtttcactacaccaactcatccctgtagagtcaaccctaaaggttatac

SEQ ID NO: 131 - DNA, 109339 bp, Unknown
  source: /note="Description of Unknown: 1.2-3s Bacteriophage Sequence"
cttcggcattagtctccgaagtcttagcagctgtctcactagcttttgcattagtctccgaagtcttagcagctacttctgaagccttagagtttgtctctgaagtcttagcagctttagcactattagcagaagcagtagcagaagaggcagcttgagttgcagattgttgagaagctgccgcagagatagcggccccattctcggaagctttggcattaatctctgactgcttagctgcggcagcagaagctgcggatgcttctactgctgaagttaactctcctgctgtaatagaactgatagaattagctaaaactactgtatacttagggtacttactagcagtagttatgttatcatctatgtttagaagctgctgtataataattttagttttgattgccattattgagttactccatcactgatatagactttaccttccatgatacggaaggaaccgacctctgagccagtaccctcacgagtcattagaatgtcgtagtaaccagcaaaacgttgtcttgggttatatttatcacgttctttggatgctttattaccaatattggtaacatcggaaattgaaagactgatagtagccgccccatgagtagcatcgattacactagttctaaaggttgctaaagtctcagcattctcatcaagatttgccttgatagttccacggagtgaatagcctgttaaattcacaggggactcagttgggggataaacactatcatcaaagtccataaactgcatgataagaccatatggtactttctcatcaataacaatatcaattactcgattttctgtactcattattttaccttatatggatatacccagtagctaggtctatcttcattctgtaagaggcttccggattgtttgataacgctgcatttctatcatagataacgttaacaccgatctgagataagaaggcatcattcgccacaatcttactagcggttaccgtaccgttaactatcatattgccgtgtaaaaccattgcagggtcagcccaactggagccattccattgacgagtaaatgcagattgtggagcactactattaaactcagtcaacacgtcatatttaactggaggactaccaaaattattctgaaagaaggcattagcctggctgtcattccaacccccaagaccagaaatacctaaagagtacatcccaggaccacgttgtccatcgtgtccaattgtaccttcagtaccactccactgaactacatctgaccagctagtacctacaagtaatttgttagttactggatcaagtgtacctgtagtcacatagatattttgagtcatatccgtacggttagggggggtcttcgaccaacccggtggtggataatcttgctctagtggttttgcaggaagtgagtatgctaatttataaacgaatactgtttgtttaccttgcatacctgtaccaagatctacatcgccatttggtgtaccaattacaactttatcagagattctcaatgtatcaccatcgtaacgtatatactgtgtagcgttaccgatatctaacttagccttaccatcagtgttgtcaacgcccatccagacaccgcctgcattattaccatacttcttaccttgcgtgaagattgccgggttatctttaccggtcaggttagtaagaattacgttagcagcgttaatgtctttagtgataactttaccatcgacgttcacaatcttattaacagggtcgaatgaaatcggcgctttaccattttcatcgagtgtaccaagaactactgcaccagtagcagcatctactaagaaagtctgctcccactgtttggtgctagaattccagagtttgcccttaatacctgcgtaggtcatctctacaccggtctcgttaatgaatgcgttgtcgaaagtagtgctctcgtctataatataagtaacttcattagagttagttatagactgagtatccggaccccaagcaactgataatacacggaagcggtggcggattttgtaagggaagctagtgatagtaccagctttagctgcacccacgtttagtttgttggccttagtccatccagtttttgcaaactcatcgttactaatatactggatgatgaattcacgaacgttagcaccctcaccacgagtccagtcccattcaagacgaacatcaaaacgctccataccatcttggatatgagcagttttgaaacgcaggttagtcggagctgacggaggggtgaagttgtaggtcaggttaaacagtgacggccaggtatcatacccagaaacgtccacagtaacaccatctggcatagtgacaacaccagatactcggatgttgtatctaccaaccggaacaccaccaaaaatgatctgctcagtgatcggacctctgtagtacttagtccaggtactagagccctctggtttcatttcgatggtgacgtattccgcctcaccagatagctctacgacaaccataggggcaccaacacccacgtcgacagattctgcaaaagaggacactttggtgatcttaggagcagttttcattttgaagttaacagtgctagataggttcatacctactttagcggttattaactcctcatcgaccattgagtcatagaaagcaccctgggcagagtagacagcgccagcgattagattgttaattgtggcaatgaatgtatcaacgccggtaaagtccctacgggtagttaccccacccgtagttagccagaaagttctaccaattacgtcgtaatcggaaaagattgagtgctgaatactcgcaatcgtatagccggtcacgatattctgcagtaccattttagctggtgcattatttgaaatcatttagatatacgcccatgcaaccgacttctctccccttggtccctctgcctgtattcttggctgaagtgctctataaatccccaaagtattcgagttgttggccttatagtcgagcttattgtaactcaacaggtagctgtagttatataaactggtgatcttcgcggatctaagcagtttattagtgttgtcccttatttcaagcgtgtagaaaatccctgaaatcagcccctcttcttgtagcttatcccaccctaactctaggtcaggtccgacccattccgcaggatcaggagacaggttaagcacccggaagttttccaccacactaaggtttttagctgagttcaaatctacagaaattgttactggagagctacgacgaccattaatatcaacagcgcggatctcgaaaatagtcagcccagcaggctcacccacgatatcttggaacatcctaacgttaggcgtgaaagcagtctgctgcacaatataaggatccacacggtctgatttacgtatcgagtaatagactacgttaggggtcaggctaggaagccatgaaagctctccgtttttaccaacatcacccacctttccaccgggtgtgggggtatacttaaagtctcttggtggcaggacattattggatatttcaggaacggcctcgctactgttatccacctgcgttgagttaataaatacatcctcaccatactcctgaagagttacgtttatcttaccatcccttgtgttctccacctcatctactaggaagaacttcttattccagccataacgatcgtaggtgaatactacaggatcgttaggttctataccaaggaatttgtaaggtaaagagaaactcagagagcgagagtaacgagacttcttaagctctctatctgccaagcttctagcagtgtagtagttggttatgttagcaaaagaaagttgaagtttcttgtcaactccacgatcttcattcttaaacttagaattatagaacgttatagagttggttttccagttcagggtaggatcaattagggacgcctgaactgagttatacttctcacggcctgtagtatcagagagctccagctccccataagtatctaggaaattaagttctaacggagtttttgaatctttctctacggtaatacggaaaatacctgacaggttattcaacgccccttggaaggattctaataactcctgcacgttcttgaacacagagttggagttatccaggattgtgttcatttgcattatttgtctgttttcagcagtccaactctcccatccaacgtatctccagaaaggttgccaactagtttgataagaggtgtctatgatatttaacagatcggcctcttttctccagtcaccaatcaccattctgtctataggaatacttgcaccaaaagtagtggaggttaggtagtcaaatgtttgccatacaccattctggctggttttatccatcttaacagaaccgtctgcctggtacacttttactttacgcccacttagctctgctgatacttcaggaatatcagttctgttctccgtgatagtgaaacgtataacagcgtatgcggtgtctagtagcttgtacctagaatcccaatactccggcccgttaccattctccccttgaaggaagaaattgttagcagcagcaatgtctcttagtaccgtagctaccgtctggtctggcttaccgtggaatgtccagattcgtatatccccgttaccgtcattatatttatattcctgaccatgagtggagagagatgttgacggaagtcctgtggagattcttgccatagtatctcccgatactcttttttgtccaaagcatgtacgagaagtactgtcagtttgatcagtacagatcataggggcgtctccaaactggaagtcgaggaacccttcaatctcaccctcgcagaacgcgtaaaccacatacacaacgtttggattgtttctttctgtatccgcgaaaaccggaataccaggaactttttgagtaccatatactacaggaataaacttggccgcaaggttgaagtccaggtctacttctttagtaacagtctcgtaatactttttaaggctgtagctcttggagagaccgaataatttcttcttagattctagcttgtatcgttcttcttttacttgatatttagctaggaagttaacgctcttgttggcgtggaagaatccgtagtcctcttggtattccggtcgtttggcaccgtgagaaggtagtaattctccatttacaatctcaagcccgcggtgggaggcgtcatctgtgaagcgtccagcaactctctcaaaatcgtagaattcgttagaacagttccaagttataacagaagtaccaactccggatactgtattgctttccttgataccaccacctacaatcttacccctaaagaagagtaacgggccgttagtatctgggtccaccggaaggatttccccattgtcgtcgatgatcgcctgatatatagaaatagaacgatctaaaaatgatacgccactttgcactagcttaatgacttcgttggcatccgtaccggtaacactgaagttcaaactaccgacggttaacgtgcggttttgtttgtgactgctaattgttttaattttccctgattggaagagtataccaccatagttgatatctctcatatagtccgtcatataagcataaacagcattattacccgtggaccccgggagttcgatagagacaagatacgctaatcgtatcttgtcattgttggcaaggtaggctttcgcagaaggaaggatctgtctcataaactttctctcaggactaggttaaccccgtcgtatacaccatcaactgtgatctcttcgctgaatgaatctccgttcattaatttagtttggaaaagaatcccattgaaacgtggtctctcggagccgttggtagtgagcaacagatcagggtatagattaagtgtccatactcctgctacgtttttaaaagatgtaatcttatacacctttggatgtgtggttaactggaataaatcacctggcttaggttctccagataaggaattcgtattggtgataaccagtgtggagcctttttgtccagcggcaatgcgacagttgttcgcatcccctcttactcggtaagactcgtaatgcgggagcataacgtcgagatagccccgggtacgtttatactctaaaattgcggacgaaagtacagcatactcgtcgggaaacatcacaggataactaatgttaagaccccagtactgagtggctgttttaacttcgttaaccttgccgtttggtagctcgtctctgatcactggatcattatctatcagtgtagctttatcaaacccaaggccgttatactgaggatgtgtaaagggatctggtaatctcatgttttgttttctcctctcaatgttaatattatagtcatatcaagaaaaattttcaagataattttataaattccaaaaagaagggaggacaattacgtcctccctttagtttagttaattcaggttctttaagctcagcccttgttcattcaaggctaactctacagctgcctggaatgccgcagggttttccaacgcgtactccataaagctcttagcgtccattgcctggatattcagattaaccggtcttctagcaccgtcagaagaagtttcagaagctactttatccgctggagttactttggtaggcaccataggagttgcaacttccgtaccatgctcacccatcttataggagacacctggataggtattaccaccctctgcacgaggaataaatccgttagcactacctatacctttatcacctcgaacgtaggacagctcacctgcgtttgcgcccatgctaacgtctacgttcttctggcgctcacctaaggtcaggtaagaagcagtttcacctccagaccctgctatatcggtcattccagtagcactagacgcctgtgctagagatagagcacctgcaagtccagccgcgatcatcagaggaatagagaacggatacggaacagctgttgctgcctgcattaccgctactgctgtctggatgatgatttgcttcttagcagattcctgctgaagtttaatcttctccgcttccatctttttgatcttgttcttagactgctcagatttaccgtcacgcttctgctctgccgcgatagctgcatcaattgctgagatctgctggttagtaccgtagctgatcatctgactaactgtctgcatacctgctgcaatcatggacgtagtgtccagagacccttgagagaactggatcatagcgttagctaagttccccatactttgagctgtagcagtggcctccgagtttagctgagagagcttactgatagctgtatcgtacgacgccatctggttttccatatcggcgaatttcttgtcttccccctccagacccgtagtaggcgtatagtctgcgcccaacgactgccctacgcgatccatcatctgtgcagtacgctgagctttgagagcagccatttgagcagtagtgttagcaatctccttgctccaacgtgcctgttcatctgcgttacctttagtgaattccttcatttcctggtagaacgctaactgctcctgcattttctgtgattcgcccattagaggcttcatgctttgattgcgctcgaattcctctttacgcatctcagcagttttagcattacggtcaagctgctctttccagatttccctttctatcgaagcaatgttacgtctagactgttcggcttctttctctttatcagcctgagtcttcagtagggctaacctatctttctctacttgcagatttagtttaaggttcgccacattatactgagaatctgtcatagtgcgattatttaagagtgcgatttctcgatctatacctactatcttatccttatagaatttctcctttttagtcgcttccataccctggttcttcactttgagctcttccgtctctaacagagtcagctctttttgaatcgccttgttgtccttgttggtcgccagtacagctttcaatgcctcttttttcgcgctaagttgctgcatctctagggccctacctgcttcctctgccttatccttattacgagtggcagcgtagacctccgctatgcgcttctcaacatctagcttggacttagcctcatcattcactatcttctgatagttagacatggccttatacgcagtgttcatctcggttacagtggaatagcccagattaaggtccttagtcatttggttagccttttctgtagatccacccgccaatgactcaaccgctttaagtgcatcacccagtgccgcagtagctctagacgcagtattggaatcttgtgcaaagttctggatatcattgctcagatctccggaggttttctttatgttattgaattccttccgtagagcaactgccccgtctaacgctgcgttgtcaaatgtgtataatccattacttgcttcaacgttctgtgcaatattgagtttccccgccagttctgggttctctttctgagccttagatagagcggagtctctggcgtctttccatttttgaatagctcctgcagaatctgctaactcctgctgtaacatatacgcctgtctacgcatatctgcagtctgttgtgtaaattctttgttagctttagaggctcctaaggtaaacaggttaccgaatccactatagttggcagctgtggctagtgtggtggacatatccatcttcgcctctctatccattatctccttattaagagctgccagcttattttttacttcctctttcgccttaactgcatcatccaagcctttctgagaagcctcaaggttcataaccactgcgttagagtctttaccgtccatctgcttaattgactcttgctgggcagtagctgcctctgcagataccgaagccttagatgtgtaaaacgccgcgtttatagatgcaataactgggccaagatatttagccgccgcttgttgaaccttgcgtaatgcagaatccgcgttagcagcaaattgctcccaaggggttgctcttagcacttcgtcaaggtagccgaagcgtttggtagactctgctactaccgcattagcatatgcctgctgcttctggaaggaagttagaccctgaatgttatacgttataccagtgttagccgcattaagtattttaacgtattcggcatacgcatcatttaaacggatggttacacctaattcgtctagaagctcaatttcctgcttggacacacccttgattacgcggttgagtgcatcggtcatatcaacaccaagagtagccgctgccctacgtgcaactagagcaaactcgctgatctgtttagcatcgaaaccgtaagctgccgcagtagatgcctgacgcattgcctcttcaaaggataccgcgtggccggtagcttcctgcagcgccaccgcaagggactgaataggtgtacctgtcttcgcccctacgatagagccaaactgttctaagcggttcagctgatcccccatctttaactgatcaaaagctgcttgcagtacgtagaggttggatgccaatgcaccatataaaagcggcagaggtccagttaccatagctagagctgcgaagtttcttgtagcaccacgagcagatcctgaagtattacccagcgctcttgatgccctttccgcggcgctaccagtaccggttaacgtagagtttagaccacctagtcctgtatttacgtcccgaacccctgcgttaaggtcggtcagcttgtcggacaccttgtctgtgcttctagccatatcagccatggtggtattcattttgttgcccatagcgtcaatagcagctactatccgattcatctcagctaccatagtgcccatattaaaacctgcagcaccaccgccaccacctccagtttgtcctaagcgaatgcgttttgcaatcaacttatcgattgcagcagcggatctaattgcagccgcctctattgcatttagctctggaactactttctggaagttattgatcatcctggtagaggaagacgcagatttagtagccatatcctggaagcctttagagaaccccctttcaagtatttgggaggtagacgctagcttggtttccaaagcgtttaaggattgtgtaatggctttaaactgattaggtagctgtagtactcctcgccctgcttgaattttggctaaagctgaatttacctgattagctgcttttaccagtaggttgagctgcggaataacgcccttcaccgagttgcctagtggatttaacccgccgacactgctcatagatgcgaaagccctgcttaactgtcctaggttggcctctataccagataccgaggcttccagatctgcttttagcttggtcatggatgcaccgagtttactaacggatgtagaggtattagccaggttagtacctggtttgatcttagagagcgccgaagctgcctggttagcgttgacagaaagctccgctaagattttgttaactttgtctaagtgaggagaggacgacgtcatcgcagcggtgatatccacccccattttattagcgctagtgctaatgttatttaactgggatgtgatccttaacacagacttcgctagtccaacctcaaactcagtgaacttagttcctagcataccgatagaggaggctagggttgttaaactagtagttgatgccagtttctccagagatttctgagtcctagatactgaacgctccactgtagtgaacgttgcagggagcttgcctagactctggttaagcccctcagaactttgagtagcgctctccaaggcagcttcaacatccctgatttgtttagcggctttggatccaccacgctgcttgatatctacaagtaactctcgtattagtctatctgtcatgattttttccaataaaaaaggcctagggcattaaccctaggccaagcctcacgtggaacgcccgttggaggaaaatgtaactcactatctgctagaagacttcattttagacttcttaatagctgcttcaacacgtttgcgagaggctgccacagcatgtgagtcgaatatgttgatgatctggagtataagactcttctcatctggatcctcgactccgtagatatcgaagaaaactagtagggcacttttatccttgcctaaataggttggataatccccggggatataattgtccgataagttgttatatattgttagagcggtctgtgcgatttcagggaagtcatggatctctacaaaacgtttaagtacctcggggttaggttcctccccgagggattcgcacatcgtcagatactgctcccgtgtaattttggagtctcctcctttgacacatcgttctgcaaaggcatctatttccttaagcagtaggttccgattttgagccacgaaaagtgtctaggtggaagacagtactgttcatccaagtctcgaaagcactggagttacgcaccaacatcatcgcgttgtcgatactaaattcgactttgtcttccagacgatcttctggaacttcgatcagcattagtttctcaacatcagcgacggttagaccttcccagcctgcaatagccaccttgacgaactcttctgcgaatttatcgtcgttctgcactttaacagcgattccgttaacaaactggttctcttgcgcagcttccaggattttcttggagagcttacgtgagacgtagttaactttcagtttgaagtgtggtaggccagggtatgcaatgatgatctgtttggtatccagtgcaatatcttttaggttaatactcatttgttattctccaattagcttgattcggacaggatctgattgctcagtagggatcacatcgtaatcgatcttgtacacgtcggttaagtctaggcgttttgtgattttagtggatggaaagtccaccacaatatatttatttctgatctgtaccggtaggcccacatcaggtttaatgttatgcgtagaatctatatgaagactctttgcataatacatcgatatcaaagcagatgagttcaactcgttaacgattgctctcctattattataaatcttattgatatcgaataaacttctgtcaccccgccattcgcattgctgctggaatgacataccggctgacataagtcctgggagcactctcccattcgaagatacctgaggtaatgaaaatggtagcacctcaccttgatcaagcgtatagctattgagtgggtggcctacttcctcaaagtatcccgactcgataccaacgtttagcaccgggacactcttatctagagaaaagtcgcaggtggtagcaaaacagttatcgaaacgtaagctcgtgttcttgttaataatatatacggagaacattttaggctcaatattattactgaacaagggcatctgatacattccgtctatctctataaaccccatcaactcgaaaaatagaccttcgagagcattgctagagaagttaagagttagagaaattgaagaaggagactgagcagttatcttcgaataggcgtagttactgcgtctgtgaatcgtcctacgatttgctttaaactcttcgtaggacgttccagcagtgtaatcagacagggcgtcaaatccgtacgccctgccatcgtactcgatgactactctagactcccgcattagggagtatagcattagttatccttatggagtgaccgggttaccgtcaccagagctgatcagtttcgcaattgaagtcttggtgtacttagaagagaaacctaagtaaccctcgtcacctgcatccatctgagtaggaatagccttgaactcaatagatacaccaagcacgtcatcagtttcgattgacgggatgttcaggttagcgtgcttagccaccagaacagctgctggacgagcagtatcatattcgccacctaggatgattgctacttcgaagtcgttcacggctttcaggtcagaaaccagatctttatatagctggatagagccattggcggcatcattcatgtatgcagtcagggaaccagtcaattcaaaggatccggtgaaggaaccaataggaacgtcaacacgagacatgatgttaggagtcaggtacgtcacgttgttgttcatagtgaaagaacctcccgtgatcgggatgttataggtttttccgccggtagcattgttcttcagcttaagaatggtcagtttgttcttgatataagaactctgaatcttagcataaagagcgtcgtctataccgatggttctaggatcgaacggctgagaagctaaggtttccaagcgagtaccgttgcctgaccaggttacacgaccgatatcatcaatatctacgttaacctcagcctgcccaacctggcagttacggatcacagaccaagagctatcggtcaggatgtagatgttcaacatagccagttcgtggtacccgttgtctttaaagttgacaaccaggttagtagcattctggaatacgccagtagtacctgctagattcacggcagctccagtcgccagtccgtgccacagtaggtagtccggtagaatctgtttacctgcgtcgtcatacggcaggatataagtggagaagctccactcagcagcgtttaatgagtcattaaagcgctgcgaaccacgggtcggcttagggccagcctcatttaaagtaatatcagtggagttactgtcctggctccaggagacgtcatcctgaactaggatctcctgggtgttggccttagtgaaccccgtagtaacggttgacacgaaaattcgtgtattacgtaatagttgtacagacatttaaatttctcctgagctgtaacttatctatccagcgctcttctcagaggcatataccggactgttacgttaacttgagcaaaaccaaacggggacagtataccctcgtctgtggacaccgacgtgatctgcatgtcagtggcttcagaatcgatagttgaaccatcaggtttcattatagtatattgtaaatttcctccagtgtcaatagaggtttttacatccgctatgagtttctcaagttgcatgttaatatcatccttttctttatcatagataagaataggaatttcaaggtaaacccactgctgtgcagacggcaggtagtttccagtttcggtacccacgtggactgctatgtaagggaactcattgatctgctcaaacgaataagtctggcgggatacgttcccatacatattagtaaagaactctgtgggattactcccgtccatgtccttcttcagtcgttccactagggcatcagcaatacttgttctgtaattcattatgtaccctgatttactcttatccggtatctagagtggataaggtctcttgcagccttagcgattgcctcgccgatcagcttctgcgggttcctagcaccagggaaaggtcgtagggagagtccgcggtaggtagagacggcaggattgaacacagagtaaggcttaagcatgtagttatacgttatgttgaggtcaggagtctttgcccctgcgtcttctcttaacagcacgtctttaatcttcaaggaattagcgaaacgccccgttctaaatttaaggggtgccccagcttttttcatatccttgactaagtattctttcgctacgagttcaagtaacgctctaaggtttgtgtttgagacgaaacgcccagaagcgccagaaatagcaccagcgtaaccgttgtcagcatctgaaggatctccaaagttaacctctaccctaccggtagatcgttttcttcctatcgtggattttttaccagtgatactatttagaaggttatcgataacaccaacgtcgccttctagattaagtgacgacgagacagctttcaaaatagaggacgtccgaacattcagtagatcctccgataccggcttggtaaatcggaaggataccttgcctatggtgccatctttgtggttatccatagtttccgcactatatatcacggtgttcttagtggagtggctaccaccactcataatgtccagctgttctttaactatctgtcgagctagatcgcccaacgccactacagcctccggtatacttcgattatagtacggatgtgctccggtacgccagatttagtggtattgaaagtaacggtttctccgccaaatgtacgagactcgcggtagtccttcttgacccaatgatcgactaagaagcacgctgctaataccaagtcatcaggaatggaggtgaagccggtctgggtaaactctacttccatatacccctctggaggagagaatttcagcaggagcgtaccatccgggtagttcttatattgcgacttatcgatctcctgatcgttaatcgtaattttagtgatcgtgctaggcacgggagaagacaggaagtactttttgcgtgctggtttagtaggcaaaacgtctacaacgttagcactgtcgtcaatacctaggagctgcgtaatcagagcatttgctgccttgattaacattgggatatttgactctaagtcaggacgtttaaggcctccatatgttctccaatcagaatctgtcatgaattgcatattttacccaataaaaaaggagagccgaagctctcctttagtcggcagtatagccaaattaagcagcgtaagcaccagcaactacgccgttctcgaagaaacgcatcaggttcagacgctgagtaacgtagtacgcatcgcgctgacgttcagcctgacgctctttctcaacggtgattgcacgctgacgcggaacgatgaagttgtcacggtaaacaaccacacagaactcagcacttgcagccttagctgggaagaactcagaaaccagtaccggcagaccgtagatgcgaccaacctgaccctgcagtttgatagcggtggtagcggtaacctgtgcaacgtcctggaactcttcatcttcgatcagatcgtaataagcatccatcgaaacaaccagagccagtttgttcaggtctagaccgtggcggcccagtgaacgacgcagcttgtgaatttctttagcggtaactttaacagaaccgtcagctttagcagtagtagcaactactttaccatcgtctttagcgaactggatcagacctttcggagtaccagcagcaccagtaccggtcaggaacgctttttcgattgcgatagcgtgagcttcaatcaggcgacgacgcatgatcggcagcagagtgaagatagcatcttcttctgtttcgtcggtcatatacgctttagcagccagtttgtaagtcttgaaggtgatttcagacagcttggttttgtcttccgcaccaacagtagcaggagtaccgtaggtagaggcgtcaacccagctagcttcaccagcttccggctcaaccatcatggtcagcaatttgctagacatcggcagttcttcaaacatggtaccgataatcagtttagcctgaatgtcacgcaggatacgcagggagaagatggtttcgtacgcttcggtagaaacttcgatagaagaagagccgttaacagctttcaggtgggcttcgccacgcttagtaccgaatacatctttctgcattacgtaggacagaagaaccagtttctcaacttcgtcttcgaaatcttcctgcttaccaaacattgctttagcaacgccatcagctacgaaagagcgactattttcacgtgcggccagcagagatttgatttcttctttcagaccagtgatttcttcctgctgggagttcattgctttaacgaacgcttcagcggactgtttggatttctcatccaggttttttacaagctccagagcttctgccaggtttttacggtcttcaccagttgctttagcaaccaggtcttccatacgcttgagttctttagcttcctgctcagcagcaaatttgcgagcttcttcagctttctgagaggcggttagacctttaagctgctcagcaatgtcacccaggcccagatctttagacagttgtgcgatatcgtaagacattattatttctccattatcctttagcgtaaccagcggctactaggaatttctctaaattagaaagttcaggttgttcaacaggctggacctgcgaagattttacaaaagacttgcgaagctccatgtaatcattatggtttacagacttcgaaaggctaaaagttgagtcttggttgcagggaaccgagactacagagatctcgagtaactccagatctttaataatgaacgtttcagtcatatcgtcccattcggcatctttgatatagaagcctaccgagaacgttttaagaacctcatcacgtattaatgagtaaatctgtagatcagcagcacttacctcaccctcaaccataagtccggactcggttggtaccaggtctaggatcttaccaattgggcggctgtggttatggccgaaaagcatgatcgggttcttcataaaattcttgagggcgttactggtagtccacgcttcggagagaataacgtcgccggcgcggtctttggtaatcgtgttagcataccctttgatttttaaaggaggattatcaccctcaccgacagctttaacagatttaatctcagcattaagattaatattctgcatcgtttgctccaaacactttcgtgttgttcctcagttttcagatactattattacataccaaatcgcgaatgtcaaaagatatttgaaaatcccacacggtgtgtggaattagtaggcagtcgaaattggttacactgaaaatagttatgcactagcatataaaaatggggagccgaagctccccagttaacagatattatacatccactacaggaaccttaactgttaccgttgcagtgtcggtcttattaccgtcagctgttttaacagtaatgactacagtaccatccgcagctaggttagcaggaacagttacagtaccatccgaagctacggtagctttggtagtgtcggaagaagtgtaaattacagacttattggttgcgttagctggggctacggtaccagtaagtttgccggttttacctgcttcgattgtaagagtcttaggtgacatagtgacaccagtaaccgctacagcaacaggtttagttgcttcttcatacgcttcctcaaactgtttccaggttctacggttagtagcagcgtacccatactccttacgcagaatctggtaagtgagatgtgctttaacagttgccatcgcattgtgcggctctggcagtccgttagggaatagtgcttttaaagcgttataatcaatcattctttttcctcgtctttatttggtgcgccaccttcttgtccacttactccggtagctgatccagctacgttggcagggatgcgaattttcttcatctgctcatcggccagttcctcataaccaagttctatacgaccttcgttaccagtaaggataccattgttgaccagtgcagttacgaatttagcctctttctccttatcaggagttagtgctactacgtctttagtattgggcgttactttaaaaccgaagaagaacgtaagagagctacatactttattgagcataggcacaatagtcatgtagtagaacagctcaatgttcggtcgaatattggcgttgttacctccatcgatcaatagttgtggtaccccgagagcgatacatacatctttattaaaacgagcgatatcgttttcgaagtcgagatctttaaaggaggagatttgggagtacggcttagccttcatcccgccgtctagaatgagcacagttgattggccggtactagggttatagtccagctgaagctcttcttgtttacgttcacggagctttttatttaggatttcatctgtttctaggataagaccgataaccgtgccgttgtccaggaatttctccttgaactcaagcattttctcacgcttagtaagcgagttaattacggtagccacgcgagattgacctgtgatctgggaattaataccaccattctggccattatctttgatgaagataatctcatccacgcgatagtcgatcatattattaaagacaaatttgttaacgaattttttgtcatctgcttttacttccattagggcagcaggcagatggtacagagacgaaccgtcccaatggatatacgcacacccttcaaatagaaggtcagacactattaggcgtctaaaagtactggagtccatgtaagggttagggcgaacattaagcagcgtctcaagagttttactcctgatcgtgccataggttgttattgttttatactgttcacctacggtgtaggagcactcagcggcgctgtcaattaccatgttcgcggatctattaaggatctcaatagacgaataggctttgccagtcgtgaatggtttgacgttagtacggtgactaacatcctccaagtccctgattatgcgttgtccgcggtttagtttagtaactaaccagtcacgaatagccattataggaaccttgcgaatcctgatttctcagtcttgacgtcagtcggaagccacttcgcaaagcctgatctttcgccagtgttgcttgtacgaggtgcttctggattcatacatctttcacgttgtttctcaacccaaatcttctgtttgttagctgaaaacaacggcggttctttcgtatagaccttgtgcagggtctgatgatgaaagacacataaagaaacagtatcttctactagctcatgccaataatgttggtagaacttgtcccgattactaaggacgacttctgagtcagtgaaatccagttggaattctttagcaaagttttttactagtagagatactgtatgatagtgatgaagttcaatgttctcagcactaccacatattgcacaggatggtgctcttttatacttggccttaatcccatcccgcattatagagattgcgtctcttttatactttacgttagcagccactgctctcctccgctccgaattcttctattaaaaagtctctagcaagctctggggttatattgaagaactcagtactaccgcagaaaccagagtacgaacagcgtagatcgtagaatcttctgtgagattctttctcaagatctagagctgtggacctgtcaaagaagaatacatatctcagggctaggtcttcgaaccctgatgcacgttttacctcttggaggcgtttcttaggagatacgctaacgcctatcttggtgccggcggtagatcccataatatataggtatcccccggcaccccatgtatttgcgcagtcaggacaaccttttccggctttgatattatctagcctagatgaccactcatgtcctgaactacaacgtatacgtatcggctctttggcagatttatatacgctaataagagttaaatctaactgagataagtaatctgcaacctcttgttgggttagcttctgattaccactacatttcccacatcccttacccccatgcatgatggagtgaggagtagcttcccaggtatgcccggaaagacatgaaaatgtagtttttgttcgctggttagtatactcgccgatgatctttatgccccggtctgccagtcttgtgttaatttcttcagtagttagtttagctctagccatattaaatattcctctcattcaccctgatgtctatgagatctctcaaggtatgaatatattataactgccacacacgaaattgtaaagtgaattttataaagttggaacggaatttgtactcactactatccgttccaactcagctcttatttgccacgggaaatcgagtagatgccgtaacgcagtgcgtcacataagtgagagttggcatcgtgacgaggtttctctctggagagcttttcctccccttcttggaagtcccacttgtagttctggagtgcgtgaattaacgcagtacacgaggcgtcaacgataatcttgccctgctggaataaagcagctaggcacgctaggccatctagaacagactttttggcaggagcagaagatatttcatgctcatatgccaggtcctgtcggaactgtgcagccgcggagtcaacgaagatacggtctacattgtaccggtctatacagtgttgtatatacatggcgtgctgtgctgtagtcttctctgcctgctggtactcctcaagaatgtagtacacatcttgatcatagtggtacttaatagtcagtaccgctgtcgggtccctgtaaccaacgtcgatacctagaatagtctcgaactcatggtctgctgcaaagaagtgacccatacccgcaagatcctgcacatgctcggaaacgctgaaggtgtcgtaaatctgaccctcgaatacggagaagtccgcctcgtactcctgtttgaagtagttcttagatacagtcttacgtgcttcttcgatatctgcgagagatacgcgaggattatcccggtacgttccgtggatcgatacccactgtggaaggtcttcccggaatccctgctcatagaagcgtttaaaccagttaccgcctcgaggagtagagataaacagagctttagagttaggtttgtctaacgtaggacggagctggatatcaaaagcatcaccaccaacatcggagattgctgcttcgtcaaagataataaagtcgtatgaacgaccaaccgcggagtcagcctgtgcagcagaagccagtttaaagagcgaaccattagcaagttcaatctctttatctttggcgttctcacgctcggtttgaaggccgtatttcttaatcagacctttgatctgtgcccacccgatgtttgccagggagtagttcggagctactacaagcaccttaacgtttggctctaggagtttaaggaagcctagagtgtacgcaatgaacgacttgccaacacgacgtgatacgcatgctgtaatgaaacggtgacgtgggtcttccagtgcgtttatgattgcgcactgcgggccgtttggaacgatcccctcggtggccagcaagccggacaccgggaatttgaaaaatcgtttatcaacgccaaaatccaccacgtcagtcgtattaatataactacgtgagatttccattacttacctgcccccacaatgcgtgacaggagatccgtgtaattagagtcatgaccacctgccaagttgatctgagtattagtctggtgtacaggagctttagcttgcttcaccttctcatactcaatctgcatcttcatctcatccatcttcatcttgtgcatgagcttgaggatatccataatatccatctctgaacccattccagtttcatctagttcctccattttcatagttagaacagtgtctagaatgccaaagaatttatcacggttacggaagccagattccatgaagatatccgtaaggtacgctttgacctcaggtttacgcataatctcccggaatttaggttcctccataccaacagctaacgctgctttcgcaacgtcgctgccagactccaggtaggcctcgataactagcatgccttccggagacattgcatctggtacaattaaatcattgctcatattgcctcctttaggcaagcctttgcacagcaatcctaacatcaggaagaatcactcgcatgttcataatattagccatttcagtgttaacccatacctcaacactgccatcagctctggcaaccaaccagtatgtaatagcatagtcgccttgagtagcagagttagtagtagcaggcgcccacatggccttcatttgcatggcgttgttcccaggaataaccccacattggactaccgtaccacgaataaagtgaaagggcacacacatgttaacaggtaaacacatgatttgatgcacgcgtttctggaagtgatttccaaaaattctcagcctactatctacttcgctccactgggtaagatcttctagagggttataacatccaatccctgcagcagcgatccactcatcgtttttccagtctagagtgacgacgcaagctccatttctagagttattaatccctaaccataaggtggctagatgatggctggcgttaccgctagtacgtaggtttcccccaatatcagcgaagccggtaccacctactaggcgaagaggtcgagttgcctcagaccatactggaccccattgatttccaatctccggtggattggatttaacgtaccactgcgcatcagacctaaagttatataccccaactgtggttacgtgcatagcactaacgttaccctgcccgaattcggcactattatccggtcgagtcagaggctggttgaattgggtgtacccattattaccaatagtagcatccccattaaatctagcaacattggttgcaataaccctgatgtccggtctattacctgggctgtagtttatgtcattctggtttatgaatttccatccagtgttcattaggtttataccgtttacaataaactctctagggctgattttaatctcttggttgcgagagccaaatacgtcctctgcatagaacccctgcccattgtacttcatattagtaatataccagcgaacacgcttagggactctccagttgttatccctataaatagcgttgttaccccaaccactaccagcattattattatcagtgttctcccagcccataaaattgttgggaggcccacggaagaaaccagctttatattcaatttcctggtatgactcagtttggatattatgtgagtacggcccacccaccgggttagagcttttaccgtatctaggacccatgtgtccgtatatgttacgattgagggtctccccacgtaaacatatactgttaacaccagtagtacgcatccaaggatggcgcattgcatctgcaccgatggtaagaggtctgttaggtgcagttatcgaaccacttactatattacctgggaaagctcccctatagagtacccaaccagctttgatgattgtctggaaatttggtcgtataggctgaccaaccggcggcccaggacccctgtcaccccattctgagtttactccccaggtgtacatacacccagtaccatcacgcaacttctcattaatagtacctggagtttcctcaaaatagaaactaacatccatatgcagatcagcagaagcacaaacgttagtcttcatactagccatagtacctgcagaaacctgggaaccgacagtattactaaagtaagcgttatacgctttagcgccaacacctaaagatgtaccgtaaatgaaacgtctagtaccatcctcaaactcaacttcagttaagacaactctgtcgtagtctgcggacagtacctgaataatcctgtctggcattctagtacaacgataccaatcaccaccatcccagaggtctctttcgtgagtttctaaaactacaacgtgaggcatatcactatggaatatagtatcccaacctggatttgtatggttattgacgtctttattgttgccagaggtgagagacaatactttcttgtcacctatccttcctgcataaaaccccataaaaacctcaaaatctcacttgctaacaagtgacttttataatataatattattataaattaaatcaaccgtcaagtaaaccagattttttaaaaccatctaggaggaccactatggaagtagttataggagcacttgttttactctcaatcgtactatttgtcattaccgtaaagcaaggtaagataatcaaacggctagaacgcactaacggagtgttgcagaagtcttatgacaatcaaacccgtttgctgcataaggcacagttaaacctgtctgaatgcaaagcggaactagaatcagcaaacaaaatctacattactaagggtatggtgtaaaacatgactattgtattaattttcacaacattctttttcctggcagcagtttggtttggtgtgcgggcacatgacctgcggaacgcggtagtagcggcagatcttcgtaacaaaagtctgcatcaagagatccttcaaactcgggcagaacgtcaagtagcgatctcgaaacaccaacgagtcatgaacgatcttcggaatgacccgagcaacccgtactacatccctccagtgacaccgcaggtagcgagacgcaagcagaagcgggcaggttcggataattctcggaaagtttcgggaagtccttcatcgaactcgggaagttctcggagcgatgatggatcgactgcggcaattatagctacaaccgcggcagttgctacgtatagcgggtatgactcgggaagttcttactgcgatagcggcagtagtagctttgattcgggttgttccttttaacagctagttgatggcctaagtttgcctaagtactccctttagccttttctcaaaaatcttaatggtttacgtgaaggtgggcttagagggtcggggggtggtatggtagtccgattacccccctagctaactattagtaccctaactatttcgctagggtactattaactttcttatgatgcgatggctaacgattgaatgaattgttgcggcttaattccgtagtcgcttctttcttcttcggtcataccttcccagcaatgagctaaacgctcgcaaagatattgataatcattatcatcatccagcgcttcatctatgaatgactcacccgcaaggcgcacaccaatagacagaatatcgttgattgcggtagcgtccatcgtttgaaggccagcagcagcagcagcagccaacacgcctttattatcgtcaatcatggtgatagtagcgttcggatattcagctttaagcatttcgaaataatgagttttatagataccatctttcgaatagtacacctctttataatcggcgtcgccaatatatcggtgcaatacatcgcgggatagtatctggatattaccaccgcgccccgccctgatacgttgtttgcgtaggaaatagtaatcgcttttgctcatataacgagcggtaacaacgatgtttaatacagtgggatcattaagcgatgcccgcatatattcaaccagcggtaaaagagtgtcggtcataattgcatcatgaacgcaagccttttcccggtacatgtttaaatctaagttacctttctcatccatacacgggaacacacgggcaaaggaattaataacagtcccgtctaaatcccataacttaattgccttaattgccagtttattaaaagccatttttcatttctccggtttcggggttgttggtaattaatcaagcgagctatattataactcgctttgttaattatcagaagaataaagttaaggcatcggctaattcagccggtttaatccgggtagccattaccgggacaattgcgagcggcggcgtatattcgctagaagaataatccattacatcgcctaacagataagtatcatcataatcattttcgcttacgacgataaacataaggccagcggcggcggcgtcaatctctacgatctcgcaaatatcagcttcatagagaatagaatcagcggcgactaattgcgacacaatgccggattctttaaaatcagcggggcgcgggaggatagcggccacggcttttaataccgtggcgccgtcaacggtaatgattttttgatagctaacatgcgggcgcccttcgctatcgcgggtgataaccagactgttttctacgacgttggacgcggtgaaagatttacgattgttatagatgaaagtaagtttcatttatttctccagcttatttatttatgggttatttattgccggggcaattgccccggctttttgttatgcaaagaaagcgccgtctttaaagtcaatcaaggtacgttgaccgttttcataggtgattagatgagtctgtgaccagctagacgcgccaatgttgtaacccatatcgagggaaccagcgacgccagcagtataaacaccgccgtaaatgctaggcgtatgcgtatggccagtgttcatcttaccgagcttacggaatccttttggattgccgcgagcgccgttaatgccgttgtgaccgtgggaaccgcattcaatgcccgcgattttcatcgattcatccgtggttaggaagatcgcagcgaaatcgcagccagcaacattgcgcagggcgtaatctagtacgttaaaagtatcgtctttgttttcgattgcctcataaatcgcggcgttcaggcgataataaagatggccgttcgcgggatcttgctgaatgttcgccttactatcatccagccagcgagaaagcgcaagatcatggttagattcaacaatgaccgtttggctaaactcacgttccatttgctccaatacgcgcccggtatcgataagatcatcaattaccttgtcacgtccggcggcatattgtttcgcaaggaaaacgccactagcgcggttatgatggtttcgtgatgtaaagtcatgcacatcatgaacaatctggtaacgagggcgcaggatgtctactagagcggtttcgctagggttgtattcccagcttgccgccgcgacagcgtgatccagtttttcggcgtgtatgtcaccatattgcagcgcggcaacatgcccggttacttcttcgccaccgttaacagtaaatttatgattaagatcgtaaaacatcccgctttcatccatcgtttcgatttggcgagcaaagaagttgccgttgtcgtcgatctccaccagcaaagcgccatagttatgcagcgcttcggccttttggcccgctttttgctgaatataatttttcagcgtcgctgtgcccgttgaatacatacggcgcacaatgtcgcccttcattgccgggacactttcagcggtgattttagcgtgaccaatagccagccctttcaggccgtaggcggtcgcagtctcgccaaagccggacagcggaaaatcagcagtaggcagaatgttaatttccgccatgaatgcgaatcctgtttcacggctgcccaaaaacacgttttcattacaaatgaaatctgagaaagcatcatcatatttcagttcgtcattgccttgcccattctggaagccttttttgttgtaggcgtatttgctcactagcagggttgcgccgaggtatttcgcggcctcctgtaaggttttccagaagttagcatgagggaaggtattattctgaatcgacgttaacagaaaacggcggcccggaattaccttccagctttctacgctggaattaagctgaccagcggcaacggggcgggaatcttccaccgcaacacgttgggcgcgtttttcggccgcaggtttaacgggcttgttactatccagccaatcacaaatttcgctagaatgcttcgccgtcccgtaatgctctttgctcaattcgtcgcagatctccagctttttagcgcgcagacgtttcccccaaaagttgaggttagttgcagcggttaaaatagctttttgtttctcgagtgcaatgatcattatctaaattctccagttatgggatataggcaaaattgccaaatataacgccttgttgctggtggcgttataatttgcgactttaaactattgcgggaataatgctggccgatattccaaaagctacggctataataataaagattattgaccagcggcggcaagtattcgctttcttgaaccagaaatcacggcggaataaatccatttgttcactgcctatttccatgaaattatagtaaccatagagacaagcggcggcgaaaaatccggcaataaaaattaaggattcagtcgggaagaagatcattttacagtctccttttcttctacgctgaaagcgtaatttagaagataaatttcacgggaagataattccaacatttccggcttaaatacttcccgattgatagccatgccgtaagtatcagcatcagggttaacccacaaaacaatatattcaggtactttgacgctgggcggcgtcattacggcggcatcttgataacccgtttggattaattcatctacaacagttcccgttaatttaataacggcacctttaatcaaagccattttatttctccagttatgggggacaaaatatttaattatgcgccccgctagggaggcgcattataattattctgctgattcttttacttcatcctgaacgccaaccatacgggcgataacgtccagttgatccagcttcatttgttccaaacttgccagaccgtcggcgtcctcgatcaggccgtcggcgatggcgtgctgagtgagaacgcgcacatagtgagccttacgcagggaggaaccgccgccgactttgcgcggcttatcggacttctgatacacctttgcgctaaccagtttagagcgtacctttacatgagattcagcgccaaccgcttttgcaatgtcaatcagaccttgcgagttagccacctccagaccatcggaagcaatgataccttcatacatagaaatggcggtagcggcgtttgtttcgttccatgcaaatttttcggttttagtagcagtcatgatacatctccagttttatttaagggtttaggctagaaagttagccgctatatattctagctagaatatataacgaaaactctttattttagttttcaatttaaagctatttaaagcggcattgtatatatacgctgcctttaataattacgctgttacgtctatttcacgctatagattcgtgttaactcacaattgccgttcaaagcatgatataagttccagcacataagtttaatttgcgcaccataacattgcttgcgctgcatggaatatacatcggaagtctaacatatggggaagcatcccattatttaccgggggttaaacacattagccgttaagcgacggctaaccatttatcatctttgcgaataacctttacaacgtcgccggaatcgacccggacgctataaagttttaaatcactgttttttgctttttccgtttcggcgtataccgcattaattttatcaaacgggatcatcgccgcccctttgatatatccgattttttcattttcgcccggcttacttacgtcgccagtaacgaaaggaataaaaacggaatcaccgatcattggggttttaacgttttgcatgtttcttactccagtttagtttattgggttatccggttaacactcttttactgctagagtgttaacagaaaactcaattacccttactgagagaatcgacttttccaaatttttaaagagcggtgttgcttattgagattctataataaagcgttatcggcaggctgtcaatcgttattttgtaaagattttagataacgcatcatgttatcccaaatcatcggtaagccttgctgacctccgcgctgataagaccgataacggcgtttcatatcgcgctgcattttgaccagttccgagcttgccatttttttcaattttgccgccggtttagatgatattacaaagcgtttcatgttgtcaacctttaattagtggagtgtatgatttcgtttagtttgcataatgatttggccgtctttatgaatgaaggctaaatctacgtcgtacacatttaaataagtctctataaaatgttcggcgtctgctactgtaaacgtttttactacgtcactcagcatatatgattcttttaacatgttttcggttcccttattaagtaaagaaagccgataacgctttttatagaatcccaaatttttaaagagcgtcgcgggatgttttccgctcccgtttggcttattgcctcccggtgaatacataatagcaaattgcaggttttgagcaagcgtatatttgtaaagaagcgtaaagagaaaacaggccagcgatagataggaagcgcgcgcacgtgacacaatacttaaagaaagtcaacgaatatttttactatttttcttcaaaagggattgacaaaatctatttcacacgaggtgaggagatcgccccatacccggtatgattcatcggcttttatctaaaaccgcttagaatcgattctagagcgttttagaccctgttaataacttatacaaaaaacaaaaatgaaatttaattagttatccactagacaaacgattatttttatgaaaacacgaaataatgcttgcgtttattttatgctgtactcttgtttattgggcaagttatccacagcacaaaataacttgacaagctgagaagcggtataacgagatatccccagacttatccacaggttatcctactgtatatttatacagtatattccagcagcggtaatactctaatatgcccctagaacgctctataacgcattctaagcgctttaaatttagaagccatattaaaggccattgctagaggggcgcagaaaaacaaaaaagcctgctcattataagcaggcttattattagttagctaactattccgtataggtaatgttatcatggtcagtaaatgaaaacggcgtttcatccgtactccattcatcccataatttagcagactcatgatttcgcagtttagcaatagcaggcataatactagcttgctcattattaacaataggggcggctaactttgcatactcctccggcgttaattccacctcataggtgaggttaataaccctttgcgtgctaactaatacacgtatcttttccattatcgaaataccgtttcaattgttgacccgctagagcataccgacccgccacgataaaacaggcgttcggttttatatttggttagcagatcatagagatccagatcatcggaaagcgggtaagactcccccagcgcggaaacggaaacaggtttaccctctaccagatcacggcaaattagaatcagcaaaggccaactaatattaataggatcgccacgcaatccgattttaagtgtagccacttcatcaatatgccgcgcattctggcggctaacatattggatcacggtctccatcgttttatagtgggccagaaaatatttgttgacatagatgtaaatcatagatatactaccccgctaactttccaaccggattttaaaccttcctcaacatgaaacatggttttctccaataatgggggcggctagagatttagccgccgggaaggggattttacagcttatcgcggaaagtatcaagccggttgtttagctctttaatcgcgtcggcgtgaatttcgtcatacgttgacacgatatccgccagctcatccatagttagcgaactaacaataacggacgttttcacctccagcttttccggttccggttccgctggtggcgtatccaaaaacgttagcgagcctaaactgatcaggtacacttccatttcagtagcgccggatgcgcagtcgatttcaaagctactatcaccaatacagatatcaaagccatagccatataccccgataatcctcaaggggattcccagcatatcatctgtatccgggtaacagtcccggcggtcaatctggcgggccagattatccaaatttttcggttcgacgaaaatagcataattgccgcgatcgccattatcacgcaggtgataccagatatcggcaagcgtcatctttttaccttcaaaagtagcggtaaactgttccatttttgtctccagttagttagcagggtaattattatagcgccccattatagaggcgctagggataattattctgctacgtcgttttcaatcaggctagaaagattgacgccttttaatacctcgtcaatcatttcgccgacgttgaaactttgtaccagttccaacatggcggcttgcattgcagcgtcagccgcaatcaccgctttgcggttgttcggcgcatactggctaaccgcgaaattcagcaggttagcaattaccacacgacctaccgccgtgtcaacataaccgcgaaccataaacggcgctttgctggcggcgatgccggaaacttttttcaggacgatagaaccggcttccagtttagcagcgtttacagcagcgtttttgttagcggcaacgatagcggtagcagtagatttgatagtattcatttgtaaagctccagtctcaaaattattaaggttaactacattttcagtaacagccggggcgacttcctctagctcgccatcataacgataatttccagtccttgccccttcttcgatatcgatatcatagaagttacatggtagcaggatgcttccgtccttgtcaagcacaaaaatcatcatttcgctagaaatccgtgctggtggtagttccagatgatcacaaagatttttaatccatgcgcgggcatcagtgaaagcaagcagttcgctttcatggtagcaaaaacgtctcgacgcttgcttaccctcggacgctttatacaaataagcgtccgtagtagtagacactatcagatcaataggctggctgtcaaccaaatattgatcatcgtgataaataacaatcgccgcgccggggttggctagagcgtagtcgcggcaatgctcaaaggcatagccggatctactttccatattcgagcggtaaacgcccaaaatatgaccaatagaggcgcacttactgccatctaacaggttgcgagcgccaccgcgaaccataggcaaattagcaacgggggtaaacttctgtaacattttctgttactcctttgtttggctgggaatctattatagcaagattcccagctttttagcaagtattattttctagaaacagataccacggccccggcctacctcatcccgattttcatcgaaaatgatcacattagcattgaacgtgctacggctaacgatcatttgaatgccatccttccccggttccggttccaccataaatccccatgtaccggaatcgaccgttacagaatcgaaatcctgattccgtaacactgctgaaacagttccctcttttgcaaaggttacagaaacacggcactcaataggcctaactttttcaggggtaacgatagccggggcgctaacctccgcaagggcagcaccggaaagcatagcaaggccaacaatggcaagtttcataacattctccagtttaggggttgttcccgtttgagagattgcattatgcaggaatcagatctgattgtctaccactaaaaatagtagttgcttcctgctagggatatgctattattatgactctagacaaaggagatcgaaaaatgactttttcaatgctggctttgggtttagttggttctatgatggttatgggtttcatcgccttttgcgggtatgccctctatgataccttgtttaataaggaggctttttaatgagaactttgcgcggtggtagtcctaagagccgtagccataacgtttaccaattgaatgttattcgtgatggtcagaaaaagggcggtgacggtggcggcggtgagtggggttttcgtgtcatcatggttattattatgaccctaatctttttgcagagttgccaataatgagcggcctaatgattttgggcgtgatagttattagcgcaatcattaccctggtaatagtttcagttgtaaaccatttttggcctgagtgtttccacggcgatatgtaggaatgtcgccgccctcctccaccgcgtgaccccttactaaaatacccccacgaaaattaaatcgcttagagcgcgttctagagcgcttaaaatctacattagtagaaagtgttgctgggaaatactgtataaatatacagtatgataacctgttaataagtctgtggataactcgtctgcgaccttctcaagcgtcaacctaatttacaattttgtataactctggggataacttagataatagtgtttctcacttactttccgaaatgcgaattattctcattcgcgttcagcttatcaaacgcaaatcattctcattcgcattcaacttctcaaatgcgaatcattatcattcgtatttgcatttccgacccccgacccttcctgcgcttatgtgcgaatccgacaatttgtcaagcaaaatattacgtgaggctgctagggtatgtgcaaatccgatgaaaatttatttttaccgccctgggggcatgtgcaaatccgatactaatatgtgcgtatccgacaataatttttaaggggaaggcgcgcagtttgctgcggcgcagcggtgggcgcgagtctgggtgagtatgtgcaaatccgatgggtatttttgagggcgggataaatggggttaattggggcaattcggggatgatgggggcagggggcagataagggaaaatattatgagttaaatgggggtaaaggggttgacacagaaaaaattcctgtggctctaaaaaacaagcgaactcacggtgacacaccgtgtaaaaaggcttgaaatttcaggagatattttatattcgcagaatcgaagattttgatccacagctaccgtttgctagtatatatgtgcatatccgatagtagtttttatatgtgcatatccgatagtagtttttatatgtgcatatccgacatagctagtagatcctctagctgtgtgcaaatccgataataattttgttatgtgcaaatccgacaattactagaaacgtagaaatgcttgacttctttaatatctagacagctagagattttatttaataatgtgacacttagaacttgggcaaatgatgtgagtttgtgtgagaacttcgtgaggactttgtggagtgacgcttaggacttaggcagctagcgttttaaggtgggggatgtgtgaggacttcgtgagatgtgtggaacttcgtggaattgtgtgagtttctgggcagctagcgggtagtttttgggttggaaaataaccgccctccccttaggtgttggtagataaccgccctgtcaccaggtgtatagaaagatgactagagttcaaccctagagccgcgaaacgatggtgtgtaaggattacctatttttaaacgtgagtaatcgtgagttcattcccacgtttccctattttctccttagtttccagtaattaataattccccttagggttttaacgagctatcgcacaccccggctagcgatactgtgcagattgatcaatttttgtaatttcgcactaagtgtcttgagtcgggacagggccctgacacttacgaaattgaaaaatcaatatctgcacatctctagcggatgtgttaactatctatttaatctaacttttttatcttatagagttattctaacatacatctcaaataatgtcaagaatttttacaagagtgtttgaaaaagtgtcacggggtagatgtttaccccgtgaactcgtagactacagttgagaacgtaggttctctaactcagagaggaaggcaggattcgtttgatcgaaatccttaatgaggaggtgctgatcaaaggagaattcgtagtcttctccgtacagcttaatgaagagatctggatgttcacgtttcaacacaacatgcgctacgatactcggggtgatctcaccttcttgctggtgataatcgaataactgtagagtttcatgtctagtttctggtttagctggtttagctggttcttctttctcgatgccccaaggagtgacaaacttaggatcaccacctgggaagacggaagctcgcatcttaaagctatacgagttgagatctttcatcgccttaccgctctgccaaactgcgaagatctcatgtttaccttcagatgctctgacgggtaaataatgatcagggtagctggttagtgcacaacggaaaggatcaccattatagctgggagcgtgagaaccgtaaagtgtttcatgttttagtggttcatcttctataatatagagttcaccaatctgcggataagagaaccactgattgagaactttaacagcgaagcggtgtgcgtatggtgtcatcttgagaacgtgatacttcgctcctagatcatcctttgccgatttaccgtcctctgttactgcataacgtctacagaacatctctacgagtctacgctcgttagttgtgagagtcgagtatttacgttggtgcaactcataaagctcctctagcattccctccagcttggttaccatttcttccgggtacttcgggaatggtttttctactgcgttcagtacagtgttagacgaacttttacgtgatctttgtagtgcatttttaaatctgctcatttttttttctcttatagtccattggactcttttttatagccacgggattgtggctcttaactttcctcattccacctaggatgtgagaacggttctttattagtcaggcgttccatcatcctgcggcgttcatctgccattcgctcctcgaacacctgaagagcggcgaaactgtccactggcgtgtacggcacgccgttaactttgaggatatcctcgcctctgatcttgaatagcgggttgtcctgctgggccttagcgtggcattcgctcaagtactctgcgaaaggtttgccgtcttcccgagtacacagggtgcgaagaagatagctacaattctccccaaccggagtccatacttcatatttctcgttcattgtgttatcctcttacataaagaaatcttcatcggattcagctatttctttataaaaaccgtgatatgcgtcaactgcctcgctaggtgctgccatgtcaaataagcgtgctctttgttttaattcagctttattttggcactgcctaatcatttcttcgacttcttgctgcaagcgtgcatctacccgaaccaccagctcaccgtcgtgaattgccccgactttgtacgtcaacatcgtgagatagcccgggtgctgtcgagacttcttgagaaccacgttagtatacgctgttaactcatggacgaatactgcacctgggaacacataaggagttagcttcttacgagctttcactgccttaacatctattaaatgaaagaagtctttcggagtcttggatatgtcgtccggtacttctaattggaactgattccagaggatacgtactttgttttcagacatgccgtagacaatatacgtttcgttagcttcttcaaaatcaactgtacagaataacatatcctagccctcttacttgttgtagaactctgtagcactatcccattttatgagactctcgacatgggcttgatcccagatatttctggagttagtcagtgccgaaacatgcggctgaataagttcgaacttaccaaccgtggcaccactagtaagcagtaacgaggttaatgcttcgaacttaacggtatcgcttccagatagctcgcttaccgctttaaccttgtcaattatagcgatcatcttagcttcttcgcccacgaacgtaaagcgcagattgcggaagcggaaggagatagctgctacactcggcttgctagattccggggagtagtttggatggaacttgatctcggagactgattggtcagtcagatagttggtgctcggattattcagggaatcgtatttcatctttaacctccaaaggctttatcaatttactggagttattataccaaataatagagtctccgtcaattgaaaatttgtgataatatgctggcacggtgtaacttccataatccgtaactctagtaaccatgcggtgtctgcatttttggcaaccgttaccttcaaggtgacttctagcagtttgcataaagtaatcctgatggtctggacaccatatttccaccagctgatttaggctgtggaacactagcttctcatacccgaagaatactccatgagcgtctagagcacggttaataaagatgaggttcttagcatcttgcctgaaatctggcctaagttgctttatcttattatggttgatcgaaccgtcgcgtttaaggaactgattaatggggaaggatttagcttcccatactagctcttgatttatcttctgtcttaattcctccactactcaaattccttcttcaacctctcatacaggtctttggactgagtccaattaaggtacactcgattaggctgattgccgcctccacgttgagtaagtataaaacactctttccttactttttcaacagtaactgcagcctggtctacgggattctcccctcgtaggtagttgtctatagatttcatttaatatccttaaaccacgaaaggccagagcaattagccctggcctctttgttaggtgaacagatccagaaactcctctggataatcggaaggatctccaaagtcgatgtgatctgcgttgaccgggtagccttctttcgtcttgatgccctgaagaacatgggccaatacgtcaaagtctacgctgctgttgttagtgcagcttgcccaggcttcctgacggtggacgcatttgccatccaccataacctcaacaccgtagccagtattccagcaaccgtattcgcaatccccagaatcttcttctaggaagtttaccacaacacgtttcttagccatttgtcactctcttagtgaatagtcccgtcgatgccttccacatggatatcaattgccattttcagcattgactccgatttatcaaactctttcttcgaggccaggagtgcttcaccacgagcttttccatactctgcaatagcattcagtgtatgtttcaggatatcatcggcggataagccctgagtttgccagtggacttgagctgtggcgatattcaccataaacttactcagctcaacacgttcttcgtctaacgcctgcattacatgggttttgcagttatagaaggagttcaggcaaatgtcttcttcggtcagaccttcaaccagaagcatcttctcgacttgtgccaggcgatcaagccacggattttggagcatcaaattcttcacttgcatggtataagttcccgtcgttaattggtgcgaatgatttagcgttgcgttcaggacgttgtttagcgatccagcccagcatcatctgtcgaggaaggacaacctcagtgttaaggaatacttcgtaaatccagtgacgtgcgttctgatatttaccgaactcatacgcctttttgaacaagccccaaactacgctaagctctagcgtctctgcatttgcagtctgtcggaacggtatcactttagagccaatgagttctttcagagcggagttaatatcctgatggctgaacgtggtctcatggaactcgttgaagaaacgatagtccagagcgttattagcgttgacgaacatctggatgaacagatcgctgaactcttggtgctcacgattaaaatattgatttaaaacttcagttgatgcggccatctttccacccgttaattgctacgagatacatctcgtaaatgaatacagtgactggttgaattgcttccatatagaacgtcgccgggacgttatggaagactgaaaccactacggagaggaacaatgcccagcctagaaaacggctggggagttctctccagacctggaaattgcaatccaggaatttatagattcgaagctgattaagcattggtcagtctccagtaatagtgacgagtattaaactcgaaaggttcgtcggtgatcttagtgtgcagcgtgatgatatccggtgagtaggactttgccagatctttacgaaccattacagtgttaaacggggcgccatcagcacgctgaaccacgattgccaagcctagaggaggaagctcactcaaaggacgccatgagtccttctcagcaagctcaattttggcgattaaggcaattgactcaacgatatcttcatcacaaagcaaatcgtggtctactacctgacgcagagcatctactaacacttggcgttctttggagttaagattcatttttcttccttcttaatggtgttttcaatatcatccagcaatgctgtgcagttatcgtagttaactttgccccggccaaagattctcaaaacacaggcgtagtacccggttaacagaattgccagaggatacagaggaaccagcattgctgccttgatagtacctttcaaaccgaagccgtggtacttcccagacaggtagccaacaactaccaggtaaagcgctgctacaattggtgagatcatttcttaatctccgtgatcaaccgcattttggttgtcttcgacattgtggaatcttggccgattatttcttcgatcttcgctaggcgaactaagagtcgttcagccgcagcagagaattcatcagcgtctcgtacttgatccatcaacttttcgtggagtccgttattggtcaatctcattctgcggttagtttcccgcagtattgatacccaaaccgccagacccgttccagttacgagggctgctattaacagcccggagagaatttctagtaccattactttttcttcgccttttcacgtttcaggtcacgttcgaagctctcagcacgacgttcagcaacctgctggtgttctttggcccaacgcgcttcatttttagcgaggttgtaggccgcagcatttttgttagtaccttcgtacagagcacgaagtgccgggagagacagtttagcaagctgaccttcgaacccatccatatccagcaggattaccagtaccgcaaccatttcgtctttggtcagggtgttagcttgttcgtcagcagttttaccagtggtgtaagagatagtgttcttagccataatgatttccgtccgtttcgttaatttatgcgtatattataccgaaattctaactacttagcaagtgaatttttaaactttttatcaatcgatccggtaagcgtaaacttcagaatggatgtgttcttctaccagtttattaatttccggccagttcttttgaatctcgtctagaacatagtcattcgaagcgtcttcccattcgtcaggagtgcgcatgaaagagttcgcatactccagtacactctccagaacatcggtcaggtaaactatttccccacgattgcagtaggcgtgttgataatcccggcgatcttcattaaatggggagtcgctgaggtagtcccccatatgaaggagttcatcggcgaactcctcaaatgccttgacacgagcggacagcggtatgctttcatcgcgcatcagcaggttaaaagaagcacgggcggtgttaactgcgtggcgaagggattccatatttgcattcagttcgatcattgcgtttttcatatttgcttcctcatcaatttataaagctattatacagaaaaattagctcggaagcaactgaatttaaaatacaaatgctacgagcgcccagattccacctacaattgctgcaccgactaatgcggctaggattaagaggccaataaacatcttggccatatcatttcccattccagtatacatggttactcctcgattaccagtcttctcatgtagtcgttccaccctgcacagaatggagaaataccccggagtagctcggtagactggtgctgattatagtggtcttctgcagccttagccccgcgtttcttctccgcccttttattaaactcttctagcacgatacgtccttctagagcttctttagcgataggatactccggccaatcctcctctagaacgaggtagtttggaaaccctaccttaccgtcagcttcccgacctttaaagatcagagataagctgtcgtttatctcccgaatagcagtgctggttagatacttagcggcatctgactgcttaaatacaatatagcgagattcgagtttcatgatttacctcaggcagtgaataggatgtcgtccagtaggtcgtccattgggcgatctttatggatctcccagaactcttccggttcccaggtttcagtgtccggggcaaccagaaccgagatattcgcgtcatctgtaaacacggagttgccgttgtctagcattgcgacacatttctgcaactcgaagccaccagcaactacaaatacttcaccttcttccaaatctttgaaaagtttcatgtttcacctattaaataatgtcagcggaaccacagggatcatcacgatttgtggtgaatgtgtataattgacctagaaccggcgacgccacggtcatgcgaccgttaaaggtgccacctgtgtccaaatagacgcggttcttccagcgaattgggaatgggacaccagtatggccatgaaacacgtagtctactcccacgatttcaggaacatcgactgcgcactccttggagaagctagagtagcgatcgaagtacggatgcttttccccactacgatacaggttaaacccaacttcctggattacatcacgatcccacagcagtacacccaaacgacgtaaatctggtgtatattcgtgttcatgcacaatgtcgtcccacactggtacagttacacccataccttgagcctgatagcgcagagggataccagcatggactaccccgtaacgcttgccacggtgctcaattgtcatcatgtacggcattttgctgtccatgtcctctgcgatgcctttgagggtgtcggtgtcaaaaccctcagtgatagtccaactaccaccgttatacatccagttagcatagtcgtcttggatcatgaattcgtcatggtttccgcgtacagaccggaatttcgggttatacaggaacttcgctagaacctgtaagttctttggaccgcgatcgataagatcgcctacgcagaatacgtagtcacggccttcctcataccctgcaagtttcagggcatccatcatcatatcgtactcgccatgaatatctccaataaagaagatattagcattgtcgggtacggtaactgtttcatgaacgttcattaatacctcgtctctaaatagtaacgttttggcagcgagaagtctgagggctgctgcctgtgatctcttacatattcccctcgataagggtcgtatattacgtattgcactagaccttcgggttcccaggcaatcagtatttcattgcctattcgtttaaatgcgtacccattctgcttagcccacagtatgcacgagtagtccaggctcctagcatctacttttataccagaaaagcccctctctacattgtaggtgataccctttattaacttatcgagctgtattttcttattatagtaggcagcagctcgatttttacgggccatatcagaagaccagtctctagagaatttttgcattatgcacactccacatcgtcgtgttcatagccatagttagtgcaggtgttagcttcatcatcgtccttacagaacgcaacgtagcagtcaacaacttcccagaacgcttcgttgatcagagcattttggtgggttagatctaattcatcccactcttcttcgctctggaagtcagtatgtacgtgagcatcacaacctacagcgcctagagatacgacaataactaactcgtcatctaccatttccaagtaagcctctgcgtactcccaggcggcttcgttaacgagctgagtctttacttcggggctgagagcttgccactcttcttttgtgtaccccagatcaacgaaggtagtgccggccgcaaaaccgttattcaggataagatatgcttgcttagtcattatgtaatcctctctcaattcaatataaatattatatcaaaattttaagcatttagcaagtaataaaaaaccccggtctcgtattgagccggggttaggcattattcttctacgtagtcgataaagtcttggatagctttactaactaccgcagagcgaagcgtggcaccactcagaatgtgatgtgcttcttcacgtccgttctccacatccaccaggactactgctggtacagtgcgaaggccgaacttacgtagggaatctacgtcgtccgtgcgtttttcaacgggcaggttgaactcagcggtgagcttatcaaaaacaggttcaaactgcttacaaggggcacagttagaacctttaaggaatacaatcttcttagacattattaatactctccaatagtattttcattgtttttacggttgcggtatccaggtctagcttttctccgaaagcctcaattatagcttcctgatacggctttttcagacgaccctcaggcactgctacttttttaacatctccagccttgactttctccaaaatagtattcaaagttggcatagagagcttctggccctcaatgttaacgccgagcagtttggttagcgcattgttaaggtcaattcgggtcattttcttaccgttggacataacaccctccgatttcttagcaattttcttaaactccggtgattcacgatcccacaaagctatatttaactcgtagggagatactttaaaatgctcgcacatttgagtgtagaatctgtctgacattttgtatctcctctctcgaatttataaatatattatacgctaaatcgagcggaaagtcaattgaatttttcattaattgcagtgcttaccccttcttacgaaaaacagtgtaattgggtagactgagtacatcaacacaggggaagtgagggttagaatcgatgtcaccccaccagcgtacattaggggtataaacgccagcgttatagctaggactatcataccaaatagtagtgccaaggataatgagaagcaattctctagctctagccagagccagcagaaccctgtacccttctttttatcacatgggcagcgaaacacgccaaaaataccaaatacgaagtgtaagagccatctagcaaccttagctaagcgtgttctgcgaaagtaaatggcaccgcgtattaaaatccatgttgcggaaaagaatactataccgaattgaaatatcttgagtagcattatagttactaaacttgcaaacataaccacctcctatttgcttgctacatacaaagaaggggagcctaaaagctccccttaatgtcacagtaactctacgtgcccgccgtcataagaccctctttggatttcatcacggtagtcgccagagttgttccaatccgctccgaaacgaacggcgatgttcatttcatttgcggcctttttaaatgcaccaacaatagcccagaatgcttctaagtcgttccagtcaatcttaccattgatatacggagcgaaatcaatggcctttcccgtaacgtgcttagacttgctagggtcttttaaaaatgaggtgccattggcaatattctgggcactctgttctacggtacgtttaccttgaataatggtaaaatcgtgtggtgagagttccagagcacgaatagccagagccttaagtttaggatctacagtatcgagctgctggagactacggtttccaaatctgaaactcatattgatctccctagtgatctctgcggcgatgcgcagatttttgccatatagtcattaaacatgctcatgtcttcgtctaatagtgggtatttctcccacgcgacggcaacatatccagcgtagatgttattaaggttaaaatatgggcacgtgtacacatactcgaagtttacactcttgaacggcggcaaacccgttccagaccacttcgataaaccttgtttatttcttgcatctattgcaaagtttagaccgtctaaatgcgctcggtagagcatagacgtcttgtcaactgctttgtcggatacgtcggatttatccaactgaacgttgctttcccaagctatgatagtttggtaatcatttatagcctcaggcttgtatttaaccacgaagacagcatcagctcgagtctgtgagaataggatcattgccttctctcgtgccacatttggaaactctagtgtgcgttgtattttaacatcttgtaggaccgccgaagtagagaaagtctttaagtacgacatgacttcactcgtattagctataaagaggtagataactagaccaaccagtaaggttagcaaacgtttaagaagagaagctggatccttcgcttcttgtagtaacagcgatatcaactgtataaatttatccattaagaacctcctctaaccatttataattataccctttattggaggaagttgcaataaaaatttatagttattgctcggatcatactttgagacaaatgtcaagtagaatttagataaagaaaaaggccagagctaaaaagccctggcctacttagttttattgacccgcagccttacgagcttcttgctctcggtgcgcagccatacgatctacacgttcgttgatctctttggaggtcagccaaatgtccttaccaccttctatcatctcggtaatctcttctagagagaagaacggatagtacaggtctagcatcatatcctcgaagaatgagttgaactgatccgcatagtgctggatctcatttttgcccttaccatagtgcgcaccacgataagtatgacccatcagcatgacgtaagggtgtaccagccagccgtggcaggctaggaagattgagcaggcagctgatgctgatggcccaaccagatgcccaatcacagttccctggcagttcatgataaggttgcacaactgaactgctgtatcaacgtacccgccgggactattaatataaagattaagagtgtctccctcttgcatagttgccagagtgactgataggtcgcggtagtagtctacatcgactatcggcccatcgaggtgatagtggtaaatattatactctgccttagtcgccaccagggaagcgaagtaattagtagtcttattgccacctttctgctctacgttattaatttgtcccatattgttaccttatataaagagaatcctctcgtcgcaaaacgcgtttacatttttacggaaattttccagtccgtcaaagttatttgtgaccacatcatcaataaactccggtgcaacacctctagcagaggcatgagtagattgaatagcgtggatgttgttaggggcgtgaactttaagaatactagagttctgcgcaccggggaagttccgaactagggcggcttcattatcaaaacgaacatcagaaataatactaatgtcagctttggtagcagtgatacgatcgaccacaatattcaaccacaagttctcatccaccagagcgcgtcctaactcagtgccaacaaattctagcattttacgaggggacgtgtataatgggtacagcggggtctcgtgaccctgataaaagtctggagcagtcttagcaatcaacggatatagtgttgacgcttcaaactgaggccagacgtaagagaaatcggcgtacttgtcgatcccaaaacgcttccagacgttagcagtacgctcaagggcttcctgagtcacccaaaaccactgcttaatctcttttgtcctgcgctctgccagcttttctggcgtgactccaaggattacagccgcgagttcgtaaactggagccgcaaaactgaatttactgatagaatactccggaccgaggacttcccaggcccaaaccttagccatgtcagcaaaggtgtctttgcctgcgccggcatcaccaactaatcctaaaacgtatttcattttgtttccttattgaatggtttgcaacgatattcattaagtgacacgcgataggtacacgttaatgcagtaagattggcaatgtaggtgtagacctgctcattacacttgcccattgtgatccaatcttggtaaggtatgcgaacatacactttaccttcttcgtttatgaactcaaaattaaacgggcaagtctgtaggcttgctggccacggtaggtgttgcggctcaatccccgttactgtgctacttgggtctggccgttctgcacacccggatgcgataattgcagccgagagcaggagtccatatttccagttacgcatgaaagtctctcctggaattcattaactttgtcttttgccaccttggtagcaagtttaggtttagcggcaactacgccttctttggctctagctgcatccagtttgttaatacgtccgtccaggtcttcctggttcttggctaggttggttatataggtagtagtgttgcgatctcgatttcgaatctccgtttggagattaccaactgtcttttctagttgttcattacggtttgatagggactgtaaagagctggacatatctgttagcttattggtaatgtagtaggcaccaccgaaggtgcctgctgcaattgccagaaacagaattgctccagtcttaccgctccatattcctgaaagaaactttagcatcgaagcccttagcaattaaccgatcacgatcagacgtagattcggtctttggttccccttgacccagcacaccgaagatataggattctagggtctggtgccagcgatacaggtttggatcaatttcctgccacgggaaatcttccgcatggaagttgaaatcagttttaacggtaatgttaaccgttgggtctgtcttggactttgcagcatcccacgccatagcaatgggtttgttgaaagtctctaggaagctggaagccgtggtagttgcgttacgaacacgagcgtcgatcttctcaatcgtattcatgtcccaacccatccgcaggtagtatccttgttcttccagtacctcttttactttaactggatcgaaagtctggatatgcacagcatctgcccctaggccagtgtgataaccgtacagccagcgtagtgtaccacaaatcaatactggacgaacttccagagttcccatattaacacccccatatccagaggaagtatggttacgcaagatttcagcgtagaaaataatttgttcgaaatcagcggatacgtttacaacctttttcacctcttcgcgataccatgctctttctgcatcatacatagtaccttgtagatcatatacgtcctttaatttagagataatacgcatctttgttctcctctcatttataaaaccattatacaacattttaagcgagagtgcaagtaatttttaaaaaagaaaagcccaacacctttcgatgctgggcttggatatttagcgatttagcgggtgtttttcaacacagtaattattaaagatctgtgcccttttgaggctgtccggtttaggcttagcaaatgggcctttcaaagcgccttgtacaatgaaaatccctttgcaaattctgccgatgatcttacgatccatacagcggatctccgcagcatatttaccactacgaagctccaggagcttatcgaaggacttcaagacaccttctgcgtctttggcaccacccctggcgattatggcctcgatatctttacgggtggcgaacttagccagaaactcgaaggctttagctgacattaccttagcgcaatccagaccatgattgataccaactgccatccacgctgctactgccagtaaaaataaagtaaacattttgcttcctcagtttgtctttgaattagttaatggtcagcgaccaactcaccacttcgttcatcgcgggcacgactccggataggaacaggaaggtgactcctataacggccctaccgttatacgtgtggattcatgttacacatcatccgagtcttctctacttcccgtcgtgctctgcgacgttcccgccgtagtttgtattcattttcaatgaccttatgaaagtggtcattaatgttatcctctggtaacatcaggcgaattgttgccaactgctcgatctgaacccgaaggtgggagttaggcatacagagctcttgcatctccacaaacccggataatcctagagcggtcatagaggctttagcgtatactttatcctcttttaggcttagttcaactgttatccggtagcgattatcaaacacagtacaccactccgagggggctgcaccagctcttgcccagacacagtaaggagcttcctcaaaagcacactcttcattaatccagtctagggtctcttgaagtttggggtgaagattactcatcgctatcatcctcgtcttctacctgacgaccatagcggtccagtgtcacagcgggcttgccataggttttgttcgtgtagatcttagtttccccaaaacgggtttcagatttacgaaacttaccagcttctttagtaatcccattcgttgttacacgaacccgcccgttatcagagatctctactttgttacgctctgcggccagagatactccagagtacatcatactgaatgcgatgattgctgcaattgaacgcttactcatagtcttcaccttcgttatcttgttcatccacttcaccttcgaggtctggctcgcagtcccggcagatttcctctatttggttctccgccctttcaaaagcaggacaccaccacccgcaattcacgcaccgaaagatctccatatcttccgcggtctgccagaagagatcctcgataacaccttcgtgaagattatacccgttagccaccagctcttcttcgataacattgagagcttcagtttcgcttacacaggaaccttgtacatacccgtgcattaacgggcggataatgctttcaatacttagtttgctcatgaagctctccctatcaatttatgtaactattatatcgaaaaatcgcctacaatgcaactgaatttttcaatactttggcttcggcacgctttcttttgtattcggcagcccccttttcgagttccgaattaaggtagtcaaccatggaatcccatttacggtttatccagtgacgagtaccataatgcgagaatacctgtacggtatagtctaccggactggcgtctttgacgctataccaggcctcaggactaaactgcttgagatcgtccagctgtggagttggcatatccagagctttttgatggtacagttttgtcaggtcaaatactttctgctggtaacgttcatggtcacgatagtagccagagagtcgctccactagtgattgggctgcttccagattacgagaggttacaacgcaaatacgatccggcaacccctgctccatgaattcatgtactacacaatatcctagatccatattaacagctccagctacatttaggacacgggcaggacagtgcatgtacgcacatcttgccgtttttatcaacaccagtaccgtgacacttggtacaggcagcatgtaaacacaccggtcgttgctcttcgactaacttcttaataaacggagcgctttcaaccattttgcacaattcttcgtgagaatatccaaatcctgtagtaatcattttctacctctgcgtttcggagtgggccaggaattagtcttgccgtgagtaacctcctggcgggagctacgtggcataaagttattaccaatcggatgttcgtgttccatttcccgagcgtaggattctaactctagaaagctggcttgggactctcgttccattctttctaggtcagtgaagctgggaaatccgccgatgccgccgtagccaataagcattattttcggcacctcgacattacgttcttccagtcgtttacgaacaagttctattgcttcccgagcaattttatcgtccattacgttcctccttcggtaagtaatcatgcagctctacataagagatgttctttctttctttatactctggcttaccatacataccatgcacttctactactttggcgcgacgaggattattaaacataacattccccggtatgactactacatcacctatctccggggagtatttccaataactaggtactcggtaaacgtaagttctgttactgttggaaaacttaattccaacgtggcgagtagttgaagccatgatataaagccttagccgcctgccgcggcatgttaagtttttcagccagttcagaccagaagtctttaccgcttaccatgttatatgctacgatgttcccatcgaaatctttgagacgctcagcctctgcctctagagccggtcgattcttttcaacttcgagctggaactcattcagacgcatgaagttacttttgtcgcctagaaaacggacgtaggctccggctacaccatctatggaggaagcaccacatttacaggtctgcattttgtggtctaccaactctaaggtgtcacggcagcattttacgaaatatacaactttactcataatcattatatccttcaactgtaaaccagcgtttaacttgtgtgaagctcacccaaatgccctcatttgcgtcactccgcactttgtaccctgctctactatcgtgtagctcgacgaaatagagcttaccaggagtgaagtattgaaacttgtgacccccaacaattttatactggaggccaactccaggagtgaagcgtaagagactagctttcaccatatttcttctccaggcgtttttcacgcagttcggcttttctcttggccacacgttcacgcagtgtaccgtgttctttctcatagcgcaagtgatgtttgttgaaatcacgcttcatacgaacgttatgccagtattcttggctggcaataaagatcgccgggcgagatagtctaggaacatcgtataactcgaacatgcgctccatttctttatattcggcgtagttcataactcgatcgccaggggcaatctgattatcccaaacccacttttcgtgatcccaatccgtatagaacgatcgtataacgccaggagttacttcaatttcgtaccacgccgtcttagacacacgatcgtgatacagccctgggcggttgaatacggggttccgctctttttctctccaatcatagaatgtaccgtctagtgcttgctcaacagtgcgtcgagttgccttgccccagatatagaaggaatcaacaaggctagagcgaaagactcggataccacgtagagattgcttattcattatttgatccccaatgcgagaagatggttggacagcttatccagggcttccagagcagctttgttgttttcgctcaagttgctaatagtcttctggagactatcaataacaaagtcccgaactgctaattcggcggcgattgcagacttactattaagcccttcggcggtcattgcgttgacgtgtcgggtataataaccaccagcgaaatccagctcgtcaatagcacgttcagcgtaatgcaattcattcagttcattgagttcgttcattgattactcctcatccatcatttcgaggcgttctttgacgtataccagtctgttgtgctgttcttttgctaattctgctaaccggtaaatatcagccactaactgcattgtatgatcgtccataccatcaggtggaagtgtatccgcataagcagtacagatagcgataaactcttctgtgttttccattgttactttcatcttggaaacctctctcatcaatttataaatctattatacggcaaaattggcatttttgcaagtgaatttataaagaaaaagcccctcgctcaaagagacaaggggcttttgtttagaggtcaggaggtgcctcagtgttcttttctaaggatttttgtgccctcagaacaatctggtttatttgctccagagagtcgaaggaaagttgcaggccatgaccttcatcggtggcttgtatgaataaaactctcttagaggcgtctacgaagacttgaaattcttgttccactttactctccaaaaataattacaggacactggttttctctggctatacgaaccacgtaagcgtttacgccatatttaatagccaagctaggctcgtcaaacatgatgcagctgaatcgacgacctatacgataggtttctaacatactatacgttgtaattttaacgtgaggctgaagctcattatacttcttctctaggcgtgccatttcacggacgcctgatgctacgtatactgcttgaatacctttaaatactgcaaactcataggccgtattaatagcctcaaacgtcttgccggtagctcgtcccggattgactgatagaggccaacgaaggtcaagttctaggaacctgaacagttggttgcgatctatgtacatgctggctccttaaaccaaacaatgcgaaaacctgtctcgtcctctagagcctgtacgatttgctctagtgtcagaaccttatcggacgagaatgtccagagaaactgttggagttcattccaagactcggcctccataatcggaacaccgatttcctggccgaaataatcatcagtaccacgaacgtcaatacgaccaccggcataccgtttggcaaatactttccgagttagttgcccaccatctgcaaaacgattaggctcggttacttccgtatacggaatacccatacggatgtaccaattgttggagactggccccataaaattggtgctataagtgatcatgatcactcctttaaactggcaaaccccaggagactcgaactcctactgcacggttttggagaccggcgtgctgtccagtaacactcggggaataaaattagctaccgtggtagacagatactgtcttaccattctgattcataacgtaggctacctcatcttctttcaggaagatatgctgatcaagaccagcaatagagatgctcttctgcgcaggattaaacccaacgcttgaaccatcgtgaatttcttcgccaccgttaggtgacattactttaactgttaacatttgcttctcctatagtttgccatctctggctgttaagtgacgtcctaactattatagagtcgagttccaggcagacgtcggcaccccggactacattggctctagaacagcaaataatttaagagctaaacatactaagacgcagcgcacgtacacgatctacgcaggcttccatctcagctaagagtgagaacactagttctgcatcaaaggctttcattgttgtacctctcaagtagtatcgataaaatggccttaccggctcccagttccttgtttaattccccgtaacgtcaggggacggtcattttaccgaatttggagcgactagggggaatcgaaccccactcagtaccgcttggaaggcggacgctgtaacccgtacagttaatcgcaaattattttattacgcaagtgcagccacccgagaatatagatccgtaacacttgtcgcacataacgtcttctattttaagaactttaaatctcatagagagttactacctgtagtaatatttatggtgctggcttccggaatttaacgacaatgtaaacttaatcacactgtaaccataaccagcaaaaatggtgccccaagtaggaatcgaacccacgacctaccgcttacaaggcggttgctctcccggctgagctattgaggcaagattggtctccccggtaggatttgaacctacgacccgatgcatccaaggcacccacgctgaccaggctgcgctacggagagttatctgtaaactgcaagttctttcatcttacgtatgattaattctttaggagcggaaatccactcattggagtgttcaaaactacccagcaccaatttttcatctcgtctacgatcgaagctaaagaagtaaaactccagggtgtaatctcgtgcaggagagtacgtctggtaagaatttaatcgatctattacgtcaatagcggaacctactttaaaactgtcccaggcagggttagataccaagtaaacatacccggcattcagccccttagcctgattttccttatggtaaaactttagtaggtctctagccacaatttggcagaaatgttttgtatttctacggtatgaactagaacctttcacatgggaggtagtacggaagtactctttattcgtaatattctctactatgaatagtacgttttcctcggtaatatccggagttataaaccccgcatcaataagctcttttagcttattggactcccctttaccatgcttcatatttctaaccctataaaattggatacgggagtaggactcgaacctaccatcacctgtgcggaattacgagaccatttgcctacggaatcgaaccgtatctcaaccctagccaggccgacttccccatcagtcgtgccccataatttggtacccactcccggactcgaaccgggaaccctgaagtcttaagcctcatgcctctgccaattggaccaagtgggtattaatcgttatccaagtaggcttctatagcctctagggcttctagagtagagatattgaatctctttaagcactaccactagagtttcctgattccaggaatctacggaattaatgtagttctcgatgaaattagagtagccgcccattattaatataccttgattaaagtattgtcgatggtgttcaggaacttaactgccgcatctctattagagaatgtctccagcacgataatgttgttctcaggatcaccgttacgcactcgtatttggtacgatacaatcacttcccagcggaaccataaagctcgtggattatatcgcataagaattttttggttcattaggtaagccctctcattaatttatataaatattatattataaataagagcgtttagcaaatgaatttttcgaactttcgggaaaatgccaccctaagtcaatgccactacttgagacgttataggcaatctatctcaagttgtctgccccattgctcttcagtgatttctgcacgcagaaattcttcttgactggaggactttaccacgtcaaacggccggaaatcggtggcttattttacccttcgttcatcagtcgtttgtccgagtttaatcggagaaccaactaacgaactactttggatttggaagtatcagttggattcgaaccaacgcaccggctaacctagagatcaccagacgtttccaagtctgctcattaacggccagctgctttaccgtgagctttaggactattcagctccataagctattgatactattaatttggtgcaaccggttcgatttgaacgaacgacccctggactttcaaaccagtgctctcacctcgctgagctacagttgcgtaattcgtgcctgctcctttgaatcaagaagtccaccccggtctttgggtctttgcagtacatcacgctgctctgatgtttggtggaacttgggagactacgtgttactaccctcacagaccgggattccccgctatccatgatgcttaaccgattagctaaagtcccgtaatgtggtgggtcgtggaggactcgaacctccaaccttcaagttaaaagcttgttgctgctaaccgttgagctaacgacccttgttattaattcttgatagatggttttcgagttcttctctatccagagttatccactcatgagagtatacattgctaatggataacacaaattttttctgcttttcgacgatcttcccagaacgaccagtgctctaacttgaagtctctattaggcgagtatgtctgataactggctaatcttttcttaggatcagatgacatacctactttatacttgttatcccacgcaggattgctgattacgtaaacaaatccttctgggatgttaagaccttttcttttcttatattttataagatttagagcagcaattttccggttatacctagtgttactaggtttggcctttccgttacctcccgtaacctgattatacacagccatatatgcgtcaagcatgttgtcgttaatcagaaattgccccgggggtataactccctgcttttccagaatagaaagtattctttcactcatacatgaaatgctgctgagtgaggaggcgctttgagaattctgcataagattcatccgggaagaaagtttcacctctgttttcatcgtttaagatgaccgaaccatctgcctgttcataagcacggtaagtactgccaattactaggactttacgagattttgtggtccctactttcgtatcagtaaactcgaagatcatggattcatagcctcctgtataacataagaaagattaataagaccgaatgagagtgtacggccacaccctaacgctcgtttaactgcactgtattcgtcatccgttagactatccatagtaatagataggtctcctagactaatgcattcattcgagccaaagtagatctcttcttccgtgttgaagcaagcaccttcagtcgctaaaagaaactcagcttcttcttttgatatttcatgaactgcttcgatatcaaactcgtcagcgtagttaccatgtatgcgtaggatattgatcatgataacctctatcaattaattggagcaccatcatggattttaaccatgctgcgagggtttgcaagcctctgcctagtcactcggccaatgatgcattgtttgattagggcgcaccggagttccaccgattgctaacgcttcaccgcaacctaagtcgctgttcttaccctaatactgtattactgactaggattttcacctagacggagttagcaccgtagcgtgtagcggcttacctctccaaaccgggccacatctttcaatttcggtggcagtgttcctacgcgtgcctgagttaattaaataaccctttcagtaaaattggcgggagaggtgagattcgaactcactgtcattcgcttaacaggcgaccgcctataccacttactgcttctctcccaaatttgttacaactcaatgagtcccgcatgaaactctctgtgacatctacaacagagtggaatacacttttcaagttctgttaccagtttttctctgctgaaattagagcctcgggcatcacttagtacaaaatctttttcgtttgggtcaaaatggtgaaagtcaatagcagccttacacttatcatacccacatactgcgcagtctagaactggaaatacttcggctactatagcatcaaacctatcggctctatgagttagctcacatgttttgcacgttggcttccatttttgttttccggatactggctgtttaccattagtccagaagttatctgttgttaatgggtaacttacgttacacttattacatgtctttaattccatttctataccttaattggtgcactgaggtggactcgaaccaccgaagtcgcgatgacaagggatttacagtcccgcccgtttgccgctccgggaaccagtgcgtatttgaagaagctctcttgagaacctcttcaaataccccgtcgaaacgggatatttgctaacttattgtgactagggctgacccttgtgtccgaggatacctctagacggtcatatctcttagcccagagagaatttggcgcgactaacgggattcgaacccgtggctccgacgtgacaggccggtatgttcaccgctaaacaccatagtcgcatatttgttattcagagtaaagaatcaaatcgtcacactgacaatgatcgcattcagtagggcactcagaaagctcaccgcactccatacattcgtataattcatcttccatttgcttttcctctttcgtttcaatataaatattatactaaatttcagggtactaggcaaatgaatttttcattaatcgtcttcttcgtcccatgagagggagtgcatgaagatcggtagaactgtaggttctacgtcaggcgacgggtagaagtacgttttaccttgagacaggtcaatgaacgtgggagttctaccctcctgcatgtgttcatcaaccttgtctagggcgtcgtttaacagttcgaagcagtcagtattcgctccgcaaacaacgataaaatccattaacgacccccgttcgggaaacctgaggcaagcaggaagcgaacaacgtcttccagcgacgggccttcgccatcttcttcttccagatggaaaggcagaatagcgtactgcatgtcagctggcgctaccggggtgaaggtaggctctgcgggagcttccgccatgaacactgcggttccgtcaaccagacgatcgatcgcttcacagacttctagctgttcttcgatcttggcctcgcgttcgcgcatcagagccagcagttcagtgcgatactcctcaatacgacgatccagagattcgatgttgttggacaggttatcctgtacaatcatcaggcggactacagcagaatttccattagttggtcgtgtaaacatgatatttcctcagttaattgttagatagtaaaatttgcagtgacgattaaacgtaccttatggctgaatactaacccatgatcctcttcggaggaataaacgttgatcgtagcaatcagttctgtaaggtcaatgtcaacatcaacagtaccctcgggcatgccatgttgcttgattagctctgctttgatttctggtctaagagatgtatcgtaaaaacacatccactcgtggtcgccatcccaaccagaccaatctgtaactaatgcagattcgatacctgttgcagtaacctttgtcattctaaaccccctgtatttggctcagtacaatcttacattctgtatcctggaacttgtgcgcccggataaactctcttaaaacgtctacgtctttagggcaccgcgaaaggggcctagtatagtaaaacggtttattatatcctgccacaattacttttatcataagttgtggattcatttgctaactcctctcattaatttatgtaactattatacagtaaataagagcgtttagcaaataaatttttgaattatccgctccgaagagcggtaatccaggcttgcagctgttaattgcacttggtttgaagtttgcgagtcaaagcgaaaggggatctattccttacggacgaaagagttccaagcgctgagagctttcagggactgaaggttgatagccttcccttttctgcaactaacaaatcttagcttgaacgtttaacgtggggattgattagccccactacacgctaaccccggaagggatcgaaccttcacaagatagaccatttatctcagcctcgttttcgggtatcttatgcagagtggatgttctgcttacgccctttaggaagccccgtataccgattccagcacggcatcaacgcgctagggcaatgaccgtctaaagtcctagcttctacatttatactcctggacggcatggagtcgattccctagacttttactcagcattgcgccaaaacctgtaaaggtaaggatggggtattcttacgaatctgggatcgtccccatcagaaattacagcttctcggacgtttgacggccctgactgaagtctcactgtaaattggtacttgctactgattttgcaccagctaccatcgacgtataaagacgatgatctcccgattgagctaagcaagtatttggtggtcaatagtggattcgaacccactggtaatggaatcaaagggcgttatgttaaccagtacactactcttaaaaatgccattaactaggtgctatttctatcggctgagatacagtaggttgttctaatgtatctggtgctgatacagagaaaagagcctgtaatgctgcaatatcgcgctcgtaggtatcaatacgagtagtaagagtatctaccatttgtttatggtgggctaagttattttgagactcatctcgaagagtctgaagttctacgagacgtgttaacataatttcactaagtaaagcattactcatttatttctcctaagttttcgggttcttctaaacgtttgccttcatgatctactcgaataactccgcatccttcgcaaatcacaactgcaccataaccttctttgacttcggcttctataatcaaaccagaaagatcaccagtatctctgctttaaccgaagtctcactgtaaattggtacttgctactgattttgcaccagctaccatcgacgtataaagacgatgatctcccgattgagctaagcaagtatttggtggtcaatagtggattcgaaccactgtagtctcacgtatgaagcgagtgcataaaccatctctgccaactgacctaaagaatttgcctcaagaatcttacgctactattcttctcctatctatacctattttgcccacaaagtaaatttgtctaggcttaataggtaagtactatactacgtaccatcgctggaggatattccgatgaaatatcctatagggggcaaaaattggtactccgaactggactcgaaccagttacctaacgattatcggtcgtttgctctaccaactgactttttctttcgagctgcacttaaggtagcaaatcacctaaattttggtactccgaactggactcgaaccagtgacctaacgattatcggtcgtttgctctaccaactgagctatcgaagcattattgttcttgctggcggacgcagatttcctcgtctgggtgtatttgagctattctagcatcttcttcagcttccttgtacgtgtcatgaaaagccggtgcccaaaatacgatctcttttgtgtgggtattaattagcataccttgatagcgaatcatagttacctcaacgtttaccgtttcgaggtgctcctggacgtctagcagcctctgccattcgtttcttgattttagcaatgttctctggtgtttgttctgacttgcgtaatcctgtcacgttacaccagttatcaccatcccaggaagtaattagcattactccagtacctagtactcgttctgtgaaagagattttcatcatcttctcctagaattggatgctccggcaagattcgaacttgcgatctccagcttatgagactggcgaggacggcctctcctctacggtgcaattggcaggggcaacaagaatcgaacttgtgacctaaggcttcagagacctccgctctacctactgagctataccccaattatgcgcactctgctgagtacaacgttgtgtctagggccagaacataaatgcttgcatttatgggaggcggctagaagagggatgtgacccagagggctaacctcgtcactctcagcagagattttatggtacaccatcgaggaatcgaacctcaaccatagagttcgtagctctatattctatccattaaactaatggtgcagtaatctggagggatatcttggattcgaaccaagatagactcgatccacaatcgaggtcattatccagttatgataatatcccaaagtttatttggcgtatacacgttgccacgtatactatatccaccgtattcgtcaatagcataattcgtataggctacgagtagtaagattgactgtatcgtataaagcgttggcctatggtcatcttttcgcttaccaaatttgagtaccatcgagggctgatcagacctccacaaatagtatgtacatcgcacacactatccggttagaccgcgtattggtacgttgcacttcgtgcagcatataactccaacaggcgactcatcgaacgatgatactcaaatttggtggccctaggaaactcttcccactaacaactagttgattacttctggattttcgcccagaaaattctctagaaaggggcaaccgttactcgtcgggccattgtgaatgggctggtctctcagccccggttactacttgatccttacgatctgacggcaaccacgtgcagcgacccttcatatattgtatagtgctcagaaggtcattagaagcactacaactttcgttgtttggcggaaagcgaaggacttgaaccttcatgccctttcggactcatcattagcagtgatgcgtggctaccagtttcaccagctttccagttgtttggcggaagataatggagtcgaaccatcaccgattgctcagcgggctggttttcaagaccagttgcgtaccgctacgccctatcttccagtaataaaatgatgtgtatacgttagcttaattaatgaatagctcgattagcggtcaaactattagttaattacccaacctgagttagttaagtgtgtttggtagggatggagggggtcgaacccacacggatatttcaccactagaacctaaatctagcgcggctgccaatttcgccacatccccatttgtttggtggaggataacggatttgaaccgttctgattcccgcattgcaagtgcggtgtccactcccagcagacccatcccccaataatttgttaaggcaattaatccggtgcgcgtaataccctgggcaattagccatgcgaggatacccgctcttcacaaatacgatacactctacgcttaccaggcgtttcggagagtcactccgctattcttgcgaaccctcagtatacaatgaccgggcaagctgcaagcgtgttttttggtgccgactctgtatcagattaattccttaacaaactatataaatattatatcaatttgttaagcatttagcaactgaatttttcagtaaatttggtactcccgacggggttcgaacccgtgttcccactgtgaaagagtggtgtcctaaccagcttagacgacaggagcatttttaaatttggcaagggaaggaggagttgaacctaccgatctcggagtcaaaggccgatgccgtaaccacttggctattccctttcaatacaaatattatctcaaattctagagcatttagcaattgaatttttcaagtattttggtagtgacccggcaacgcaggtcactatgcaaactactcgccgtggtctacacgaatgagcggacaaagtttgtccttcttatagatccgcatcttctggtagatattaccaaagcgcagttcttcatcacgggcgttatactctttctgtgccctttcgaaggattttccttcattccactcttggattttattggcgatcttagctaaggtccagccgatcccagacagtgccaacagggttaccactatcgcagacaaccctgctagacttagccctacaagagtgtaccagggggtaattcccagttcaaatgtgaggcctaaaaaagcagataagatacttcccatccctaaagagaagagtataatgatagcagctacgccaacctgtagcagaaagtaccacactgagtgccaaaataggctacataaggtgactctgttgtcgttcagccgataggtgaaagacgcggaagagaaattaagccacttgtagaagaaacctttacgtttaatattcagcatatttagcctattacttgagttgattgattaggaaaacttgtagcgcgataatgaatgcggcataggagtcagagcctttaccaccttcgttttcgttgacttcttttagtagggcttcaaaagctgctttgtgacgctcatagtgccctctgactgtcgggccagcatcttctaacatgcctaaaagcatatagtactgggtttgtaattgggcgtccattagtcctcccacacgattttaattgagagaagacgatttacaggaatgaccagcatagtctcagaccgtttattaaggatttccaggatatccccatcacgatggagcagacgtttagggctgatatctgttactgtggactctaggacgataccattgtcatccacaaaggatacgattgcgtttttagtagacattttagtctcctgttatgaaattggtgggccaggggagactctaactcccactcgttggcttatgaggccactgctttaactttaagctaccggcccagagaaaggctatttctaacccttatttagttatactgctgcttcgtctttcggagtaccttcaactggggttcctcagttggagtatcttcaaccggctcaggatctttcacgaaggctgcttattcatcggagatcacatacagatcctgaatatcctctgtattgatcatacgagctacgctaccatctttatagaggacggatttagtgccctcgttgcgagccatgttcgcatcgataatcagctcagtgagaacccctttctttaaatattcaattttgtaagccattttatcctctactttctctttgatttaaagaactattatacaaaatttctgacaaaattgcaagaaaaattttgtagaatcaatcttaatctgcgccctgcgggctttctgccgctgcccactgaatattacgtgtgggcagcgattaaagtggtactccctacaggattcgaacctgtgacccacggtttagaagaccgttgctctatcctctgagctaaggaagcattaataaagtttaagtgttttgacaaccagatcatgaacctgttcagaataccggccaacgctcttatgcagcgactctttaaactctagagtgcgcctggcgattagctgtttctgttcaggtgtcagattaggtgctggacgttcatacggaggagtatgcacagatgccaccattattgtaccttgatagagtttttgagacgatcgcattcagcggcgaactggacatttagggttttgattgcgtccgtacactgatctatttgtttgtctagagctttgataagtcccagcttcaccatatcgtagcagggtttcatctcgaaagtgtaatttcgggtcagctctccacacaaatcaaacgtaagatctccagcgcgtaatgtaaagcgctgttgcgtaccgccactgatgatttgtttagccttagtcagctcactacgacgagagaccatagactgaatatcagagcgtatcttagttaacatacttaaatcgttcatatagacctcgtcaattagtatctttaagaactctcgtgaaagctcttaaagataccgccagtaggtaggggccttcccctgtttaagctatgcggcccttctgtcagacgtatcttccagttatagtcagggtgactaatataaccccacatagtctccacagcggggcacactccaaacagtggcacttctagcctgtgtaagggtgttataaatagtggttatgctttcgctcggggtgactccggtcatgactccattgtcacatgcttacacagggtatacgagcttccgcggagctgtatactcaaccgtgtcccacttaggtctcggagcgaccgtttgtacgaacggctatccgaatactctttcccacttagaatcaggcgagatcccaccccgccaaagtttatacgatcatcatgccgtatttaaggactagctttggcacttctggagagccatcctccacgcggtctgttaaaatcacacctccgaattttcgatgtgaagttttgatagcttgaaaaacgactcctcgtggaggaaaaacttcactatctaggctaccgcctaaagttcttcttttgatttgggcatatatcaggtaagggtagccaaatcagcatcctagtccttcgtggtttagctgtttcgttcccgcgagtctcccaagtctttccctgggaggggaggaggtactccagcagcgagtggttcgccaatagaaccatcagttatctagctctttccgaccgcaggattcgaacctgcactttccgcatctggggatggctccccgcgtgcagaagtctaccaattaacttaggacggcagtgttgctacataagtgatttcgacaccccactatggtggcaataaccagcaccagacgctatacacatgtctccaatttgcagcctaggcaggtcagtgtgggagctatacgagtttctcaggctcagctccctacctctccggcaggccacgcaccatgcttcattctggtcgaacaagttaaagtgagattccaccattttctataaatcagaagaagagtttacgagactccgggacagctcccgagttttacaagagatctctaacctacgcccgtccaatacgctccctggccggtatccggactggatgcacgaactttgtcaggtgatcactcttaactcaccgattctattcaacgaatcttaatgctcgacgagtcttacattaaaacaagttcagcgtaatcggcccgctgttctctctaatttatgaaactattatatcaactttttaagcattaggcaactgagattttaatttatagaacacatggttgccaattttacttgttcttttgaagtccttgtcttctgtccagtaaggtttagtatccttactgtgaaagtacaaagctcccttcgtcggatctactggaagatccatatagtaaactagtctagctatctctttagcctgtttccactcttcgtctttacgatcgagtttctgtttctttttaccaacccagctgaattgccctggttgatagactactttacaatatgtggacgggaattttccatagttaacacgatttttcgttacttgtgcaactgcggtcattcctttaactccttcccctctagcttcaaagtacgcatttttagctatgcactctatttcatgcgcatcaatctttgcctgcgcatggaagctagtgaggatggagatcattagaatggctgctttcattatttctcctttactctttgattcaagaataatagtatatcaagaaatcagccatttagtcaaatcaaattttcaatttcgattcgatagttttaatacagtacgcttctaccagggcgtcaaacaccggatcatgttttgacgggtagaccccctcaggaatcaggttgtaacgctcgattacgtcatgtgcatagatttcagcacagcgtaccaatgctttccaatcccctcctagagcctcaaagtagtcacgcgggttgcgggcgctagaaatatcccagaacttccacggaacgatcgcaggatcagatggagaaaagatgttagcctgagctgccactgtttcatagatggacatgtcgaactgcgggccattaccatagtggcgcagagaacgagtgtcaatgccctgctcgtcgataataccttcgattacctgttttgcctctacgaacgggcagatcagatccatgaacgtatgcttggatactggtgactcatgagtcgggttgcaaaccagaacagtagactcgccgtctttagcgttcagagcttcaataatggacagcgacggagcactaccagcacgagcctcattcatccagaatgcaatagttccggcggacaccttagcaccaagggccaactgctgggcaacgttaggaatgcctagaacgatataaggatctagtgatagatctttcatcagtacgaaagcgaaagacggcatagcgataaaggtgctcttgcaatctcccggagttcccagagattcgatatcgcaaacagagatccagcggtcttgtaagttttgcatattgtttcctttgttattaaagttgcttctagatgtgttaccacatttagaagccacctccggtggtggcttagtcatatcttcggacacatcccagttttcttccatagacggccagtcagccgcccaatcttcgagttcttcgtagcacgaatccatcagttcccgggagttgaccctagagtaatctagggtcgacttatgtgtcgctgcacgattgaaatcgtttttagctacaaaatttcgcattatgccttcttagcgggtttgcgtttttgattacgaggcttgtttgccttgcccgtaaatttaatacctacgccgtagcacagggcgcgaacattctcacggctgtactcgcagccaaagatattcggcttgacgctaccgaaacggccctgggtcttgcgcaggacttctttggtgtccgccttatccggcgtactccagccaacgatcttcgagacgtagccagaggtagaacccttagttaccggctttttacgacgcggggccggtttgcttacagctgatgctgcttgagtatcagtcggatgtttacgcagatgacgctccagacgtgctttgcgattcgcttcagttttgggaaaagttgcaactttggtttctactgcttttttagaggtctgcttagccatgagttatttcctttgttttgattggtttcgttaatttatgaatctattatacgttaatttttagcgtttagcaactgcgttttttcattttcatctacaagctcatcgaagatgatgaactcgtacctgttatcgcccgatgtgcttcgcttgctcttccgagctgatgtactggtacccgcctttgttgtatgccggtgctgtacagagtttctttcgctcaatttctttaagagcggctcgttctctttcagccatctcaggatccaggatttcccgtgcctgcggtcttggtggtagacgcgtagagggttccccgattttgacgcttccagaaacgcggcgtagagatcgagctggtactgtggtacgtttgggaacaaatccctcaaatctggtgccattataattcatctccacccctcagagctttccactctgcttcaaagatttgggcttccatacgtgcgattcgcagtttcattactactcgatccacgccaggctccatcaggagcacttcatatttcatttcgctaactaagcggcgtaaattctctaacatcacatatcctccatttctagctcggtcatgcgaacatttagcaggttatctgcggcctcattaccttctacaccagagtgacccttaaccttaacgaaagttgggatctcattgtggtttagacgatacttcttgagttcgtcgataatccacttccactggtctaagttcagaggtgtatcaccatctgccttcttccagcctttacgttcccagccccaaacccaggactcacaaccattcttaacgtaggttgagtccaagtagattgtcattggtcggccagggtttttgttagaccatagcagagcctctaggactgcttgaagctccatctcgttgttagttgtgttgcgtttgggagcagacttggttccgatttgctcttcgctggagttgtaaactaccatagcccaagcaccaacgttgtctaccccacgggtattaccgcggcaaccaccatcagtataaacatgaaacattatgcgttctcccaggaaatggtaattgattcagtatcgcgttggtcaaacggataatttacttttacttcatagcccgcgtcctttaggtcttccataatctgagaccgtgcggcgataggcagaccattcaatgcgtaagaatctacttctgttttacctgaggaagctgatccatcaatatttgatataatagatctgcgagctgctataactgccatatcgttagaccttttggctttagctgccattgcttttgcatcagtaaaagacatattcatttcctctctcaaatttatgaatctattatattaaaaattcacgtggtttgcaaatgaatttttaatataagtggcccgaaggccaccttagttatagtaatttagctggaggaactagtaaattactgttatagtcccgcttggctggagggttttctttaggcggtttaggggcaaactgacgcattagtgcgtccatgcccttgtactttaccatccctaggataacatctatgtgtaaccccgaggattgaaccagaaacttcagctgagactcctccctttcggagaaggttattttggggcgtctgttaaataatcccataagtcctcacgcggtgaacggatatgcaatagggtcatgagacttataccccacgattttaaagtcgtctttagaaacccaggtgagtacgtcctctagggtttttatctccggattgatctctagacgaggagccgggaaaggtttgcggtcgaattgaccatgttccatgagaaccttgtattggttctcatagatgtgcatatttactatacgctggtttgctctgattgcccggttccctgtgatctgggccataagtgcgaggaacgtgtagcattggaccatattaaatgcctgtcccaataggaagtcattggatctctggaaggagtcgagatacagatttccattgagtagcgagaactggtgggtatgcatgcacggtcgtaagcatccttgatcaaattcgccagggttccagaaggtgagaatctctccgcggtcatcaatgcctcgtcgtaaattctcatagatcttatagagttggtcaaagtgggaaccatccggtcgaagccacgttctgccctgtactccatagactctacccatatcgtcggttccctttctgttagggttgaccagccacgcctcgttttcgttggcgttagcgttccacgtattgcagccgatagcacggaattgttctgcggaatcatatcctcgcagatatccgataagctccatgatggcctgaagggcatacgctttacgagttgtgataagtgggaatttctttccgagtacatcatattcaaagtttgaccctattacggttaaacaacgaacccccgttcgagggttctccagccagacaccttcttcgagaatgcgtttgccttcattaatatagtgaatcacagatagactccttccataacaaaacgataccgctcattttccccagaagctacatgagttactacagcatccggaggagtggacgtaagtatcgggtgttccagatacatgatgtggtctaggcttggtactgtaccagccttaggataaatggtggagcgataaatcgcatccagacagcccatagttgctagggtttctagcagagctttccctcctatgcagactacctcaacttcattacagaaatcccgaattttggaacccaagtgggtaataaaccgcacattacggggagggttttttatcagaattggggatgctgaacctactacgtacaccatggatttcttctccagtgcctttttcagtcgggaaggagccgttgtgtaggtattatggcccaggataacaacctgataggtatctaggattttgtagaactgttctagctcctcggggatggagccccagggaagttccccgtaggcatccatcgtagcagggttgaacacgccaaaagccccatcaactcgcattgcgtataaagctgtaatcattacaggaactctccaaattcatcagacaggtcgtccgggttagcctgagaggttgcaccaacacgatagttggtaatctgtgcttcttgcggagctacttgctggttcttggtgttcagccaacctttcatccagccaatagggtcttccataattacagggagatcctccggccacggaatgttgatcgccataaatgccagacgtgcgttgtaatacaggtactctaccagcaaatcggcgttcagacccgggatatcttcgccttccgggaaaatgtagtgtgcccagttgatttcggtttccagaatgctgcgcaggatcttgggagcgttagcctgagctgctgctacaacatggggaggaaactctccactctggataatgcgcagaacttccatcgccataacggtgtggagcgcttcgtcttttgcgataagctgtaagttcttagcgatacctgtcagaatatcgttctccgccagagcaaaggtacatgcaaacgatgcgtagaacataatggcttctagagcgtatacagcgtagtagaactccagaattttctgctgtacttgttcggtaagtggattcagatccacatataaacgatctgagatctctttaatacgtacctgttcctctgcaatttcgtttgcaaggaaggatagctctgccttttctttatcagtgttatcaatgctctctaacgcattatacttagaaatgcagtcattaaggttctctgaagctaactgaatagttgcttctacatcctcacgttctttcagccagatatccgcaatttcagacagttcatcgataacagaaaccggtagtgctaaacgtgcgaatgcttcgtcgttagcctgtacagttgcaatgaagtcgcccggattagggagaacgttgcgaataatgttggaatacgcacgactgtgaatattctcaaagtagctccactgaataagcataccttccagctcaggacgagataccagtttcaaaatagcatcttccggagcacgggtgataatggagtcggcttgagtttgccaggctaagttcagcagggtcttgtttttaatatgctgaggcagattaggccattgtttcttatcggcttccagggagatctcagtctcaacccagaactgcgagcgttgcagtaacgccagctcctctagacgaggatagcgaacgtttacatagtcggcgattcccaggtcttggcccaggaatagtttagactcagtgtgatcccattcgcggttaaatactgttgccattgtttaatttcctctctcatttaatatacgaatattataacaaaaaatccaacctacttgcaaataaaattttgctttcggttggatcgagcttaattacagagtacaaccgccactggaacaaccctgctctgctgcagagcctccggtatctacgtcaaagtttgcgtagtagaggttcttaatcccatatttagtggagttaaggagatctttgataatctcagtacccggaataatacccccaggatatttgttaaagtcgtagtacaggttggcactaatagcctgatccgtgaacttctgcagaaccgctaaccacttgatgtgctcagtacggtcaatatcgaacgcatacttatatgactgcatggtgtcccaatcgtctagacccggagctacagtaattactttgttaacgcccgaagtcttgatagttactgcactgcgaggaggctctactgcattggtaacaccaatcagaacagagctagactctcccggcatacttgccgttaggacagagttgcgcataccatgagttttgatctcttcacggaggctctcccagtccatctcgagacctacggaaaccaggtcatccacagtcttcttgtaagtatcgattaacagcgtaccgtcagaagtatgagtgcggtggaaccactcacatgggccaacctcttttgccagacgtacagacgctttgtggaggaagaacgatgccttctctgcctcacggtggatccagttacgggcttcttcgccttcgaatgccaggccttcagcggccatcgctcctgcggcgttcatcagtccaatacctacgttacggcggcgcaatgcagtgtatttcatcgctgggaatgggtagtgctgaatctcgatgatcgtatcaacgaacttcaacaggatataggaaatcttctcccactcttccagagttttgatgcggcctagggcgaatccacctaagttacacagagatacttctccgtactctgaaacatccattttactcagctcttcgtctgtacgatacagatccactacatgagggatcgggaacgttggctgtacaatctcaacacaaaggttggacatgcgcacaggatctttaaagcgactgttacggtttacttctccagcgtccatagtgtacagacggccagtttccatgcgtacagttttccagaattcgatcagttctgcggcaggaatcacaggggctacagggagaacttcgcccttgaaaccacgtttggtaacacccgctagacgtttttcggctgcgatgtatagacgttcaaattctgctacatcaccagagtcaaatgctgcgtatacttctggagcgtacaggaagctcatcagtgtgatgttctctttacgcaggaagcgtttcaggagaatactgttaaacttcaggttgtagtccatcttatcgattttcttttcatcaggggaacggttgctcttagcttccattacctgaatgatttccggatcgaagaacgcagtgtaaacagttgcagaaccgccacgggactgctgggtgttagcttttacggagcggtcgatgtgtcgataatatggcagttttccagagtgtgggaacgcgccttttcgcaccggatcagcaattgatctactctcaagatgatagccgatccctgctcgggcagcgaccattttgaagacgacgtgctctgctgcgtcaatggagtccagggtgtcagtaccatcaacaagacagcaagaagcgaagcccctgtcagcgctccgaaggcccacgagcgacggagttgggacgttgattttctgtagcgacagcgcgttataaaggtcgattgcatcgagcatactccagtgaggttgagaaagcattgccattgccatacccatgtaggcaaactgcggagtttcatagatctcttccgtataaatattacgtctagagtatttatccatgaactgcttcagaccagcattagtgaatagttcgtcacggctgtggtcgataacttcgtttagagcttcaaactggtcgtcagagatccagccgctcatatcttcccacgctcccagctctaccatgtggtcgtggaagaagcgcagagatggcggggtgtaagaatcaaacaggttcttacggagctgggctaaacgcagctctagggcgaatcggtcgtaacgatgatcacgctcgatcattgattcagcagacttaatgagcattgtttgcagatcgtctgagtgtacatcacctttcggcaggttcttaactgcggctaccgctaccggagaccacggcacatcgcttcggataccgatgtattttgcccagtcattcagcttctgagccatgaacggttcttttgtaccgtcacgcttgataacgtattcaatacgttgggtcattggtaactccttttggaagttgtcaggatttaaaagatattctactttgttttcggccattttgcaaatgagattttacagacaaaaacaggcaacccctttcgaggctgcctgtgtgtcggtctactttaataaaagtgtaattttttcattcgactaactaactctttagtaccgaggggttggttaggaaactcgtttgctatcttgaaagcggcatggtgtcgccgctcatcctcaggatagttagcattgtatttattgactgttgccagggatactggatgcaccttcgttttacgggtgcggaagttgttcagtgtaaatacgttgttcatacgcgctcctagagttagaggtcaggacgttcgtcgtgagaagtgataccttcaccgaagcctacaaagccccagttttcttcagaggtaataccctcaccataaccaatgatcagttcagtaaccatattagattcccatatcgttaaagattgcctggaatgctttggattcagcggaacgcacgttatcatgtaactctactaaggagaatggcacatgttcgtactgatcgtagatatccatgatcagttgcagaccagagtcggatttaatgtctttctgcgctacgtcgccacagattactaatttgcaatcctgacctacgcgggttagaatacacttcattgcttctacggagatattttgagcttcgtcaacaattacataagaattgttgaaggtacgaccgcgtgcatgttcgatagcaaggtattggattgccttgcgttcaaccagcccctgataagaacgttcccctaaggcccatttaaagccatcggcgattggttctaaccacggtgccatcttctcgttcagatcccccggcagcatccctagagatttgccaagcggttcgttaggtcgaacaagaatgaacttctcgtacacagaacccggctttgccagctcttgagcagcgagaacagatgggataaacgttttacccgtacctgcttctccaataccaactgttaccgtaaagttacggatagtgctgatatagtgtttttgctcagcgttcttcggcttgagttcttttgcggttggttgaaaacgttcccgtgcttcaaaatcaacggggatgacgttttcgtgacgttcacgttttgcgctaccgttacggcgcgactccttacgacgtgctgcttttctcattgcgatctccttagaggtctacagagggtcaaatttcgaccatgtttatcaatttagaataccagtataccaagttttgccgtggattgcaactgaaattttctagaatgatacggaggacatatcctttcctttattcgcgcgatgcgcgggcgcacacgagtaatgtaaaataggggagataagcaaataaaattttccggtttttattgttttgatgatccagatcaagttactgttgattataataaaatagggttgacatagttgtgtctatttggtataatatatgcctaactggaggaatatatgaacgaactagacctgattgataatatctatagtatcctcgataacgagggtgaagaagaccttatgtttaataatgccaataaagcaagcgagcaattccctacacagagggacatgatagctggggaggtttctaaatatgtggtagcacaggagcttccagcatacctcttggcggcgcataatagaggagagatacacattcacgatatggactaccgagcacaggggtatactaactgctgtctggtagatttagcggggatgttcaagaacgggactaaaatcggcggggcagagattgaaaccccgaagtctatctctacggcagctgcagtgactgctcaagttattgcccaggtaagctcatgccagtatggtggtacgtctatcgaccgtattgatgaagtctttgctccatatgtacgtaagtcttacgataagcacttagctatcggccagcgttggctgcacgatagtaagaaggcagcagtgtacgctaccgaaatgacagagaaagaagtatatgacgcttgccaggggctagagtatgaagttaacactctattcaactccaacggtcagcaaccatttgtgacatttgggttcggcctaggggaatcctgggaggcacgtatgttgcagaaagctatgctggaagttcgtatacgggggcttggtgcctcaggtcatactgctgtatttcctaaacttattttcgcagttaaggaagggctcaataagtccccaagtgatcctaactacgatatcaaacagctggcgctcatctgcacttctaagaggatgtacccggattacgtgagctacgaaagagtaacggctgttacaggtgattttaagttccctatgggttgtcgatccttcctttcagctattgagtctggggaaaccgctgggcgcaataatttgggagttgtatctattaacctgccgctagttgctgtagagtctgaggggtgcttcgataagttctggaagctgctagacgaatatattgataaagcgatggctgcccacgattgggctattgagcggttgaagcgtgtgcgtgctaaacaggcacccattctctatatgcacggggcttttggggtacggttgaaagccaatgatcttgtatggcccatctttgaaggcagggcatcagtgtctttgggatatatcggtattaacgaggtgattgaggtaatgtttgaagataccgaccctatgtctccacctgcggttgaatttgcagtacgggttctcaatcacatgaaagaccgttgcaacaaaaaagctgaggaaactaatctcggattcagtctttatgctactcctagcgaatccttatgcaatagattcaacactaaaattgccgaacagtatccggagtatgactggctaacggataaaggctacctgactaatagtcaccacctggatgtccgtacaaaagttgcccctaacgtgaagtttgactatgaggctaattttaccaccgtcgccaatgggggtaatatatcctttgtagaacttcctgagatgcgtaagtttatctctgcactagaatgggttgttgactatggattaagtaagtcccactacataggtgtcaacattccagttgatgaatgtgaggagtgtgggtatttaggcgaatccgtatccggagagcatggttttgtatgcccccaatgtgggtcgggggatatctcagttacccgtcgtgtttgtgggtacttaggtagtcctggtagtagaccctttaaccctggtaagcaacaggaagtaatgcaaagggtcaaacacatgaatttgaaataaatcacttgctaaatacctccgtttttgataagatagttgtaattgagaaacggaggatttatgaaaatccataaaactgatgaaaagcgtatctactttatgatggactctggagcatacggatctatttcccgagaagacgtggtaaaacttctgcgatgccgtaaccacttgtggaaagataaagtcgatcccagaacctctgagtgcttgtccgaaaaggctgagcagttgcggaaagaagaaatgagaaactatatggagttcctgtaatgcgtagattgattatcgtaagtggtgctggattgagtgctgatagcggagtgccaacgttccgtaagggtgccatcactcccctgtgggataaatacaaactaaccgaagtatgcaatattcaggcgttcgataaggggtttcactatctgaacgaccctatgcccccgttagaagccctttctgagggatctgatgatgagcctagccgtaacctgtataaactaacccatgagttctacaacatgaggcggcaggaactaggtacggtagagcctaacattgctcacttgagaattgccgagtggtataaacgcttcccaggtcaagtagttaacttcaccactaacgtggatgatctgctagagcgtgctggcattccccatgatgatgtgatccatgctcatggatacctgacggagataatgtatcgccgaggtaaggatgtgatcgtggaagatatcgggtatactgcggtagactaccgtgagtatgagtgggttaagcctgcgattacgttcttcggggaaaccgctccgtggtatatggggcagatcaacttatttgataccctaactacccaagatctggtaatcgttgttggtgccagtaaccaagtaatcgactttaattgggaactattcccagcccatagtcgaggtactaaggtgtgggtagtaaacaacggtattaactacctagagcagagtttgtatgaagaacgcggggtccccgtttggtatgatactgctgccaatgtatttagcaacaaacatttcataggtcaagttgaggcttggctggaggagaaaatttatgtaccatcccgatgatatcctgttatggcctaacggtagttggtgctaccgcagtgatataggtgacatgagtcacttgtctgatgactaccaggttttacgagcggactctaagcagtggcacgaattcattcaaatgggagaagaatatgctggtcaatgaaaaggttgttaatgaaggggttgggctagttccctgggctgaaattcctttggacgtaaaagagtccttgctggaccaccttcgtgtgtggtgcgataatatggaggtatactttgattatgacaacatgcacctggggctgtgggttcctatggacgaagatcaagatgaagtcctagactggggcgatctgactgagatggggctggtgtttgcactaggctacgtgtgtctgctgcgtgagtcctatatcccggttggggttacaggtgtttcagcaggtatttgggtcggacgtaatgaagattattatgctccggagaatattaacagttggatccaggtgctgcgtcgcttcggtttccaagttgaagggttaactaaatgagtattcctaaaatggaacgtatctcctgggcggatatccccaaggaattgattgatgtagcagagaatctgctgcgagccgcgttgagggacgaggagctttgcttcatcatccagcatgacgtgtgtattggtttgtccaaaggtagtttggcccaggattatgagatcctctttgattgggatgacctctcggacttgggactaatggttctggtgaacaacgttgtgttccacccctctaactttgcagcattccgggaaccgggggtgggtatttctccggggttcttggtagctgaggagccctggacgtatgctccagaggttcttcgtgaaggcaagcaaaatgcctcttctaactcaattaatattatgggttggaatgcctagttgaacacttagatcaggggattatcctctggtcttttctatgcttaaacccagttacctaccacgtatttaaatattttacttgcaatctcgccacgatttttatataatatattcataggttgagagaaatgatgtgagttacaaaactgacataattcctctcattcacttccgagcatacagaacagtccggctgctacatgcttggttgggtttggcttattgggaaattgattccgaacggaattatagataattgatctagaatgcgggtaagagaggttggcatcgcgaggctctcagatatttgttcgttagtcatgtggagcaaatagcaccgcggtctgaaatgaccaagaagtgaagctgtaagtagcaacgtacctctgcgcaatagcgacgaataggggtcaaccacatggagcttagcggcgattacatgctgtgtgggagttgtgcgaagcggccagttctagcaatgaggaagtgaccatccctccatctataaggaaatttgttgagtcagtggacttttaagctgttctatccttgatagttcgagatcgctttattcttcaacataggagaaaacgtaatgttttctattctagaaggacacgcgggtttttcccgcgatcccgcttccggaaactggaaggaagtgaagacaactgattacctttttgcgaaggagttttctaacgagcatccagaaggtaaaccagcctcaatgccctacaaatttaacgtagtggatacggttgaccccaaaaatcttaatgaagcgtatgagctgatggttcagctcactcaagatccacatctcgtagcagtacgaggtacatgcttagttgcagagaaggccgtgcgtcgtaaacgtactaacttcaaaatcgaccataagagcaatattattgctatggacgtcgatggaatctccgataccggaggatgcgacaggtttgacatcgtgggtatgggacgtcatgtcattaagttattaaatagcatcagcgaggacatgttcccgctcaacgcagggtttattgcccatgcgtcgtcttcggctggaattaagccggggattcgtatgcacatgctattagagagtaatattcctgttactcagggtcagttaaagtttctatttacgtctctcaacgatagctctcggcagaagtatggttttgatattgccgacttagcttactactcatctgtacagctgcattatttcgctgacccgattttccgggatcagtttaccgatccgtttaaagcggagggtaagccacgtctggttaaagttaatggtgctaggatcgaactgcccaacactatgccagattacgaagctactcgtggggagtttaaagaggagtttctatctttacttaatcagattaaaggcaagcgtgtggcctctgagaaagtagaacaaacaattgcagagctggaagaagcagaggatggtgtttatctgcgtattattcctaaactgtatcacagagcgctagaagacggcgttgatttcgcgtggcttgagaaagagattacctcggccttatccgattatatcaacacgaaggataactcccgtagtctacaggattattttaataacggacgtaagcaggcgttaaaagcgtttgtgaacaactccatgcgagatattcccgaatcgaacgttaaaggcgttcctgtgcacaagttggcctctgatagccctgatgggatgaactatttgaagatcaaccgtccaccgccggaaggtcatctaacgtttatcaaggcttctctagggacaggtaaaaccaccgcagtgacgaagtggctggagcgtgatcagctgaaaggcaatttccttgcagttacgaacacccgtgccctagtctcgtctaacgctaagaagtttgaagccgggcagtacgataagtccgtagatatgctaaacttcaaacgcggtgcgattgatcgtatgtctactactattcactcaatccacaagtttaaaaactttgttgggcagatcgatgttatctttatcgatgagtgcgacgcggttatgaatgatctgttattcgctccagttgttaaacaacgtcgtgagtgtatctcagttcttcgtgaaattctgctatctgcaaaagtagttatcttgtctgacggggatatcagtgcagaaaccattgaggcatatggatctctcatagattttgacaagccggtctcttattataaacatcatcgtaaaatgctctcggatgctcaggcgtatgagttcccggatgaatccagtatttgggttgccctccaaacatcgctagagatgggggagaaatctattctggtatctgactgtgggccagatgagttgaacgagaaaggcctgacgttacgaaacaatacaggtgcgattgttaaagagattcactcaaactctacatctgatatagatatccgtcgtattttagattatacgacgaatgagttaattgaacagcaaattgactgtctgttgtgtagcccgtcagtaacgagtggtgttgactttaactatttcgacaacgtatttgttatcactcgtacagctaaccaggcgccgaacatgcgcttccaggcaatcaggcgcgaccgaggagctaagaacatcttctacttcatcgataagtccaccagtggattctccgcaggttcggagcagtacaacatcgatgagggttggatggaactagcgcagcagctgtacgttaaacgtcgtgagctagagtcacgtaactttatcagcacattacgatattatctgctggatcagggagcaactattgatatcttcagtgaaagctggggtaagattgatagctcagccgcagaatatactgctgaacgagtttccgctattttgagcagtaccccggattggtgtgcaccccgtcatgcagacgcatacgaagccaagctaatgctggtcaagtacttccacctggactctatcaagagtatcacacaggaacatgcggagatgtggattagcaagaaacctcacaagcgagcggaattcttccataaacttcaagatatattctggaaggatattaagaagtgttctaacgtgacgattagtccgtttattgaagccctgaagaaacacaagaaggacttctttattagaactggacagtctgcaaaccccaaatatgcccgtatgtacttaacccaaatgggtattaataaggaaatggaaacggagcagatcgtagactggtatcgaacgtactgctctatcgagggtatctctgtaccgtatgagtttatgacggacgaggagaaggcgctggctgatgaagcgcaaaatgaacttggagtacgtaatgagcaagcgtgatgctcgctgggaaacaaggaagtttcctaaacgcgatattaagcccaggaaggttaaagagatagagctatgcagagtaatacctattcgcttagcacagatgccaaatatttatgattggctagagtctcagcgaaagacacgcctttctatacgcattaacatggaacttaatatggggtacaagagtctatctgaatttatgcacgttactttcgaccctacgttctatgaaaatcgcgattgcttagaagctaaatctgtattataatagtttcataaattcgagagaggataaagaacatggcaatccgcaaaaaacttcatgctaatagcatcccggatgaaaagttcaaggaagcgattcagtggctagaagatggcaagaccaagaaaggcgcttgcgaaatcctcggagtagcttctaactccacgatggagcgtttgatcgaggaatggaaagataaccagcgtgtttctgctgaaatgcgcaaaaagaaacgtggtactaaaatcgaaggggctgagctggccaacgttatcgattcgtacctgtccggtgatagttttgaggcaatcgccgagcgtttctaccgatctgcaaacatgatccgaatggttctgtctgcacatggtgctctgcttcgagttaacggtgaagttgacccgctctttccacctgcgattccagaagaatcaatgaaagaggtattcgaagtaggcgaacacgtttggatcccagggtaccagtgtattggtgaaattaagaaagctctagataacccggtaggagcttaccgtatttacttgctgtctgaatccaaacagcagtatgttaactacatgtattgggatatagcttctgtagaacatcttgtttccctgggagtggatatcaagtcgctagggtttaaatggagcaaagaagacgtagctgaactggttaataacgctgttaaggctgctctgaagttagagaaacgcggtaaaaatgagtaaatgggatattctaactcaagaggtttgttcaaaactttttgagttatcagatggcggtatacgctggaaagtaggtaaaaatactggtcagttagccggatcgaaagattcgggtggatacttacaagtggacctacgaatacgctttaacgatcctcgactactggttggggttcaccaagtagtattcatgatagacaaaggtttcgtacctgatcgcatagatcacgaagatgggaataagttaaacaatagccctggaaatctacgggaaatttctgcctcacacaacgcattgaactctgccaccccagtaactaatacctctgggtacaagggtgtggtatttgagaaggatcgccaaaagtggcgtggcagattcacttatgaaggtaaacgttacgtgacctcacgggttaatactccggaggaagcacacgaacttctagagcttcgaagacgtgaggtcatacccaactattcaaaaattgtagttgctaatcgctaagtaacttgttataatattctcatagtttgaaacaaaacttaaaaactctttttaacaataaataaggaagtaataaatatgtctactccaactcaatggtctcctgaactcgaagctgaactgacttctgcctacgtcgccaaaattgaactctttccggaagatgagcgtcctggtgtctctatggagatcgtagctgagatcgctaaagaacacggtgtttcccctaacggccttcgcatgaagctgtccaaagctggcgtatacgtcaagaaagaagccggtaagtctaccgctaaaactggtggtgatgctcctaaagctggtggccgtacttctaagtctgatgctcaggctgaactgcgcgctgcatttaacgacgctggactggaagatggcttcctggacgaatcgatcgttgacaaactgaccggtaaagctgcctctcacctggctgaagctatccgtaaaatcactaaataagagggtattgcaatgaataaagcacaagtcgtagctatctgtgagaaacacggtgagttttgcatgcaatacactaagctgcgtaccaaaggggtaacttacctctacggtacgactgagttcgatcctaagcaggataaatacctggctgagcgaatcgtacgtgaaggcctggaacccgctgacaaagatcatatcctggtctttagccgctctagcgataaattccgctatattccgattgcgaatattaagcgcatcaccagcctcaaccaagaacttgatcgagctactccagtaggtcgttaagacgcaatcagccccttcgggggctttttgtttatctgagaacaataaaaatgaatcaaaacatttgtcaggattacgaaggacatattgatgatcagtcccacgttatctttgaagatgaagggcgacagattcgtatgactgtctcggagtttagaggcaatttatactttggtttccgattatggttactagatattgaagataactggttccctactaaatcaggcttctcgttcccttacacgttagaaatgaccagcacgttgttccgtgcctttactaaaatactaagcaattcagaggttcttcatgaagtttaccgtgaatctcaaaagacccaagccagtgacgactaagttgctggctttttctttaaaatctcaattgcttagtgttttaaaccttgatataatattctcatagtttgaaggagatctttatgaaagatcatgaaattgctcagttggttaataagctgaccgaagctgctaagacgtatgctcatactcagcaattaagagcacacatgtctagaattgtcaacgaggcgctaaagaatgcaaaagataacacttaacgcgtacttcagccctccgctccagggccaggaactagttctcacgtggcatgagaaagaaaatggtaagccagtagttcatgtattgtccggcttccagatgctaggcatgtggtacgagaagaacgtattggtatgtgagctgtatagtccaaaatctaatcgtagggtaatgtccaccttccaggcggtatgcgaaaacttttactgggaaggaaagactcagatgctgttcgattactacgaggtcaaataatgcaacacgttaaagaatttatcaaactgtgtcaagacgcatattacaaaggcatgtcgattatctccgatgaagagtatgatgccttaatccgtcgttttccgctagaggaagagattggccctaaaggtgatgtacctcatctgttccgtatgttctccttacagaaagtgtacccaggccgcggcgaagaagtacccttccagggcattgaaacgccgaagctcgatggctgtgctatttcacttctgtatattgacggaaagttcgtttctgcgttaacacgcggtaatggcgtcttaggtaatgatgtaactcataatgtgaagttactgaacatacctaaacagatctcccaaaagacccctgtgcagattactggtgaagtacacatcaccaaagaagttgagaacatgcgtaacttcgcctctggtgctattaacctgaaagattctggggagtttctctcccgtattgcggaaggtggcctgatgtttacggcatatagtattcagtgtgaaaccggcaaagttggcctgaccgctactttctgtggggatatgcatatccttcagggtgatggttttgttacctgtctggatatctccagtcgagtagactggttcccaacggacggggtggtggttcgtatggatggcaacaatcagtttaacgcagcaggttggactaacaagttccctcgtgctgcgtacgccatcaaagaagacgatgaaggcgaggttactacgctagaacgggtagaatggcaagttggggcttccggtaaggttactcctgttggttacttcaccccggtagtcatcgacgacgctgtcatctcaaaagctaccctgaataatgttggctatatcactgcccttgacctagaaatcggttgccagattcgtgtaattcgtagtggtggggttatccctcgcatcgtagaacgcgtttacgagtaacacttgattcaatagatacaccgtgatgattttttaaagtagttattgacattttcatcgccagggtgtatactattatcattcagttgagggaaagaaatatttggtgagagactgagctaaattctgaaaaatttcgattgcttagtcctgattttcttgctataatatttatataaattgatgaggaagaaaatcaatgaaaattgaaattccactgaattgcccctcttgtggttcgaaactggacttagttaacgatcagttgttctgccgtaacaagtctatgtgtccagctcaaagcagtaaattaatcgagaacttctgctcaaagatgaagttaaagggctttggcccacagacgattgctaaactggaaatcacgaaagtttcagaactctttttcctgactaaagaagatttagtcagagctgtaggtgataaagtcgccacgaaacttgagctagagttggaaactaagctgagacaagatgttgactttggttcggttcttggatctcttagtatccctcttatcggtgaagttgctgctaagaaattatcccagctttacaacgatttccaatctgtgaaagcggaaggtaaagctggagaaaacttagcttcgtggaagaatacaccggcaggacaggacgtaattaatctaccatggaaattcagtggggcgcgggaaactcaagttaccccggcgactgaatccaacggagttgttctttgcattactggtaagctcaacgacttcaaaaatcgtgccgatgctaccaaatatctggaaagtcttggatacacggtgaaaacctccgtgactaaggctgtaaactacttaatctgcgaagatgaaaccaagatcggttcctcttcatacaaaaaagcacaatcgctgggcatcgaagtcttgacgattaaaattctactggagaataaataaaaatggctaaattaacctggaacgaagaaatcactgcatccctgaccgctaaagctaacgctctgaacgcgaccgttatctctcaggaagctgttgctaacatcgctgctgaactggctgctgaaactggtaaagaagttaccgcccgttcggttggttctaaactgcgtaaagaaggcttcgaagtgcagaaagcatccgacgtaaccaaatctccgtggactccgggtcaggaagatgaactggttgcattcctgaacgatcatccgggtcagtatacctacgctgaaatcgctgctgctgtagttggtggtgcttataccgctaaacaagtacagggtaaaatcctgagcctggaactgaccgccgctgttaagccgactgaaaaggccgctgctgtacgtagctttagcccggatcaggaagctgctttcattaacgccgttgccagtggcgcgtccgttgaagcaatcgctgctcagttcgaacgtactgttaagcagatccgtggtaaagctctgagcctgctgcgtgaaggccgtatcgaggctatgccggttcaggaagtctccaatgctaaggcacgtgaagacgttctggaaggtctgaatatcgccgatatgactgttgctgagatcgcagaagcaactggtaaatccgagcgtggtgttaagtctatgctgagccgccgtggtatctctgctaaggatcacgatggtgttgctaagcgcgctaaacttgacgctaaatccgccaagtaattgatttgacctgaggggagaggaattttgttcctctcccctttttcgtttaagtagacgctaacgcggcgtagagagtatcttatgtataacgtccaagcagtagttttgaaaatgctcctagcctccgatcaaaagcaggtggccctagagacattctctagactgcgcaaagatcacttcaatgacgcatttaccgcgatctaccaagctgtccagaattattacaaaaagcataacggaatgccttcgttagatgctctaatgctagagtctaacagaaacgcaaggttgtctcaagcactaactgttttagcaaacacccagattccagacgttgacatatcgcatgcgattcatgtcctagagtcggaatacacacaggatctattcctgaatctgctagaaactgatgtgttgcaggatattaccatactggatcagggagaattacttgatcgagtagcggctctgcacatgaagctagaggaacgagtaacaacgactggtaaggtcttcaacgccgatactatgcgtgttttcaagagaaaagaagactcgatgttaaatcttatctctctcggcatctcaaacgaatttgatgctcaacttggcggaattgccagaaaagaaacactgctactcggtggatggcgtggtacaggtaaatcaatcatctgttctaacattcaagtagcccagtattacaacggggatatcgccccatatttctccatcgaaatgccagagaatgaggtctttagacgtaacctagccattatggctggcgtttccgctaaggctatgcgcaacgactccttacaaggtattgaacttaacaaacttgcgaagactcgtgcaaaaatgttcgaaggcggtctggaagtatataacgattttgtatcacgttatacgctcaacgagatgagtgacttccatgacatggagactatgctaatgcaggaaagacccctgcacactccgatgatcattgtgtatgatccggaacttagtacagcaaccatcgatgttgaactaactaagctaacctccaagtatggggacaaggtaacaatcgccctgctagactatatcaaccaggtacgtttgcctgatacgaagacattagatatgtacgattggaagcagcagatggttgtctcctctacattcaagtctacgtgccaaaagcataacgttgctggtgtagccccttaccagattgaccaacagggtaacgcccgtatggcaagaggtatcctcgactcctgtgacatggccgcaaatctaaacgccgctaaacagaacgaggggcatgacggtgcaatcaagtttgacttcgtaaaaactcgtaactccgagggtatgacattcatgccgaagatcaactggaactcgttacgtatggatcagacttctgatcttaaactagaggacattcgtcagatggaagcagagtttgttatcccacttgaaagcgacaaaccgaaagacaaaccaaaaaggaaaaaggcttcggatgaggatactaatcccaccggagaatcctcaagagacttatgagtagaataaccgagcttttagatctcaaagggattgaatacagagatacgggtggggacatcctcatccgctgtctcaatcctgatcatgaggatgctcatcctagtttgcgtgttgaccccgattccggggtttttcactgcctaagctgcggatttggtcgtggtataccaagcatctttcattacttcaatgaagaacagtacaggacgtcgcctagactcctgagagttcgcagaatgattagtgacctccgaactgagggtcgcagtctagaaattccagaatcagccatgatattcgatcaagactttcgtggtatcaaagcagagactttcaagaaatactttgcattccaacaaacagaggactgggaaggtcgtgtagtgtttcctattacggatgccgtagggagaaacttattcttcttaggccgtaatatggatagctctgcccctccaaaatatatgatcagacctaaaaaggtctccccaccaatcttccctgttcgatataacaccccagccctaatcctagtcgaaggtatattcgacatgttgaatctagaagataaaggttgccataatgtttcctgctgtttcggtactcaccagttctccctagataacattgcagataaattcatgccgttccaaatcgcaggtacgactcacgtagtcattatactggataacgataaatctggtaacgaggcagctaagaaactagccaaattaatccgtgataagactagaatcataccaattatcggtaactttctgcttccagagggtaaagaccctggagacctagatgctgaagaagtcgaccagctcatcagaaacgtagaaatcttgattgctgaacatgtcaagatttgatataataattgggtaagtttgagaagaaacactgacgttttacttgcttacctaataggagaaatcaatgaaaattgcagttgtagacaaatcaccgaataacgtccgctatcagaaacacttcgaactctttgaccatgaggttgagaccttcttcatggctagtgagaaagtaaccgggcgactgctcaagaaacatatcactatcggaacaccggagaacccgttcaatccggaagattttgattacgttattctggtaggtgcagacccgttcttgaagtttgcagctaagaaaggcatttccgattactcaggtaaacgtgttgagcacgatgggtacgctaactggattgcaagtatcagtccggcccagctccactttaagccggaaatgaagcctgtatttgaagccacagtagagagcattcatgccattctcaatggtcgtgaaaaacgctccaaagcaggtgattaccgcccgattcagtgcccagatgaagccgaagcatacgtgaagatggtgtataccatgtgtcctggtatgatcgcatatgactccgaaaccagtgcgctgtattgccgagatggttacatgctggggatctcaatctcccaccaagagtatcagggcgtgtatattgatgcagacgtcatcacagaaaataccgtctattacttacagaagctgttcgatagcccggaacatggcgttgtgttccataacttgaagtttgatatgcacttctactgctatcacttaggtttatcctttgacaaggcagcggaagagaaacgccttcatgataccatgctgatgcactacgccctagatgaacgacgtggtacacacggtttgaaatctttggcgatgaagtatactgacatgggggactacgattttgaactcgaccagttcaaggagacgtattgcaagacgcataagatcaagaaagaggatttctcgtatgatctcattccgtttgatatcatgtggccttacgcagcgaaagataccgatgcaacattgcgtctatccaatttcttcctgccaaaagtcgaagctaaccctcgactgaagtctctgtactacgatgtactgatgccgggatgtgtattcctacagcgtatggaagaccgtggtgtaccgatttccaaagatcgtctaaaagaggctcaggttcagttaatgactgcgctacagcttgcaaaggctaagctgtacgagtatcccgaggttcgtaagctagaggaagatcaaggctcggtgtttaacgcagcctctgttgtccagctccgtaagctcctgttcgattatgttgggttaaccccgacgggtatcatgacagatactggtgcagattccactggcgcggatgccctgaaagaactttcagaccaacatccgatagctaagactctgctagagattcgtaagatctccaagctgctctcgacgtatatcgagaagatgctgatcagtatcgatgctgacggttgcattcgtactggattccatatccatatgactacatccggtcgtctgagttcgtctggtaagctgaacctccagcagttacctcgtgatgagtctgttattaagggttgtattgttgcccctatcggttatcgcattatcgcatgggacttaacaactgctgagatctactatgccgctgtactgtctggtgacattaacatgcagcaagtgtttatcaacatgcagaacgacccggaaaactactcggatttccacggttcaattgcacacatggtatttgccctgccgtgtaaaccgactgaggttaaaaagctgtatcctgcactgcgtcaggctgcaaaagcgatttcgtttggtattctttacggttctggcccggctaaagtagcagcgtcagtaaacgaagctctcctagaagagcacatgaagactggtaaaccgtatactgaatgtactactggtgatgcgaaagagtacatcgaaacctactttggccgattccctcagcttaagaaatggatcgataaatctcactcccaaatccagactaacggcttcatttacagccactttggccgtaagcgtcgtctgcacaacattaactccgaagaccgtggtgtacagggcgaagaactgcgttctggcttcaacgccatcattcagtctgcgtcttctgatagtctcctgttaggcgctatcgataccgataatgagattcgttctctgggtctgcaggacgaaatgaagattatcatgctggttcacgactccgtggttgccattgttcgtgaggatttagttgatcagtacaacgagatgctaatccgtaacattcaggtagaccgcggtattagtattccgggctgtccaattggtatcgactctgactcagaagctggcggttctcgtgattactcctgtggtaaaatcaagaaacagcgtccttctgttgcttgcattgaggacaaggagttcgaggagaaagtacgtagtattatcggtatggaggacttcgattacgctgctattgcggctaacgatgaaaaccaccctgatcacgataagtacgccaatattaagttcttgccggaaatcagcaaagatattgtcaacgttcgcagggttcttggtgcttaactttagcttaccagtatatgctttaagggcttatgatgtactcttccaagagggggagtacgttgttatccagacgagatttacaaggtatgtgctggacaatccaagccttcctgggacattctctcagcgaaggctttttctttatggtgagcgggaaaatttaccttacaagctctatccattaaagaaacagttcaagtacttatctcaaataataaattctggactaaagcatttcatcgactccacaggtaagatagtaacatggaaacctacaacttattataacattatcacggaacgcgttagaggatcaactagaatcttcaacggaaagtaccagtgttatgtcaagaacgttccataccctttcttacttagtgaacctgccaactatatttcgtacgcgttggttcgcggttcacccgttatttttgatacgcacgaagaggagccagaaactcctagacttagagttaagatatgaagatagttatatctaataaaatctattgtaaacccagcaacgaactgtgggaatacttattaaaacacacttcataccagatctttaaacctggggcgaagtatcctttaatgttccagaactcgggatcggtaggtaaagaaatcaagtggttccctgtaaccagattagatcttctagaatctttcgggcaaaaagtgacagagatcgtggacaaacgtactctggttcctgtggatattccaaagccatcgtttaccctgagaccaggggatcagctccctatatatgaagactgtaacgatacgtgcattattaatggtaaacctgggttcggtaaaacaatccttgctcttgctatcgcccataaacttgggcaaaaaacgttagttatatgtaccaacactaccattcgagctatgtgggagaaggaggtacgcaagttctttgggattgagccaggagttattgggtctggcaaatttaatatcgattctcccatcgttattagtaatatacagacagttaacaaacacggagccgctttggcaaaagaattcggcaccgttattgttgacgaagtgcatcactgtgttgccaccacgttcaccaagtttctagagcagtcctcggcacgatataaaatcgggctatccggtacgttaaaacgtaaggatgggctacaggttatgtttaaggactattttggaacgaaagtgtatagtcctccggtaaataacactctgccacctactatccataggtttgcgctaaaaacgcaggtttctggaaatatgaatgtgccgtgggcgataagagctaacgatgtgtattcgcagccagagtactttcagcaggttgttgacttgtgcgagttatactcgatggcaggtcataaagtcctatttgtgtccgatcgtatagatctgattgaaagagttacgaatgctttggaactcaggggtgtgaagacctacacgattaccggtgtaacatcgctcgatgatagggagcaggtacagattgacgtgaccaatgacggcccatgtgtattagcggcttcccaaagcatcttctcggagggtgtatcattaaatgctttatcgtgtttagtgttaggctctttaataaacaacgaatctctaatcgaacagttggcaggtcgtgtccaacgtatggcagatgataagttagacccaatcctcgtggatctgaagctaggaggtgtaggatttaagcaggcggcaggtagagaagcggtatatcgtctcaatgggtgggaagttcttgactttaacgagaagaatatggcaaacttagataaaattctgtttgctaagaaccccaaagtttgatataatatttatattgaattgagagacagatttacaaagaagagttaagcaaatagttaaaaatttcagttgctgagtcctcaaaaatacgatataatatctgtataaattaatgggaacagcaactgaatcttcggaaagtccgaagcagaaaaataaaaaacttagttgctaaattctctcaaaatggtgtataataatcatgttgttttatgattacgaaaagatttacatattagcgagaggcaattcatcgctgattgtacagattatcagacgaatggttgaagatcccgaagctcatgtgatgttaacgggtagatcattcatcctgaacgaaaatacaatcgtttataataaacgaaagctgtcagaccgacagttggctgagtatctagggcttttgagttttagaaactatgccgaatatagcttctcgaaggattcatcactggatatgcaatatattccaccgtgggttcctagagcagttatcgagcaccacccactaatcgcaatcaacaagtcaaaattgacatttatcgaggaaaattaaatatggctactaaatcttggggttctactactggcggttctaacggcgacaaactggactacatgaagttcaacaacggtaagaacgttgtacgtatcgtttccggcgttctcccgcgttatgtgtactggattcagaataaagaaggtaaaccggctccgttcgagtgcctgcgtttcgaccgtgaaaaagagcgtttcatccgtggagcatccgatccggttcacgatatgggcttcaaagatccggagaagaaagatggtaaggctcagccgctgcgtcctaagaaaaactacctggccgttgttatcgaccgtactgataacaaactgaagctgatggaagttaaggcaaccatcctgaccggtatccactccatcatggcccagctgaatctggaagatccgggtgagatcgatatcactatctccaaatctggtactggtttcgatactaagtacgatgtacagcagatcgcagctatgcagttccagatggctaaaaatcagccgggttctaaagaggccgcactgcatgaagccgacgttgctctgattggcgaggctctgtacaacgaagcggacgaattcgaaggcttcgaaaaagtgcctaaactggatgttacctacccggttccgtcctacgatgagcagaagaaagccatccaggcctggctggaaggtaagaaagatgaggagggcgatgaatctaaaggtaacgaaggttctgcaaactccggtaacatcgatcacgaagcagcttctgacctcgattaatccaaacaaggggagcttcggctcccttttattttgactatgaaaatacttttctcagcagaccatcacattaagctaggggcgaagaacgttcctcaggaatggcagaaaaaccggtttatacttctcggtgaaaagctggacgaagtgtttggggctaccgggtgtgacctccatattattggtggcgacatcatggatgtttcagacccgtcttcagaagaagttgagctactgttcgcattcctagctactctccaacatcctggtattatttacaccgggaaccacgaaatgaaatctaaaacgatttcttgcctggatcactatgcagcagcaatcagcgacgcaacagatggactttggaaagtcgttaaagactaccgatctccagagttcgatatcatcccttacagcagccttcacaaagctagttggaagcccagagtttcagacatttgcttcacacatgttagaggtgcaatccctcctcatgtcgtaccagaaatcgatctcgaaagattcgtcgaacatgggtactccaaagtatttgcaggcgatctccacagctacaagaacagccaaaagatcggggatgttgacctgctctatcccggatctccgcttacaacttcgtttcacagagaaaggacaaaaggaactaacggagcttttatcatcgatacggtcttgccaagagaccatgagcactacctttcgtggattgaactgggagatcttccacagctcatacgaaaaactattgaagtcggcgagccaatggaagccgatgcgtatgacagagttatatacgaagtcaccggcgacgtatcacaactcaaaacgttaaagaacagcgaactgttagataagaagatcaataaccgtgtcaccaaagatgctaagttagatctagacgatatgtcactgctacaggagctggatacctacttcacaaacgtgcagaaactagacgaagcgtctagaactcgcatattaaagagagccgctgagtatgtcgatagtaattaataaattgacaatcagccattttatgtcgtatgctgagaacgtggtgatcgagtttgataatcaccgcgtaactcagttaatcgggcgtaatgggctgggtaaatcaacaattggtacagctctagaagagcttctttataataagaactcacgcggtatcaaaaaggacgacctgtttaactggcatactggctccaagtcctatacgctagaaggtcagttcacgaaggatggtgacgtgtataacgtcaagaaggttgtgaagtcaaccgccaaagtaaccctcactaaaaatggggaagatatcagtggtcacaccgcaacccaaacgtataagctgatagaggaggtacttgcctgtgattttacgacatttactaagctcgtatatcagtcagttggctccagcctcgacttcctcaaaaccaccgatgctcagcgcaaagctttcctcgttaatctgtttgaccaagaacagtacaaggaagtttctgaacgtgttaaagcgggacgtaaagcagtctcggcaaaactgtccggattggaaggtagcctgcgaactgcccaatctatactttcctcaaaagcctcgcttggtgcacctcaatcagagatcccaatccctgttttcgatgaagagccactcgtcgaagaattaactgaagcaaaagttaaggtagcactggcccagaaacagaaagccagtattgcgaaacgtagctctttggacatggccgtacaagccgccgaaaaaacttttgcaccatttgaaaatttacctgcgcccacctcgaaatctgaggaactcctgagtgttacgcgtaacctaacggttgtggcaactagagcggatgatttgaagaaacgctactacgagttcaaaaacgcggcaggtaaaactcagtgttctgcgtgcggaactcacttagacacctccgccgctcaagaggctatgagacgaactaaggaggagtatgacccgctctataaagaacgtcaaaaactggaaacagaagttgaagaacttagaaaggaagatagagcgttcaaggattatatctctaagtttaacgctctggaacaggctcgcaagaatctcaaggaatttgatgaggtcaatggaacgcaggatgaaatcgtagatacgagtggattagctgaacgcatcaaagccattgagtctagcattcgtcagggcaggtcttcggtagagctagcaagaactcataacgaatcagttgtgcgggaaaacgcaaagtacgaagccaagcgcgaacagattcaaagagctgaacaggagtttgataagatacaggccgagttatctctcgtagcggaagaggtagcagatctggatattctgatcgccggactgaaagacctagttgggtataagctagagcacagcgtcaaggtatttgaagagatgatcaaccactatctctctattatgaccagcggtaaatttgctctagggtttgagttggacgagacgaagctacaggttgtcatctacaacgatggtaacaggacttctatggtcaactgctccacaggtcagcagagtcgtatcaacatctccacgctattagcaattcgaatgttgctttcaacaattagtaaggttaatatcaacctgctcttcctcgatgaagttgtaagttatattgaccctgatggaattaataccctcgtagaacttctacaggaagaagaccagctaaactcaataatcgtatcccacggacatacacatccgtatgcgcataaggttgaggttaagcaagatgaagctggcttatcaattttggaggcctaatggccgttgatagtcgcgagaaaggaaaacgagcggaataccaaatccgtgatatgctgcgtaagtatacctcattggactgggaacgtgttcccggttcaggagcttttggccagtctcactctttaaagggtgatgtgtatctaccccctagtgtgggtaagatgagccaatactgttttgagatcaaacactacgcagacgagaaatttaatagcaatatcctaaacgttggagaatcccagctagaaaaatggtgggcccaagccgcacgtgaaggtgagcaaatgaacatgaaacccgccctgatctttaagaaagatcgtggtcaatggcttatcgctctggatagtagcgaccctatgattgataacctcatgagtagagcacatttcattgtaaataaacgtggaatggaaattgttatcggtctttttgagccgtggttaaacgcatgtgatattggagatttagttaaatgagtaaatcctggggaacaatgaaacgagaggcagaacaacgtctagcctcacgccgtaatcttatgattgttgacggtacgaacttgggcttccgcttcaagaaagatagtggcaaacctattgcagcgtcttttgcaaacaccatcaactctctggcaaactcttacgatgcgaagcatactatcgttctaggagataaaggaaagagtatcttccgtactaatattttcccggaatataagggaaaccgtgatgcaaaatacgcggatcgttcagcagcagaagtagaggcagatcgtcaattcttcgagtacttggacgatgcgtttgatcttatcgcaagccaattccctactttccgaattcgaggagtagaggcagacgatatggcagctttcattattcaactgataggccagcactatgaccatatctggctcatctctacggatggcgactgggacaccctactagccccgaatatttcacgcttctcatttactacccgtaaagagtatcacgagaaagatatgttcgacaaccataacgtagatactgtagaccagtttatctcattaaaagccattatgggcgatatgggtgataatattcgtggtgtggagggcatcggtgaaaaacgtggatataatctaatccgggaacacggtagcgtgctagacattattgatgcactaccacttccaggaactcaaaaattcgttcaggcactgaataaatcaggcgaactcatggagcgtaacctaactctagtagatctcccaagtttctgtggagaagcagttgccgcagcaggacaggatatctacgaccaatttgttaaagacattatggctattgccacaggagaagtataatgcgtattaaattatctcaccccgattgtaaacctcacgttggaagttcagaagccgccggtatggatctacgggcctacttcggagatcgtgcttccgacctattgcgtgccatacccccaggggagtcattgatgattgataccggagttgcggttgagattcccgaaggttgggtaggaattgtggttccgagaagttctctaggaaaacgtcggctaatgattgctaatacagtgggggtgattgactcggattatcgaggaactatcaagatgaatctgttgaatatgagtaatgagacacagccaattgataatttcgagcgtctgtgtcagttggtggtcgtacctcattataaccccaatgacattgaaattgtcgatagcctaacagacactgatcgtggggagggtggatttggaagttcgggaagcaaataattttactgatcctagtatggtaggtattaatatgccaacttatcaggttataactaatgaaccagaaatgttagtgctaaaaacagacaaagagggtaatgttactttctgggatcctgaaggttttgtagaactttgtactaatactgataatgaacatttaaaaatactattaattatctataatcttggtattatagagggctgtagaagcatataatagaaaaccccagtggacaaaatccactggggtttcttttttgtcaaactttactagccagtaaattttaactacttgggttaggcctgctgtttgcttttcaaaatctctattagacgattggttgagtgttctgcatgtaatattgccattgaatgcttagctagagcatgtttttcatacaaaaaatgttatgaaaaaggggccgtttgtcccctttgattattcacctttcagttttctaatctcctctttcagttcgtcaacttgagccgaaagtgccttgattgcgcaaagtgcatccattaacagcgggttagtgtcaagtacgagtcgcttattctcgactacgttcccgtcctcgtcctgataggatgcttcgctttctttgacatagcacgggtcaatctctcgcacctgctgtgcaataacgcctcgacgctctcgcttctgatcatcatccttataggtgaacttgaccagattcattgctttgatgttttcgagtgattgcaatccatcgtaatcaacaacattgtctttatagttaatgtcagaaagaccagcaaaaacaacgttgccataagaagtgcttgcaatattaccatctgatttaaattgccaatactgcgtagttccagaggtaccccatttgctgagctcaataacggcgcgatgttcataccccctatgttcctcaagccacatagagcaacgcgcagcgttaccagttgtgttaaaccttgagatgaatgatggggctttaagtatcgcgccatttcctccagtcggatcttcaaggggccaagcaacgaaggcgtcattatggcaagccctaattagccctcgcgctgtgaagtcattcatagcgcgcacacttcgacaatcaagcgttagctgatccactgcgtcgttgataatccttgccgtgaaatccgcgctcgatttgttaaagtgaaaatcgacatacggcgattgactgtaaagctcaatcccgccgtcagtagttgtaatgtttccgctactagcagtaacccccttgcccacaacttcgccatcgacaaccatttgaccatttccggcaatcgtcacttgaccacttgcggatccatcgccatttggccggaagtacatcatttgcccagccttagagctaatgattggggaaccggaaggattgcaacgaattgctgcgccttgaccaaatgccattttggtatctccaccacttgcagccgtgcaagagacctcgatcccattgtccgatgccgcagcgccagctggtcgtaattgaacctgtctatcagtgccaccggaggcagacagaatcaagcgaccctcaccaccttcgcgaaccattgcaccgcgacccattactatccctttgtcacttcctggtacttttgatgctgcgccgccaccaacgccaaggtttccatttaacgagctagcaccactgatagcaagctcactaccagaaaggctacctgatgcacttaacgtcttaacactaacgtcttgattcgtgccacttacaaccgactcacgccactctgaccaagttccaccattgctataacgtgtgaattcacgatttaaatcagagctaaaaatgcgctgacggttagtgaaatcagtgtcgctcactttacgaagtgactcgacgtaaagaatgaagtttccgcctacaccgcttggcttgttagtaatatttgcaccaccgccgtatccgggacaccgataaatgcgtatcgtcccaggagtactcaggttaatcgttaggctgttaagatcaagtgtctgcccatctatgttctcagcctcccaagccccaaaaaagccattagcgaacgtcattggtccagcaacagagaaaccagcatccatcattttacgcgttacaaccttgctgttttgcgcttggtttgaattttctccataagcgagatcaccctcaacatcaatgcctaaaagctttgcactcatgttgttaagtttaaacccaatcgacagatcagaatcagcatcgcgtgttaacatgattggcgtgtgttgcttgccactaactcttagacttgttgccccagtgtctgtgtcgtcattagagaaatcagcggtacgagaagagatcttgtggctgatctgtgcatttctcgccccgatttgcccatcgtgacgaacgtaaaagtcaccgctattggtgccattctttgttttggctcgaatgtgaacttcgccaagggaatcggtgtttactgaagagcttatcaacccgcgttcgctaccatccccattcctgaaccagaaatcggcgttcccgcttgcagcgtttaggctgatagacggcgttccttttgagatcacaagatcaccagtcatggtatcgccaaccttcttaacttgagcgtcgttggttacattgcttaggccaacatctgattttgatggcttgttaactgtgccataaagggtatttacctttacgttaccggcattgaggcttgcgtcattggcggcgagtaccacaaccttaccgctgttatagtcaatgttaatcgctgaaatagtgtctccgcagcgggaagacataccagagccgtgagacataatgcttgagctagctccagacttctggcttgctcgccaaaaatgcccccctttctctctcatgcgttgcaataagtctgcatcgctggtaatgttatcatatgaaataccactacctccaagaccaaaagcacctacctgcatcacgttatcatttgacgtaccaacatctttataagctgccgaacctagtcccaaagcctcttttgacggtttgttaagctcatcatacacgcggatagccttgctttccacccagccggctggcatgtcgttttggctaacatatccgctaggaatatagaggtcaacccaacctgcttttgccagaatagccaccttcacgttattaatgaaagcccgctggaaggcccaaatctcaaagaaaccatcaccattaacaatcccgtaccgcaattgattatcttccgcaaggctcggatcaccaaggcggcgaatctgcataaactggcgaacgtttgaagcgttaataacggttgttccaaggctacgcgctgacgcatcaagaaagtctattgagccttgacgcgctccatagtttccgccgttagtgatcattagtgtaacgtggcattcagacgaacccggatcagtgagctttgcgatttttatatacttttcccctgccgctgtaccaacgggccagttatattgggtcagcggactggcaataagagaggctttatcggcatactccttagcattcgtctcgctagtctttgcattcgtctcgctagtctttgcattcgtttcgctagtctttgcattcgtttcggatgttgcagcagcgtttttgctgttattagcgttcgtctcgctagtctttgcattcgtctcgctagtctttgcattcgtctcgctagtctttgctgccgccgcactcgctgctgccgctaccttactactgtctgcgctagtagcacttgttgccgccgcgttcttgctggctgctgctgcgttttctgacgccttggccgccgtctcacttgctgctgctgcgttcttacttgctagcgctgccgtttcgcttgctttcgctgcatcttgactggtttttgctgcgtttttgcttgctgctgctgcattctcactagcttttgcgttagtctccgaagtcttagcagctacttctgaagccttagagtttgtctctgaagtcttagcagctacttctgata

SEQ ID NO: 132 - DNA, 177973 bp, Unknown; identical to SEQ ID NO: 1
  source: /note="Description of Unknown: 1.2-4br Bacteriophage Sequence"

SEQ ID NO: 133 - DNA, 177973 bp, Unknown; identical to SEQ ID NO: 2
  source: /note="Description of Unknown: 1.2-4s Bacteriophage Sequence"

SEQ ID NO: 134 - DNA, 47116 bp, Unknown
  source: /note="Description of Unknown: 8M-1 Bacteriophage Sequence"
cttgtccttgtagtcgttaatgcctgcggcggtggccttgttcgcggcccactggaacgggtacgggtcatacggcatcggcctgaatcccttttccagcttcgcgcgctctgcgtcaatcatggtttccgcgatcatctgtttgatcggggtaagagtagccatattttctattcctgtgttgacggtcttattccggttgtatattctgcctcacgaatatctaacaacgcaaggacaaaataaaatgatgcaaatcggcaagcaagacgcgccagaagtgaacgaagccagcctgcaacgggcattcatacggcatatggggaactcgttccaggtgatgatcccgaactactacacgcctgataacctcggctatgaggcggacttgttttgcatacgcaagacccgctatgtcgtcgaagttgaagtgaagatcagcattacggacatgaaggccgacttcaggaaggcgcacaccgtttacccgaagacggcggaagagtcgaagcaatactggccggatgaaaacgggaaccggatcccgtacccggtcaagatgaaacatgactgtttgcagcgcggcgaactaatagccaaccgcttttacttccttgtgccgtggactatcgccgacaaggcgcgggagatcctgccgaagtacgccgggctttacatcttcagcgaacgcgggacggtctacgaggataagcaggggccaatgcttcacaagcgcaagctggacgtaaaatatgaccaggggatcatgactaatctgaattgccgctacctggcgctatggacacggaaatgaaattctacccggtagaacagatcgagaagctcatggtcggacgttgggaatacctgctcggccagtattgggatcaacgaacattcaacggtcggcaccaggcttgtccgatatgcggggggaatgaccgcttccgatggggcgcgtcgaagcaggacgccagcatgaaggggcgcggcgctggcatctgcaaccagtgcggatcccacctcggcctatggtggttcatgcaaacgaccggactggacttcttcacggcgcttaacgacatcggcgaaaacttcctgaaggtcgaaccggatgaaacggaagcgccagccataccagcgcgccagcagatcgagaaggcaccacgcatcaagatcagcagcaagccgacggcgctggaacgctacattcagcgcacacagtcggcggccgggtatgacgaatactactggctgacctatgacttcatcgccatgctgcgcaaatacaatatgtagttgcattattatattcaggtgtcgtaatatccagctcccgaacaaaggagtcaaaaatgaaaataacagtcgatttattcagtaagtttgatgcaataattccacagcttcgccgagatattcatgaacttactcgcgatgaatacaaggaactttccggcctgcttcgcgccatcaaaaacggcgcatgtactggaagccttaacaaaaatatgcttgtggaaaataaaccaatgtatgacctacttagtgtggccttatggtctgttgctcacgcactaataaaccagaatgaacagtggcgcgatatcgtttacaacgccgccgagtgcggcgagatatataagcctgagaaggggaagcgcttcttcctgcaatacaattacagcggcgattctagaaagtgggttcgacttgaagactctgttcgtgcctttagcataatgttaggaatgtgaggaaataataatgactgaagaaatcaaaaagttaacaggtagcgaagtgctttattttctgaataatgacctgtcgaacgaggcatatcaccaggagaccgaccatatcagcgggacgtctttgtgggaaatgctttcgacctgcctggcaaaatggcgctacgaagaaaacgagaagaaaaagcaatctcgcgcgctcgtcttcggcacggcggcccacgccaatcacctcgaaccggagttattcaatcgcgaatacttccgcatgccggagaaggaagacttcataaagcgtgacgacaaaggcgagatcatccccatgccgaacttcatcacgtcgcttgaagccgcgaagtcgttcctgaagctgcacggcgtcgccgggtacagcaagatgaaggaaccggaattgatcgagacagtcaccaacacagccgaggcgctggggatcactgatgtgattttctggcatgacgtgctgaaccgcgcgaacgaggaacgcggcgaacgtgaaggtctgcgcggccaggattatgacatcattcaggaaatgcgcgccgtgctgttcaataacgacagtttcaaagagttctttgtgggcggcacttccgagatctcgatcttcttcgaatacatgggtgtgcgctgcaaggttcgtctggattgggtaagcccacacgccgacctgatggactacaagacgacggacagcgcgaacccggagaagtttagccggaagacgttcgattttggctacccgctcaaaatggcattgcagcgtgaaggattcaaggcggcgttcggtcgcaagccgaaccgggtcatgctgctggcacaggagaagacaagcccgttcgtcgtggcaccgttcgcgatgtctaacaagacgctgaagatcggatatgcgcaattacgtgaagcgctcgctatgtacaaatacgcgatagagaatgatttatggccgacatacggcggcggtaatgttctggatctggatccgcccttctacatcgaaaacaaatataagcacctttgggacgaccagaaaactaaataattgtagcgcgcgcggtggcgtcgtatactgcgcgctgaatattcagcacaggagattaaaccatgcaattctcgcaaccatccagccagatcatgaagcacttcgctgaagctcaggcgctttgtgttagcccgacaaagtcgaagcagaacacgcacctgaaaaaccactatgcaacgatcgacgacgtgctgaacgccatcgggccgagtatggaaaactccggcctaatcgccatccagtcgccgacatatcagccgggccagcctgctaacgtcatgctgatggaaacaacgatcattcacgtttcatccggggagtggatgaaagatatctgccagatcccgctcgctaaaaacgacgctcaagggttcgggtctaccgtgacatacgccagacgttactcgctcgttgctatcttcggcctgaagatgaacgacgacgacggcaacaagtcggtacgaactgccgccgattgcagccgctcgatcgagcaagcggccacagctgaagacgtgaacggcatcgctcgcgccgccactgaactgttcgcgaacgacaaggcgtcgctccgcatcgttgaagcggcaagggcgaagcgcttggtcgagttgaagaacgccaacgcgaagccgttcaatcctggcaagccggagaaagcgcgcaaggggtcggtaaaggttgcagcagcagacgaagcgccgcaaaatgctgaacctcaaccgccagtaaataacgacccgattgaagaggatttctaaaccatggcacagcgcggagttaacaaagtaattttattagggcgcatcggacaggatccagacgttcgatacatgccatccggcggcgcggtctgtaaccttagccttgtgacgtctgagacgtggaaggacaagcaaacaggcgagcaaaaggagtccagcgaatggcatcgtgtcgttctgttcggcaagctggccgagatcgccggggaatatgtgaagaagggatcccagctgtatgtcgaaggacaaaaccggacgcgcaaatataccgacgcgaacggcgtggaacgatacacgacggaagtcgttcttcaggggccgagcgcggttatgcaaatgatcggcaagccagcggaaggaggcggccagaattcacagcatggaggccagcagggcgcgcggacgcattccggcaaccaatcacaaggcaatggcggcccggctcgtcagaatccgccacagggcgctaatcagccgccgatggactttgacgacgacattccattttgaggactgacacgtgaagattaaattgaagatccgcgagcgccgcgaagcgctcaacatgacacaggccgatctggtaaaggctaccggattgcgccagccgcgtgtctgccgttatgactccggcaaggagttcccgacgatcgagaagttggtgatcctgggtaaagcacttaagtgcgaatggcatgaactggtagacgttactgaagcataaaaaagggggccgattggcccccgttcttattcccctttcaacttcctgatctcttcctccagctcgtcgacaacctcgatcagatacttcgccgccgccaatgtgtccattaagatcacgttattgtccagctgaaggcgatcatcatccacgcgctggccgttacgcatgtatgacgtgtttacctgcttcacatactgcggatcaacgtccctcgcctgctgcgcgataatccccctgcgtgtccgttcctgttcgtcgtcgttatagacgaacgtcaccagctcaagcgccctgatgcgttcgactgatagctgtccgtctgtcggcttgatatcgtgcttcatgcgcgcgtcagacgtcccctggaactggacgttcccgttctggctgctgtagatcctgccgtcgctcaggaactgccaccactgctggttagcgttgaacccctgaacggtgatcgctaatcggtggtttgtgccaacctgttcctcaaagtaaagcgaagccactccagacgccgcgcctttgctatcagctccacgttgcttgaatttcatggacacgttaggactgttgatcaatgtcccgttggtcgggcttcctgggtcgctttccctttcagctacgaacccccaccagatgttaccctcaaccgtgttctgtccgaacgttcgttgattgccgcgaactcgccagccaggataaacagccagcgcgccgtcttcagtgatgatcctgtgagtaaaatctgaagtgctgcttccgtggtgaaagtcgatgtatggcgtaggcccggtaagctcaaccgccgggcctccgttaatcttcccggtgatgttgatatccccggcaacactagcccctgctttaaacacggccttaacgttaaacgtctgagtctgcgcccatgtgttggccgtcgtcgtcttcgcgacgtccttcagcgccgtgtcgatgttctgctgtcgtgtggcgtattcgctcaggaactgcgcccacgacttgacggtggccgtcgttccgtctggcttcgtgatcgtcacattgccagccccgaacaaaaactgttgctgattagccagatccacataagtgcggtcgaagcacttctgaatgctggccgctaattcgtcgctgatgtttgccattatgaaagcgccctcggattcaatgtgtttggtagccctgtgacgtcacagatcatgatttgggatctcattcgatggatccagtcgttatatggatagatgtcgagatagtcgccagtcttcaccagtgagcaaaagatattccccgcgccgtctgtgtgtgagcactcattaaggcggtatgaataaatcccgtcgtagtatgtccactcgcgagcgaacggcatggacagcgcccaattcccgccgccaacgttgccgaccatagtccagttcgacccgttaacgtcgtttgcgtggtttgggtatcctggatccatccagataacatcccttagcttcaggaagttccagccgccgtcgaagatgattccgccgccgccgtcgaagatctgcaagccgtaggttgaccgttctggcgggatccacctgtcgaacaaataatactggacatagtcgaagttaagattcccccacttgtagacctggatatatttagtccatgcgccatcaccagcgtttaatcgggaacctgaagagcacgccgggatctgtgatagtcgtttgttgttgttgtccatcaccaggaacagcagcggcgcgttcagcccggtgacgtccatcttcagacacttcgccccctggaagtcgtagaaggaaccctgaaaaagctggccggaagacacaagcgtgtagttgacatcgtcggccgtagcgacagtcaggttgtagcggttgaacagctgaacgccgtactggctcatttgttataaactccatagtgaacgcgcatcatgccgccgtagaagatccccgtcccgacgtcgtcctgaaagtaagcgaacatgttcggcgtgtaccagatgcgcacataattagaaccgcattcgacgttagggaagatcggcatccagtacgaatagcgttcattattaggcacggtaaacccggtaatcatttcgacgtgcgcgaacggtgtcccgttattgaatggcacgttgttgatcgtcgtgttccagttcccgtctgttgtcagcgggatatcataagaccctaatcgacgggacatgatcacgctgtcgtctgcgttaagcgacccgtcaggcttgaaaatctgccacccatacgcggccataaattacctcatgaatagggggccgaagcccccgttttgattatgacagtttgccccacctgaatcggacaacgttgttttcgtcccggacaaggcaagccccgtccttatccatcctccagccgccggaaacgccataccctgaagactggatcgtgttcgagatcttggcgaagtcgatcgatgcgttctcaatcatagccgattgcatatacgcgacgccattcttgacaacgaacgggtaagtcttgccagcgccgccagtatacacgccgaacgtgtcagcctggactaagaactgagacgaaccagtggcatcaatgcctaactgaatgccagcgacgcgagggttgccgcccccggcatccgtggagactttgacgccccactgtgcgcccagcttgccgtcaatgtctgcgaccgtgcttgatacctgctgaacagttgccgacatgtcgcctacggtagagttgatcgtgttgatctgctctgctgtcgcctgctccagatctgcgataacggtgttctgctgcgtgattgccgcgctgttgtcgccaatcattgcgcgcatctggttgaagcccgtagccatcgccaggccattagccgcgactgtttcgttcaggccatcgatcgaggcttcagcgccatcgacccgcgacttcatgctgttgatggccgtggtgttcgccgtcacgcgcccgtcaatgttcgacacggtggtggtcagttcactgactgcgctggcttccgctttctgccccactccggtcgacgtcgtaacaacgattttgcggatcaggatgcgaacgccggaaggtgccgcgccagctgatgcgaatcgtagatagacataacgcccggtaaagttcgccggaagtgtcaggttaaacgtcttcgtctggtatgaagtcgttagccccttcagccattctgtctgtgaaacagcccaccctgtcgggttgttcaagtcgctgatgaatcccatgctgtcggatgaaggcgagaacccggaagcggtgacgcgcgcctcaatggatacggtgaacttcagcccggcttccgctgggatcgccgtggtgttcgccacgcggatagaatccgtcccggtctggatcgccttctcgccagcgttgtagctgaatgaagaaccgctgccggagttggcccactgatccgcgttgttcgtcaggtcgccgttcatgatcgcgttgctggtctgaagcatggcggaaagtttctgcgtagcctgtgagacggacgtcagttcttcgccctgctgcgtgacggtggtcgtcagcgcgtccagtgccttcgcggttgccatgtctgcgacagctggcgtccagtcggtggccttgttgcccttctccagtttcaggcggactaacttcatcccggtcttttgcgtggtgtcctggaatagtagcttccagttcccggcggccgcgatggtggatcccttcttcgccgtctgcgacacagtcaggcggtaaaggttgccttccttcgtgatcaccccgttgcgcgcactcattcgcatcgtccacgggtcagtctgtccgactgccttccctaacacgaagtcggtaaacggcttatcagtgccgaacccttcgctgtattcctgataccagacggacagcgtgaaagtctcgtccttctcgacgatccagttcagaacagacgggtcagtggtgtagttccgttgcaggaagctagtagccggggaaatgctcgcctgcggcgctgcgctgaagtctgagttcagcacaaggttagctccgccgacctgcacgttcgcaacggtattttccaggttggtgatcgcctggccttgcgaagtcagcccgttttccgtttgctcgacgcgtgtggtcagcgcttccgttgcgctggcgttggccgcaatgttcttttcgtcggtgacgtcgatcagatatgcgtcttccgcgtagaagttgccgccagcgatgaacaaatgaaacgtaaaccgcgctgctgtgtttgccgctggagtgtactcgcctgaaacgttattccatgctcccgtcgccggggtattggtcagcgttaggttggtgctggcaagcagctgatttccagtgtcgcgaacggctagcttcatattgctgccgtcaccctggatcgtcattgccgcatcacgacgaacccatgcgccgtagcggtacgttctgcccttcttcaaggacgtcgctttactttggataagtgtcggcgatgtcgtcggagttccccggaggatgtacgaacctgtgcgcggattctgtgccttgtacgcttccgcgccgccattgctcacagtccacgtttcaagtaagcgctcgaacgagtggttcacaaccaggttacccggcatttctgccagtgagtcagtatcggcgatcgactgagtgacgttgttcgtcagctgcgtcagtgcctgcccctgtgaagtcaccttgccatccagatcggtgactttgttgttcagggttgccagtgcgcttgcgtctgccttgttcttcagcgcgccttcaatcgacgtgatgtcgttattcagctgcgtgatatcctggctgatgctggtaatgtcgcccttcacgttggtgacttcggtcgtcaggccagtgattgccgatgcgttagcgtccgccttcttgtcgaccatgtcagcgtcggacacgtcgacgatcgtcacgtcgtcaaggtacatgctatagccagcgccaccagctacaccacggcatgagatccacagctggccgttagaccgaacgcttcccgccgggattgctgccttaccggagatcttgaaccacttatcaaaaccaatttccgtcacacgtgcggacgtgataaccagaccggagatccacgactgaccctcaccagaagcgccgacggttcgaataccgacagccacgttccacgacgtcggcaacgtctgaccgcttggcatcatggcccacagctcgaagcgatagacgccttcagacctgatcgtgatctgtttgcctaaatacttgtcactgttaccgctttcgccattaagacggcggatccatagcgatttactcccgatatgcgccgctgtgtcgctaacctgcgccgtgtagtcctgccccaactgctgaccgactttatacgactcaaacgaaccatcgatccacatgttcccgccctgatattgtgcggtagtcatggccgagttcagggacgtaatggcgttagagttaaccgtcaccttgccgtcaatgtcggaaacttttgtttgcagcgcgccgattgcctgcgcgttcgctgcggtgtcgccttcgaccgtgtccagctggctgttcaggtcggtgatcgcgttggcgttcgcttcggtagccgatgccagcgtatcaagtcgctgcgtgacggtcgccttgttggcgttataatcagcctccagcacttctacggactgcgtgatcgcctcgtcggcggtgacgcgcgccgtcttctcgctgaacatcaagccagaagtcacgctgtcgatgtttgtcccgtcatagcttccgcgcatctgaacggccagctgattgcgaagcgttgcttcagcgctgtcgccgtcggtgatggccttctgaagctgctggatctgcgcctgtgatgcgcccggagtcggacgacctaccgccagccagtcgatcgcgtagtagttatcagcattagcgccgccgccctgcgagaagtccaggcgaatgcgtcggatgatgtccgatgcctgccatgggatatctgcgatcgacactgccgcgatcccggttgccgggtcgaagtccggcgcggggatggaaaggcgtcgcgaatcgttccaaccttgttcactggcaccgatccagtacaggcgagcgttccacggtggcgtcccgaccttcttaatgcggagtcggatgtacttgtacgaattgccatcgatcagcgtaccagtgccggaaggactgcgcatttcagacgcagcaccagcaggaagaagccagccgtcctctgtgatgggtaacagattcgtcccgccgtcgtcggcgctccagccttcgctgtccttgtcgtagtaccagattttgaggctgtcgaactgctcgccagtgccagcggagatggacgcgatttgctgcgccagactgtcgaagccgtcctgcatggtcgtgttagtcgtctcgatctgcgcttcgacttcgttcttcgtgttcagcagcgcatcggcggccgcttgtgcggttgctgcgtcacctgcgacacgatcctggacttccttcgccagcccttgcgcgttctggctaatctgctggccctgtgcgacgacgtcggcggcgatctggtctgcgtgttgccctgctgcgtcggcggcgtcctgcgctgcctgtgctgcgtcagacgcgtctttgatgtcgccagtcagctcgccgtatgtgtcggagtccttgatcgcctgatcaatgttttcatagtagtcgcccatgttgtccgaggacattccgcgaaccactggcgaccatggcccggcatcaccgaacgaggaaacgaagcgcgcgcggacttctacgatctgcgcgaatgacaggccgtattgtgtgaacatcccggtcgggtaggtctggcttgtcagcgccacgaagtcgccgatcgggttgccatcattgccaacctgtcgccattccagatcggttgccttcatgtcgatcaggtcgtcggtgccagtcacccagcgccaggtgatgccgttcacgacgccttcgccgacaagaccctgaacgtccgggatctcgccgcgcttgccgtcaacgaactcgtcgccggactcgccccacaccgacgtctgaccgtcacgaccgacagcgcggacgcggatctgataggtgccagccagcaccccattcacgtcgacggacgtggtcgactgcgttggaaggttagaccacccttgcgaccagctgccgttagtctgcgatttgcggcgaatctggacttcataggccacagcattctcgacggcgttccacgtgccgttaaggttggccgagcgcgtcccctgattaatgatcgaatagccttccagctggatgttctccggtgctgggagttgtccggtcgggatcagcgtcgtcggacggtcttcgatacgtgcgccagtgtcgacttctaaatatttggaatggctataagccagcgcggtgacggtgaaattcgcgtcctgttcgttgtaaacgattttcgtcacgcggaagagttccggcgcgatggcttcgcagtccagcaggtagacttccccggactgaatagccacgtcgtcggacagcgtcagctgaaggcggtcttcactgatttccacgatgtcgcggatcaggtttccgtcggtgccttcttcacgacacaggaacttatcgcccggcacggcgttatcagggatcacgcggtcgacggtgacgatcgggccttcagccttcacgacacggccgccgaactgtccgccctggacgtatttgttcgccacggcgatcacgtcaccgatcaggtacttgataccgtcaaggccgacgcggtagctaatcatccgatcgttggtgttagagatcagcgcccacagtccgcgacgctgcgcttcgtactcggatacgcagccaatagcggacagctccagcggctcaatcccgtagcgctcgaccagatccttgcgctggacgacggtgacgttcgtcttgtaatggttcgccgggtcgtcatagctgacatgcgcgatccctttgcggttttcaacgctgccgtaggcatactggaattttccttccacgacttcgtcgttcgttaccgtatggcgaaccgctgccggggcatcctgcgcgatctgcaattgctggttgccgtagctcaccaggccgttaaagatcgataccatgtcgcggatcagcgtccacgcttgtgcgcgcttctgaatgtacaggttcgacgtgtatcgacgttcctgtgttccgtctgcgttcgtcaccagctcgtcgcaacgctgcgcgatggcgtacatcgtccacttgttcaggaagttcgccggaatgcggcggccgagaccgtagcgcttatgggtcgccatgtcgtagacgtgccacgccgggttggtggtgtacgcctgtttaaatgtgccatcccagctaccggaataagtagccgtgaccggatcatagttgctcggcacacggacgcggcggcccttcattttgatgctgatcttcgggatgttctggaacgacttagcgtcgaagctcacgaacagtaaagccgtccatgggtagcgaacgcgagcgtcgacgatctccgtgatagccacgatcccggagtcaagaacgcgtgtatctgcgtcgctgtccggcgtgatgcgggtaactcggatttgccagcccgtcgcgctcttcggtaggtcgatgcggtgatcgcgctcatagttatctttctgcttgccgtctaccgcgccgttgaatgcttcggtgtacgcgctatcgccgaccttgcgatattcgatcttgtactcaatgcggccgcccacgcgatcgccgtccgattcctggatcacaaggcggaagttcatcctgatgcgcacggcgtccagttcggtgttagtcacctggcgaacccatggtgtcggctgcttcagcgccacgttaatgcgtgtctcactctcaacggccgggaagccctggatcggttcttgtgtcggcgaaccgttgcggaattccacggtcacgccgggaatgttcacgcttccgtcttcgttctcgactggcgtcccgtccagataaacgcgcttaggcagttcagccgccgggatgtcctccacttccccctcggacagcgccagcagcatgcggacggttgcattactcactaatgagtctggatcttcgactggcgtccgcgcgttgcctccgccgcccttgtaacctttgatttccattatgatcgcacctcgttagcgataatcccggcgctgatgatagcacccccgatctcacgctcgccatacaaatcacccacgatattaccctgcgccgtggtgttcactggctggccgaacgcatacgagggcgcgttggctgagtcctcgcgcatgcttaacccggtagcctgcggcgacaacatttgcataacgcccccggccatggtcgacacaccagaggcgatcaagtatgggctgaccgcctggccgccggggatgaagctcgcaaccacgccagcgacgaccatcaccgcgccgaggatggtttggaacaggccgcccttcttgttgcctttgatgatgggtgcaatgcggaattccttcccctccgggatcgggttgcggagatcgtcgaagccgatattctccttcccgatgaacgacgcgaacacgaagccgcgcttctcgctgtcgcgcatgtattcattaaatccggggatgataacggaaagggcgctgatagcttcagcgcacgtttgaacgctcaggtgatggacgcgcccgaagcgcgcgcccagctcgccatataggcggatagtgcttagttgttgggatcccatgtgattgtctccggcaattgttcatgccgaaggataccagtaatacgcggttcaaggaacgaccccaaaagctggtcatatcctgatttgcggttcattaggtggtgcaagatcttcccgtccccggcgtagactccgcaatggttcgttacgttcgaggcaatcctgaacacgaccatgtcaccgacggccagatccttcttctccaagaacccggcggccgcgaagttctcggcggtaaaaagctcttcccccttctcccaccatggataaggccgacggaagtctggaagctggatcccgcgcgtccggtgccaggccataacgaggccgtagcagtcgcacgaccccagcgtgaagtcgcgaccttccagcgacgtcgccgtgggtaaatacgggccgccgatttgctccgtctcagtcgcacagatcagccaggggatcccggactcgttaatcatgccagcgtccagcgtggaaggaacaggcagaccgtccgggccggggtgtgaatggaatacggccacgatgtcgcccagctcttcagcctcggcgtagtcttctgccgggatcatgaatccggtcgccttgtcgtctgctgcgttccggcaagggaaataaacaaggccgtcgtcagtagccaggataaggccacacgcttctgtcgtgctgttcagacggacgtgttttaacagctccgtccgaagttcgtctgtgatttcagtcggagaagttaaactattgattttcatgataatcgccttttaatttcggaagtcggtagtcgttccgtccgttccgtctgagtttgtaagctattgaattcaaaagctgaatttcggaagtcagacggtgatggcttatatatatttcttacgaaataataaagggacatacacccccataaataataaacccccgtaggcgggtatttatatttaatgggttggtatgtgtattccctaacctcacaatcaaaaactatcggcctaaacggcacgctgtcgagtttaacgccgttaggccgtatgatttagcacactacgcaataaaaccgctcagaatgcgttacagcgcgttttagtcgatcaggcgcacagagataaatccgccatagtccagaatggccgccttcggatcctccaccagctgaccgaagcgaagacgacagtcctgaacgcatcccccgcattcatcctttgtgatgtcgtccacctgctcgcccttcgcgttataccagcgctttgcggtcgcccggttccagctgcaaccgttctcttcgtcggcgtccagccctttaccgtacaacccgcgcgcctgccactggcaaaacgtagagatctgccgggtcgggatgttcacgccgttaagctgcaacggcgacgacagggtgaagcgaacataatcgtcgctctcatagtccggtcgatcgatgtaatagaattgcgtccactgctgcaacgggtcagcgtctgcattacccccggcgaagttccgcgcgtcaagatatttgacatacgtctgaatgagacggacggaagcgccgaccatttcctgataagcgcggagataagcgcccacgacgccggactggttagcgattgacagcgtaggctgtgattgctggtcgctgctgaactcgatcccctccgccaaaaacggccagtagtcgaactgttttccgtcgaaccagatcggcttcggcttcagcctgctgtcgtcgacctgcgtctggtcaatcccgacgtatgagacttttctgatctcgattgtgccgttgttctgctgccagatgctgacacggaagcgcgttacctgcgactgaagccaatcatcgccgcctgtagtaagttgtgacatgtcgatcgtcagttctctccagccatccggcaagatcacttcgctgtctgcacgtcgcccgatcttctggaactgggtagaccattgatgtgtcgttgtgttgtagttcgcaacatactggtcattgttcgaccctactggctgagtgacccaacgatattggattttaaccttcgtgtaacgactgccggggatcccggcgatgtcctgcccggtactaaatccgaggaacatcccggagttagtcgcggtcactaacagcgttccgtcgtcggtgatggacttcgcgccgccagccacgccaacctcgccccaatcgccagcgccttgtcggataacgttcgcggcgtcgcgtagctcctgcgacgtgtaagggataggggagtagtgcgcgcggatcatgccagcaccgaacgccgtcccgtcgatttccagtaaccagatcttgcccgatggatccaggcgttgcgcttcgtcgaaaatactcattatccgtttaatcctgtgtagatgccgacagcctgctgaacctcgaatgacacggtcatggtcatacggcccagcgccctgtaactgatggttccagatttaaccgttaccagcattagctcgccgtgtggcgggataatcttgaacggtgtggtgatgtgtgccttcaggaattcgataatctggttcccgattttggccgttccagtccactgacaagggaactcatacaggaacgggttaatcccctcgatcacggactggcgcgcgccgtccccgaactcgttggatcgacttctgtccatcaccttcacttcaccgcctgcggccagcggccagcggaattgatcgatagttgccataaaaaaagcctccgttaagaggctttagtattcccggaatgattatccgtgtccattcattagcgcccagatccggccgcctggctgactggcgaactcgatcccgtcctgcacagcctggcgaacggcttcgcccatcgcccggccatttgccccggcgttgacttccgacgttgtgctgccgtcctttgcgacgttaaccgtcacgccgccgatctgaacgccaccaccagcgccaccttgcgccgtcacgccgagacggccggacgcgtcgcgggtcagtggcatgatggcttcaggcccggcttcggcaaacacgccaccattcgcgaatgctgtcggtgtctggaagttgaagaactgcggagaatcatagacgccgttcttgtacgcggaaagcgacggactgctatagacgcccccgttcgcgttcgcggtcatgaacgacatatcaaatcccatcgcgccgccgattccctgaatggctttaaaaacaagccacttgttaatcatctgcacgaccatagacaggaacgacttaagcagatccgcgaatccggccttgccagtcatgacgaagttgttcagcgcgtccgtccccatatccatcgcgccagtgatggccgttccggtcatttcggccatgcttgtgacgtccttcccccactcctggacggcggtcttcgctgcgcctacgaagtcgttgttcgctttgttcaggcgttccacacgcagacgttcgcgggtgtcggcgtcgtcggtgatctggtcttcagtagcccctttgtcacgcaacgcggccgcgcgcttcatcgcttcttcgtagcgctccgcctcgtcggcggtcattccccacgtctggcgaacggcgtcgatctgcgcgttcatgtcgttcgtgctgcgggtcagctcgtcggagatctgcgcctgccgttccagctgcttgacctcgtcgcccagcaacgcgactttcttggcatgcgccaggacgtcgttcttgttggctaacaggctttgctcgtccttcgtcagcttccggcctttggcgtcggcctggatgccctccagaatggtgatcttcgcctgcaatagctggtagttcttcatctgctcggaggcgttgacgtcgaacgcgttccggttcttcagggtcaggatctgcgcctgaagcgccagttcttgcgcctggtactgttccagaagtcggtcgccctgcgagacagtgacggctttctctttcgctgccttcttgaagtcgtcggccagcttgctgactgcttcgcggctcttctggtcagtggccccggtagccgacaggccgccagcggtgcgcgcctcctgctcatacttcgcctgtgcgttggggtcggtgactttggcgctgatcttcgcgaactcgtcggcaatcttcttgcccttctcgatcgcggcgttcccgcgcttctccacctcgtcgacatcgatcccgatagccgacaggacgcccttcccgtctacccccggcaccttgtccagcaggttcgacacgcccatggtgaatttagcgtccagtgattccagactgttaatcagatcctggaaggacagcttcacaagggtgacgatgtcgatcgcctggttgccccatgcgcgaagggtgatcccgatgtcgcggaagatgttcgaagctccgctcttcaggtcaagccacgcctggccgacgttgtccgtcgcgtcgatcacgtcctggcttcgcttctccatcgcgttcgcgtagatgttgaccgcttcagtcgccgccgcctgatcgcccttcgtcttttgcagggtgatcaggcgcttcatttccttctcgtcaaggaatccatattgttcgtttagcttggcgatacccttgatcgggttctcgatcagcgtgtcgaactgcttcatgctgtcggcggcgtcaatgcctgcccggctcatggtctgcacggcttgagcgatgcgcttcatctggtcggcgctggcgttgcctttgttgttcagctcgatcagcgtgtcgacagtgtcccggatgctggatccagtcttgtcggcgatggactcggccgcttcgttcagctcctgcgcggacttaaacccagcgccacccatgaggatcagagaagacgctaggcggtcggtctgctcgctgcttgtgtaggctgcatagcccagcgcgccgacaatcgcggcggtggccgccagccccaaaaacgccgggttgatgaactgcttcatggccttaagcgtgttattcacgccgccgaagctgtccttgatctggccgccctgctgaatcatgatcaggaaagggttctgaccgcctgccagctgcgtcacgatgtccgtcatttgcgccggaagcatacccatcgcggcgttatattgcccggtcgaaatggtcattccatcctgcaacgtcttcgtcttggcggcggtgacgttatagcccttcagtgcggcctcgttgttcttcaggatgccctcgcgggtcgcaaggatacggttatactcctccgcgtctttgctggatagcaagccggacgcctgcgcacgtgctagcgcctgctgctggtcagccaggtctcgcaaccccacgcgagtcgggttgatgcggtcgagtaactgctgaagctcctggttctgtttgtacagccccacggcggcgtcgcctgccgcttcgtccgtcttcctgttctcgttgttgaattgctcgacgccttcggcggccgtggtggccgacttgccagtttggtcgaactggtcggccagaccgtcggcggcccggccagcgtcttgcgccgcgctcacgaagtcatcaagggttttcgctcccctgttgaccccgctggcgtcgacgtcgacgatcaagcgttcggtattgtcgctcatgatttttggttccccataatggtcttgattgctgcggcttccatcgttgcaatatcatccattaaatccggtgtaacctccagcccgtagatcttcgccatcatggggatcaccgtgtagtcgaggccgattaacccgcccggccccgtgcgccattggctatcgatccgctggaaaaaagaaaagctaccagatacaaattcaggtagctctactgtcggacgatagtcgtcgatctcgccgcccatcatgtctacgaacgactgcggcggatcggggaagtacaatccctcaatcgcggcggttaaggcttttggcgaatgctccacagctcgcgctggtactggatgctgattgcctcgaatgcgcgcgggtagttcaccagcagaacggccagattttccgcgccgaactcgtccttcagctcccagccttcagcaacggccagaacatactcgaccatgtaagggcgaagcagttcgtcgcgttcggtggccgacagggccgtggttttatatttctcgtccagctcttcgacgcgagtctggaaggtcttctgaacgtcctttagctcgtcggtgttcaggcgtttaaatacgaattccagcttctgaagctcgtcggtgccagccatcgggatctcgacgtgatgcttgaaagtgccgcccggcaccagcttgaacttagcggtcatagtttactgtctcctgtgtggaagaagggcgacctaagccgcccgattgattagttcgcgtccgggtagatctgcatatcgctgatcaggttcaggacaagcgtgttcgtctcgacgttgttcacttcggacgccggaagctcgttaaaggatacctggcaaccgtaaaggcgggtctccttcgcgcgcttgttgtacatcttgaacgcggtagggtcttgcgagcggtcgaacgccttcagcactttgcgcgctgcgtgggtagcgtcgtgcgccatggtgaacgtttgggtcgctgccgacttgaacgtgttgatcgtggccgcgcgttccatctggatagcctggaaggtggtcgtctgctgttcgttgcctgcgttggcaatggtcggagtcagcggaaggtcgatccacttctcgatcttcaccagctcgcccacgccgccgccagccgggaacatgttcacgtcggcagtgtccacgccctcaagggtgatcgcgccttcggttgcggccttaatgcggcacaccagaccgttcaggttgacccaatctaccgacagcatgatgtagtcgccaggggaaagcgcgtcgatacctgcgcccgttgcggttgctacggcttcggttgcgttgctgatgcccgtcacggtaattgcgtcgcccatagtctcggcgatctgcaacgtcgaaccgttcggaatgttgtagcctagtttcggggccatgttcctaacctctcacgttgttaatacggtaattcatggtaacagctacatgtaaccctgcgtcgtcttcatagtcagcgccgatttcagcgggggacgtcaaatacagctgtttcccggcgatgctaacataattacccgcataaaacatagcttcgttgaaccgctccaccaggtcgtcggccttcgcgtagatgtcagacgtgccggacatgcggggcgcgcgtagcatgatctggtagattccccggcggttaaggtcttcctgttggatcccgatgctgatcgatggtgccgggatgtgctgcggaaatgctactaccgtgctcacctgctcgtcgctggcattgttggccgagctattgcgccagatgatagggacggtcttagcgtcaccccatccctttgtcaccttgtcaaaggccgcctgaatctgtgatgtgccgatcattttttggtgctccttaatgcgtctcgaaatgcttcttcaaactggatacatgagatcctcaccatgccagcgggtgcttgacggctatggccttcgtactccagcgggtagccatacggcgagttattcacgaagaagatgtgattcaccgtgccaactttgaacgtctcgacggcgcgctgcatgttttgcgttgtctgcgatccagacttgtcgcgaacgtcaagccactcttcagggatgaagtctagcccgacctgccagttcccacggaagcggccgccgacataccccttccctaccgggttcacgccttgctcgttcttcagcaaacgaggacgacgtggccctgccgggccgacaggggaggacatgcgcgccggggcggccacaatgttcgcgcccggcttaagccgacgtgttccgcgcttcgttgcgtatccgaacgtgtcgctgtcacgcatggcgctacgtagatcgctcatgcggttacgttctttgacggcctgctggttgcgctgccataaatccgggttgccgactggcgagcgctggataatcatcgcgaagaccgtcatggccgccatttgaacgacctcttcgtgatgttccacgacgccgtcagcccaatcggccacgcgcgacgcgaaggtggatccgttgcgcttcgccgccatgttacaccgccttaagccgtagtttgttcacgatcacgtattcgccgtccggcttcactggcttgtagtcgacgattgaataattgattccgccgatctcgatcgtctcgttgatgcccggcttccatggcgtaccgcccagggacgtcgcggccagcgtcgcctcgctttctcccgctggaacttcagcaagcccccaataacggcgatcgacggaagtgatcacgccatagatcacggtggtggcccctccggggatcagaacttcattcccgtcgtcgtcgcggtcaaccgttgcaggcatgaccacacgcagacggccgccgaactccttcagcaagttaagcgcatcgcggcgcgcttcaatgtatgttctttccgtcatggttagttcctctgtaacttcatcattgcgccgttggtgctgccgcacagccaaccgccgatcatcccctgcatgtaggccggggcgaagtcctcactgtataggctgttctggtcatactcgacgctgatcgcgccagtgatagcgaaggctttcttcttcgggccactcgacacggtggttacgtccacgccattctcggcggcgtcgcacacggcggtgtaaacgaaggtgacaacctgctggggaacgtcgtattcgagacaattgtaatcatcgcagataacgcgcggccagatgtcagtctgcgccggatctgctttctcgccacaccacggaagcgaccacagccacaggttaatctgtcgtagcccctgcgccagctcttcgtcttcgagggtgtacccgttcgctgccgcgaacgctttcaggtcttcaatgttgccgatcatgttctcgctccataaaaaaagggggccaatcggcccccatattaatcacaatgctagttattcgccaccagtaccgccgccagcaggtgccgggacaacggtcggcgtcaacttcatgatgatgccgagtgtctcgcggacgttgcgggtcggtgccacaggatcgtcggtgttgccaactggtttgcggtcggtttccccggtctcgatctcccagttctctttcttgaccaggtctttcagggtcggggtcttcttgccttcggtagcctggcggaaggccagcgtcgggcgcatacccttaagcgcgacagaatagttaaattcaccctgccaccagctttcaatattctcgccgcccagcttggccggatctgctgccatcttcaggccggagtgggtcagctggataccgtttgcagccaggccgacgatcgcggtgtccggcgcatgaatggccgcatcgccagaagtggcggtgctgatgccagaacttgccgcatcggatacgacgaacgaacgaccgaagccgtcggcgaagatcttcaggctacccagctcaaagaccagtttcgcggacttgaccgcttcacgcgcttcgaacttagcccactgagtgccggacatgaaccacgcgcgaatcaggtcagcctgatcgccgaagatggacgccgccagcgggaagtcctcaacggtcgggtaaagctcgcctgctttggtggtggtgtgctcgtcctgggtgtagatgccttggccgaacgcgttaatggccgctacgcctgcgcccatgccgacggtgatgaagcgcttgatcatcgcttcggaggcgatggtggcgatctccgctgctgcgcggtttacgtcggtctcgatcaggcgcatctgaccggaagtgatggctaccgggccgagacgaccagcggagttgatggaaccgcccaggatgcgggaaagaaccttcgcttcgaccttagtgttgatcggcgcgtgttcgttacgatcctgaatgatgccgtcgatgatcccgatggtggttttctccagggtctccttcagcacttcgccagtgccgatcagcatggtgccgttagatgcctggttgaacacgttcaggttttcggtaagaagctggacggtagtcccgatcaacttccgttggaagatagtgaagctcatggcgctttccttttttgtctgttaacggctggatgatacccgttgcaatagtttacggcaagtgaggcataaaaaaagcccctaccaacacggaaggggccgagcataaagagcaaaagaacacaggagtcgcgcaaacatgaaagcgcccgcctgttttaacagaacttattcgccagcgtcaatcgactgagcgatttgctccgcgcgtgacagctgcgcctgtcgcgggttgcctgcgtcgcggtcagggtcggtcgggatctgcgggttcggtgcctgatgcttgccagtgccggaggacgccggggccacacaaatcggcttgaacatcgggttcgcgcggaattcagcggccagatcggtgacggacatagccgacggcttgccgtccttcagtacgcgggtgatgaactcgccgccatcctcgccaccttccacggccagacgttcgcggaggactggcttgaacagctcagcgtagttcttgccgcccagctccatcgccagtttgtcgatctggctgttcgtgaagtcggtcttccgctgcttgccgaatccctcgatcttgccgttcagctcggcgatctggcgcttgtagtcctcttcgatggtcttgaagtctccgttcttcttcgccagttccagcgccgcgagacgtgcctgttcagctgcctgcgccttttcgttgttgatggtggtcagctgaccctgaacttcggttagctgctgctgcatggcctgaacgtccggcatgccttcgatattcatcacatagttgccagtatcgccaaccgctttatatgcggcctgctgttccggggtcagcgcgtcaaatgctgctttgttgataagatatttccacatagtgacagtctcctgtgttggtgtcgtcggtgatgttaatcgtcgtccgggatgcggtcaagtgcgcgaagctgtgccaggctgagatattcgcccgtgtcgctatacagttccgggacgctgatcttcccgtccttcagtagctggccgcgctcaacgccgaagacttcggtcagcgtggaaagcggctgctgctccacccactggccgtaattcattttagcgctgacctgcccgttcatgctcgcgcgcgtcttgctgtcgatgctgtcgatatcgatccccagctcgcgccagctcttcagcttgtaagtagacgtgctgcggcaattgaagtgcaagcggcccggcccggctccatacggtacgctgtgaccgatcggcgtgtgcttcttgtcccgcttgtacatgaggcggtcgcgaatgatgcacatcttcgacgtcttcccgtccagcgtggacagccattgctcggccttgatcagatgatcgttcgccttcccgatctcgtctcgcgcttcagcggccacgtgactaaccgccgaccgggtgacggttgccaggtggcgctcactggtcgccaggatgccgtcgcggtgtttggtgatggccgttccccggacgcgtcgcgtgatctggtcgtaggtctccccctgaagaatcccctgctgaacggcgttcccgatagtgcgggtcaaatcatcgcccagaacggtcgggatgtccttcaagagcataccctgaaacggccgggacatggcggccgcgtatacctgctccggcggtagcgccttcaggtcgacgaagtcgaagatcggcgtcgggatcagctggcgtaacatcttcagctgataggacgcttcaccctcggccagctcctgaagctcggcggccagctgcccccacgtcgtccggtagatctgcttgatggtcggcgcgatcgtggccttgatccgctccagacgcttgaccgtgtagttctcggcgctgatgccgtccttctccagtgcaacgagaagacgcccggagacgtcaacgtttagcttgcggagtagggcgatcatcttgttcgccacgccattcgagtagcgcgtgatgtaaaggcggtggcgcaccgcctccatcattagccgcgtgttggtggtagccattacgctgttttacccttcggtttgcgcttcgccggggaactcggtttcttcttcgagatcggcgtgttctgttctggatcctcttcgtcgtcctgctggtcgtccgggttatccagcgccatctgtgcctgtcgcgcggcggtgttaaacattagctgaacgtcttcggcgttgtccttcagatcctgctcgacttcttccaggtcggcgtcgttcgggatcagcccgatgcgctgctgccacgcgaggaagtcggtcattcgcatcatgccggactgcacggcggccatgtaggaagtcagttccgtcgggttcagcacggtctcttcgtagcgcttattgatgtgaacggatcccgcttcgccaccagtgaacagcgcggcgaactccatggcctgattaaacgccgcctcaacgttgccgacacattgcgacagaatgctgttgtcagtgcggtcgtctgcgcctgcctgcgtggccgtcttcgtggccccgttgcgctccaccagcttcgcgcccagcatagccagctgcttctcgcgcttctccaccagcgccgccgcctgggtgttcgggtcagcgaccagaatgttcgcggttggcgtgacttgcccgttcgtgctcagaatgatcgcttcgctgccacccatggtgatcccgtcgggattgtccttcttgaactgcggccccactccactgatgaacagcgtcggctgtccggcaatgaacgaactatcagaactatcggcgtcggcctgatatagcgcgatgttggtgttcgcaatgtccgccagcggtgccggatccacggtgctgtcgttcgtctcgctgccgaaccagctgaacgggaggcgatccaggtgtttaccgcgcgccctgattgggcgaagtttcggcacctccggcccctgtgacacgacctcactgttcatgatggacgccggaaggccgccagccccctgtaatgagtccgtccagagtcgggagtatgcgaggccatcaataatgcgtagttccagatagcgtaagacctgatagtgctcgaagccgtcatgctcgacgtcgtccaggtagcaaatgacgatcagcgtgtccttgccgttgctgcgtcgccagttgatgatctgctcaaagtcgaacatgcgcatggtgacgcggcccttgttcgcttcggtggtgactccgcctgtgtcttccggcgcgtcgaagtcggtcaggatcccgccacggccaaacgtcacgttatgaagcacacactggcgcacaagctgatccatgtccagcccttcgccgtccacgtcggtcgacaggtaggcgatattatccggcaaggtgtaggtcgctggcttgttgaaggcgataccgaccatacccatctgtgtccggtaggtcgcgttcaggaagtgcgcgcgcgtcttatacgcgttgtagcgcttgattgtccagttctccggcttcggcaaatagcgaacgcctgccttcttgacgaccgcctgcccggcggcacagtcggagatcgtccggtactccgtcacgaatcggttgtattccgggtgtttggtcgacacgctgccgaccattggaacgatgtttgattggctcatagttatcttgtccaggctgattgtacggctgatacggtgccattatgcacgaccgggaacttgaacacgacaggatatgttccggcgtcgttcatgtggtctttgccgccctctttgtcaggcttccctttgtcatcgtagatctgctgttccaggcattcgacgaactccgggcaacgcttctcgctaacgaacaaccgacggcggccttcggcgttgcagaacatcatgttcgcgctgatcaccctgtccttgaccgccgggttcgcctcgccgcaatagacatcataaccagcgtcgtagagcatggataaatcggacatgctggcgttcttgctgctggtgttcccgccgctggcgtccgggtagacctcgatcgggtgtggcttgctcacgtgcaagtagtttgcattcagccattcgataacgtccggcgtgtcgatcccgttgtggcgttcgttgacggcgtgaagctcttctttgccgtctgcgcccatgcgttcgacgtagacgacggtcgccatcttgttcacgttgaagtcctggcccacgatcagcgtctcgccggggatcacttccacgtcggtgtcgttcagcttgcggttgtagttcttatagacagtgccgcttttcaggttgacgaactggccgttcgcgtatgctgcgaagcgctgcgggtcgtagctggcgcgcaacgcgtccaggtagtcaggcggcaagaacgggttcgacgacgtgctggcctggatcatgagatagccagctttccggctgcgctctttgtccttcgcccagcggccatacaggaagttaaagccttccggggtgcaatacgccgccacgcggttcactggtctgtctgccgggaggaagtcaaaaggttcgtagtcggctggcatctggcgacaacgtccgattgcagcgcgccagacggccttcgctgcctctttcttcagggtgtcgatctcgtcacagtggatgcgcatcgcctcccagcctaccagacgcgccgggttatccattgagcgaaaaaggaagtcgccgatcccgctgtgcgacgtgaagatctccttgttgccgatcgtcttgtaccggatccccagctcagacaggatctgttcgatacgcggcacggcgatcagcttgcacaggtcgaaagtaggttccaggacggcgatggttgtccccgctccaccttcagcggagtccagcacggcggacacggccatggtctgactcttcccggttccgaagccagcgacgaaggcggggaacttgcaagatagttgcagaaagtcgttctgcggcggtgtcagcgtcaggtcgatgaactgcccggcgtctgattggattgtcgacataaaaaagcccctgtgtgttagacaggggcatgataacagaacgcgctaacgtgtcacacgtgcggccacagcacggccatagccacagtgacggcggaagagaagacgatccacagtgcaacgcacaggtaggcgaagttctccttcatcgtgtacttgtagcccctgtcacggcgaggccacttgtggatccgcgttgacgcgaagatggcggccacgaagaacgccagaacaccccacacgacccacggcgcaccgatagccatggacagcaccagcgccaggaacacgacgccagtcacgcgacccatgaccttaacggccagcttcatgtaagccagcgcgtcacggtgacgggcgaagaactgcatggccttgatcgaacggttcattcgccactcggagacccacagcacggcgatcgccagtacgtcgatgatgatggacacgcgaagggcgatccacagtgaataagtcaggtctgacatgtttgtgactccttaaaaaagccccggcgaaccggggcgaatgggttacttgtttttaatcgcggcaatgatagcagaatcttgacgcttgatgttatccacgatggcgtccacaacggcttcgcgcatttcgtcgctcaagtgaactttgatgtccatcggggcgatggcgaagtgctccgctttgatggttccaggctcgcccatgctgataacctggccgccgcattccatcgtgttgaccttaacgccccactgcttgaacttctccagctcgtccttggccttctcggcacgttctccgaactcgtccatttgcttgcgaatgatctcgatcgagcgaccgatcccggccaggctgctggacttcacgccagtgttgaacagtctggcgataatgtcagccaggcggcggcgttcgatgcgttcttgtgccgcctcgttaagcgcctcactgaacgctttgaacatcgattcatatccacaaggagagactccgttgttctcttccagcagtctgcggaggcgcatgatgaaatcatcacgatatttcagaatttcatcgcgctgcttgtctgcgcgctccagatctttcttcagctgcgcgacctcatccttaagccgtccgcactccagaaaccacgcttcgcggtcggtagcgctgctacacaggaacgagtcgatcccgtcgcgaatgtcatggtcggcaccctgaaggccgaactggacaagcgcccactgttgccagcgcttcagctcgtccgcgtctccctgatacttccttatcgtctcgccctggcgttcgttgcagctcttcagctcctgaatatccagttccaaccctctgcgctgaaggtcgtatgactgcgcggcgttgcgtagtgtgccgtgatcgctgattaattgcttgtgcttactggctaactgttcgacttcatgcgccagcagatcccgaagctctttgtcgccaatatggctaaccgggtagcaatgaaaatgcacgtccaggatggaacgcgccaccgtgcgccagttctccagctgaccggacgccagcgccctgtcttccttcagctcttcagcctcttcgctcaggcgacaaatgtgctcggcatgatgcttaatcgtcgactgatcgacggctgtcccggatttcatagcttcgaccagctgcttgtagttgttcagctcaaggttcacgttcgccagctgctgaagcagttcgtcgcggtgttctctcacccctttaaggttctcgccagcccgaacatgtaggcggtcaattgcagctcgctgaagctcgttattcggttcttcgtgacccagcacgttaacagaccacataacccactcggcaagtcgtgacgtgacacctttcaggcgattctccaggtctgcgcgatcatcgctggcgatcgcgtagctgttctttagccgctcgttttcgcccttaagatcgaccagttcgtgcgcctgtcgatccaaccgttcctgttgcaagcggttgcgagatcgttctttgtcgagttccctggtcagctcgacgatctgctgcgcgtcgttattcatgcgcacacacagcgcgcccaaggtgccgcctttaatgtagaaatgctgatcgctgctatatgatcgcgtttcctcatagatggttcgaatgacagccaggccattgtcgcaatgtgaatccagcaggccagaagccaagcggtcgaagggcgcgttcgctaacgcggtaaacttaagaatgttgctcatgttatttgctcctgttgggcggaattgcccgaacccaattattcacacttcggaatacatgtcaacactgtttaatcatcgccccaatcgacagcctcggcttcatccttcggctcggtgccttcaggctgctgcggccgctcgctgacaatcttcaggcggatcggcttcgtgtcgtcacccttcacgacgatctcagtgttgtcgcgataaccgaacgacgccttcagcaagaacgtggcgaatgtgctgttcgtggcaagtccgacaccgatcagtaagtcctcataaagctgtcgcgcctgcgtgtaagcgtcactaaattctttatgctctgctctccacctgtgaagcgttgttgtcgtgattccgaccgattcacagaatttaaccatcgacggcagatacttcgggatcacgcgaatgttgcttttgcctgcggtcgtgaagttatgcggaagcacttcatccaggtcgacgcggaagtgagaaagcagcgcttctggcatgtcttcggtatacatggaaggtcgccccgctttgttgcgttcgacgacgtggttcactggctcggtcatgttcgtgtcctctctgtttgggaagtccattctacatcatgaattcattttaccctcatacgtaagggggaagaataaaaacgcgcagatacaacgaagcgcttttttcttctcccctgtgcgtgagggaagtctgttgtctgttataaaacttgttttatatataaagccattaccgtctgacttccgaaatatctgcttatgaatcaatggtttaaaaactcggaaggaactcggacggaaggcgcggctaccgaaataagttaattgattcaatggcttgcgctggatggtacgttttcggacggcgcgaagcgtggttttaccgacttccgaaaattaaaactactgtataagtattgcttatgctcaataaatgaacgcgtttttgtggataacttttttgcaagtaattgaattaaagaagttaattaaacagcagtggggggagggggttaaattgtgtttatatactgtataaggccgaaaatttcggacggaatggcccggcttccgaacttaaacacataagcactattgacatcacgacaggccacgctcatgatgtgcggacgtctgcacaggaggaaaaacatgaacgacccacagaagccagcaatgaccgccgacgactggcgcgaactgctcggcaaccaggagagacagaacgaagcgaccgaagtgttgaacgcgccgttcacgcctgaagaagaggacgccgcatacgaccaggaactggccgacctgcaagcgtattacaatatcctgaatgccgaaccagccagcgcgccgcctgaaccgccgaagcagcaggactatgaacttactccgctatgggacggtagcacggtgaaggaagaagcgccgaagccgccagcgcctgaaccgaagaagaaggacgccgcacagcgacagcttgaactcatgcgtgaagtgaagcatgaaaacgagacgcagctgttaggcatggacttatcggcccagcgtgtcgaagtcgcgaagcgtctggcacaggagatcgccgacggaaaagtgattgacccggcgctgaaggactacgatccaggcgagtacgtcctgaacacgtccccggacttttacagcccggtgatcgagggactcctgaaccggaagaccatcaacgagattaacggcgacgccggggccgggaaaacgacactgcttgtccagatggcggttagccttgccactggtcgcccgttgttcaattgcttccgggtgacgcatccaggcgtgaccgtgttcttcaccgaagacccggacagcgtcgagatccaggtggctgcgtggtcgctgaagacaggaatcaaccttcgcgagtggatcaaggtgttcaaacgtccggccgatctcatggaaccgtcgaagctacgcatacagcgcgggcggatcatgaacttcgcgaacggtcgcccggtgaacatggtggtgttcgacagcaaaatgttccacctggcggcggccaataacaacggcgtcagcatggacgaaaacagcaacacggatcagcagctgatcaccacggccgggcatcgcttcgccgagtccctggactgcgccgggatcttcattccccacgtcagcaagggaatgctcatgtccggcaattacgacctggaatcgcgcggcggttcggcggcgaagggtgcggtctataagacattcagccttgtccgcgaacgccagcagattggcaagggcgcgaacgcacagttcaaggacacaggctatacggttttcaacgtcggcaaggcgcgccagggcggccttaaggggcgctttaagctcaaaggctatcaggtgccagtgttcagcgacgacgtcatgaaatcgaagcaggcgaagtatgaggcgcattttgcgccgggccaggagagcaaccgcccggacttcattcgaatcgacgacgcaagcaaggtctggctctttgaggatcaggtgtacgacatggacgccgggaaggatgaagaccactttgaaccggaagagaagcgggagagtcaccagtacacgccattacaggaagaggtttatcgctttatccgcgcccaggaacacggcacggccccttacaaggaaatcgtccacaggatcagcgcgtcgttcttcaggccggacggggaaccgtattcccgcgccagtgtccgcgatgcgctgtataaaatggccgagctgggacacgtgaacaaagaagtcaacccggaagagatccgcaacccgtattacaccgtaaaagacgcagttccgccccttatgggtagctgtgccgacatttaacaggagataaataacatgagtatcatcgcacacgtaacatcgatcccggcgctgctgaacggcaagttcaaaggcaagaagagcgacatgatccgcgagacgggcctgaacatgatgacaatcaacaagtatcaggaggactacaacctggaacgccacgcgattgtcaacggccagctaatgaccgtccgggccacttctacccctgtttttgcgatccccgtcaaggaaagcaaataaacactattgacaacattcggccccttatatatagttatcggacaggcagcaattaacgaaaacgaaatcactaaggggtcaataatgtctaagtcagctatcaaattactgaacgccgcaaacgaaatcttgtccgctctggatctgaccatcggcaaccctgccagctggatgaacaacgagcaagcacgtagccagttcaagaacgccgacctgctggcttgcctgatcattgactccgccgctaacgcgctgatctgcgaaaacgtcgatacgctggacgcgaacatgtacgacgacatgcagcaggccgttgaaggttacattcactctaacctggacacatggaatcaggcggaatggaaaaaaatcgaaagcctgtgcgacgttaaggcgctgctggctaaactgctcgacgccgttgaaggtcagcgcaagtacaacgcgatccaggctgcacacgctgaagcgctggaaatcgacagcatggtggacgaatctgtttttcaagctaccgtgttctgtgataacgccaatcttgaccacgttgttcgccagcactctgtcgacagcattcgcaaccagctgttaagcctgaaccgttacccggctcgctttatcgtcaagatgatggtcagcgttcgccgcctggctggcgaagcgcgggtgaaggcaaaggcgaactatcaggcgatgatgtcccgcccgttcgttactgacatcgatcacgaaattccgttttaacaacctggccccttcgggggccgtcactgaggatgaaacatgtacaagctaaccgaagcacaggcgatcgcgatccgcaatttcctgggtgaatattggacggacttcctgtcttccacggcaatgtccgaagaagaggcggatgagttatacgaagcgatcggcggggagaattaacaggatgattattgagcaaaaggtgattttcgtcaccgccgtcgccatcacccacaacgggaagcccgtcaccatgtgcgacaacgatggcaacgaagtgaaacagctggcgcttaaaccatggatgaagtttatcgccgttgacgcctctggcgaggtatacgcgttccagtatgctccgacgcttggcggtggcgtctggcgcgccggggagtctggcgggtgctgctgtatcggtgccatcgacacgtcactggctgtgaacgcatggaagaccatgctgatcgaaatcaaaccaattccgggagtgtaaaccatggaacactttgcaaaagtctttgaatcaaatggccgccaggtgctggtcatgaagtccaccacttcggacgacgaaccgaagctgtctatcatcatgcgtttttccgacggtaatgaaatggacttaggcccggtctttgactccgacgaagaactgaattctgtcttcgaactggtggatcaggaacgcgtcgacaacttcaccgcgccgttcattggtcttgaatcaacggcggaagtcatttccgccattgctcgcgggtgacggccatggaatccaaaatcatcaaatcactgttgctcgctgtcgagcattacgaactgatggccgacacgtcacggccacagctatcgaacgatctcggcttcaatgtgacggctatccggtcgcgctaccagtacgacgacaaagtcggataccagctcacacaggcgatcgacgtcatggcgcacagcttgcagacgctttccagcatggaactacgggatccgcgctgggttatccatgctgtgaaggatctggcaaacaaggaggtgatcaggaatggataggccaatcttaaccccggccgaggcggacgaactgcgcgaccacatgcgccagctgttccggcctaccgcgccgcttgttagccgtgtgcttcaggcggtgaacgagcgcacgaaggcggtcagttaccgggtgatcgtcgagtctggcgaccttgtgctgatagctcgcgcgcataaccgctttacggccgactaccgaagccgcaacgggatcacgctggacgccaacacagcgcgaacggcaatgatgcgcatacagcaggcgctggaagaacaggcgaacgcgctccggtatgcggccgggttagtcaatctgtaaatagtgcttgcattcattccgtgttccgaatatattaatcggacagggccacaatggccgaaacgaaaaagaggaacgcggaatgactacttcactgaaaaacaaagtccttaacttcgaacgcatcgctacagaaaacaccattatcgacatcactcgtcagctttgggaaggtaagcgcaccctgaaggccatcgccgctgaatgccgcatttttgaacagcagtcacaggacgactacagcaaggcagcgttcgccaggctggctgactgcaaaactcgcgttgacttctggaacgttctgaacactctgtaaccaacacagcccctacgggggccatcactgaggatcgagatatgatcaccattcaggccgcaattgacatggcaagcgaagaaggatttaccatcactaacgactacaagatcgccacgcgtggttgtcagcccaacaagcgcgcttttactgtcaggaacaaaaagacaggaatcaagagcatcgtgacacaggtgcacgccgggtctaagacgtggtttctcggagaggcgcgcggttcacgcgcacaaatgattattgaatccatgcgcgccatcaaagaagaactcaacgaaccatggaaatcatgatcgtttataggccacaaacatattcgtaaatagataaaaggattaagtcatgaaacgcattaccgccattgctatcgccgccgctgctgtcctgggttgctcttacgtcggttccgtcggcgcggccacctgccacgaagccattaaacgcatggacagccaggctaaacacttcatcattaaggacactacctggttcaccaaaacgcgcggccagatgatggacacctgcgagttttccggccagctgaagcgcgacggcatcaccgcgaaggagttcgaagaactgcgtcctgaactgctggccgtcattgccgatccggccatgcgcgccgggtacgcgtcgttagcctcacagctgatcgtcatggctaacaaagtgcttgatatcggctactacgggaaggaggtcgcgcggtgaatctgccgaagttcgcctgccagcacgttcgcccggtcaatgtccggccgggtgatctggtctggtactatggccgccttgtccgcgtagagacaatcgccgggcctgtcgttcgttgggacgacgtcggcacactgaaggggtcatggttcaccttcaagttcaccgaactgaaccacgtcgtgaagttcatgctgacagggaatgtccgttctgattgcctgttcttagcgccggactataccgatctatcacaattcacaggagtcgcattatgaaaactaccgtcctcccgaccttcagccagtttaagcctgcctgctgggatctcggagaccagccggacgtcgaacacggtcacgtaatccagtattgggtcactatcgtcaaccataagacaaaacaccgctacgttcgacagctgacctatgtcaatttctacgaaggcggctacaccgacgaagagatcgagaatcacgacatcaccacagaagacggcgaaccgtttttctatgttgggtgggttgaagagacggcgcgcgaagggtggggcgaatactatcttccgtacacgttgccggaatactccgagatcgtggcgaattgcccggtcttcgctcctgaacctgcggcgactgaagcatgaagatgctaaccacgtcacggcatagggtcgttatattccatgaccttcagttaatcatcccggcgtgggccaatcatgtagccgtcgacagcgacggctctgtttgggcctacgaagatccgcctgtcattgtcgacgactatgaatggcgacgcgtcactggcacgtatacggccgtgtgcgacgtcgaactggcgcacaatgaagactggcgaaaaatgttactttcatataaggatctcacagcatgacacagcaacttaatcccgccactggcttctcgctggtattcaattataactacagctctgatgcggagatccttcgcgggtcaaacgttccgcctgtcggcgctatctgctcccacgtgatggatggcgaagtgaacggcatcccgactaatattgtccgctgggcttgcgtcacgccggagaaggacgcagtcctgaacctgatcttcgaagcgcctaagaccatgttccactcgcctggcaaccctgaagattatgctggcgctaatctggcgtcctataacgcgtctctgtgcgacaatatcgggacggggccgtggtataagggccacgtagagatcgccgctctgagtgaggtagaggtgacaggcgacggtcgcgccgatgcaatgacgctttccgtcgaaccagtgacggccgacactcttctacgcgacgccatgcatgctatcgaagacaaccgcgatcgatatggtgccgaagaccggaagcaggggatcgagatccagtacgacagcatagccgacgcggtaaactgcatgcgtcagttcgctggccgggtacactgcgcgctgtctgctcaagacatcataatgatcatgtgcgtcaagtcgctggccgaatcgcagaccgacgacagcctgaagtcgattcgccgcctgatcggttatgcggccattaagggcgaagcggaggcgaacaaggaatgaccgacgaacatttatcggagttgctagctagtgaaatagctgactttttcgccaacgttgaagagttgaccatgagtatcggaggcccggctaacatagccgccgcccagcagatgctgtttgacagggtgatgatggtcgttcttgaatctcgaaaataaaaaaggggccgaacggccccttcttcgttataccttcgccttccggcccactgcttcagcgtcctgccagctcatacccttcgccagcgcctggcgcgccagcgcacgacggacaaggcccggtaaaatcttgccgccctgcttgcggaaaaactccagctgaacgatcagttcgtcccaacgtccttgcgtcaccaggtcgtcgaagtctcccactttcttgtctggccggatcggatcttccccggcattgataaccagatccaccagcgcgtcgaagattggctgcgtgatggacttatgcgcccactcgttcaccttcttctctgcgtatgccacgtcctcgcggagaatggccagcgccgcctcgcgggtgatgttaattcgcggtgggttgcgtccggtgtggccgaatccccacgtgtagatcccgcgcttgcgctcgtcttcggtggcgaagtatggcgcgcttcggaattgctcccatgctgctgtaaattgcagcccgttgtcactcatgcgcatcgttcattactccttcgcggtctgacagtagtcgattgtattggatgttgcagcgttccccggcgatgtagtagcggtcagcttctgctgccatctcgttacccgcttgcactgactgattgaacaggtcggcgagcaaatcggcgagcgttccggcatcactgctaacaccgacagcggcggcgtgttgcttcgcgatggttgtggctctgtcgagttctcggcgcaaccgatcagcagcgttgcgagcactagcagcaccagaaagtgcttcattaatccggcgatttgttgcgaggtcatcggcgtctttctcccgctggcgtttggcggccagctctttgtcgagtgtttcacggcggtcgttctcctgttggatcccggccttcacgccggagttataacgcatttcaccgtatttttgtaggccataggtgccagcctgccatagcaaaaaggcggcaagcgccgccagtccatagaatttaaacttgctgatcatcacgtttagccctccgcaatctcatgctggggaagtgcttttccagcagtcgaagcgcgttgtcgatccccacgtagccgaggatacaggccacgatccagccaacgtccctgttaccgtcgacccatgccaaaaatggaacgtgtgccgcgatggtggtcagtaagaccgtgatccccttggcgaacatgccagccatgatcgcgttcgtccagatctgccgacgttcgtggccgagttggatgtggcgcaatgttgccatgacggcggccgcgatggggtaatccagatcggtcttgtatagtcgataggtctcgaccagaccgtgaaagaagtcgttcaaaagaaaatcccccgtatggttaacgggggataggataaatcagaatactctcacgcgtgaaattttaaatcgcgtagcactcgaagccgtgcttgtttgtgacctgccgccactcttcggcgatggttgccggggtgatttgcttcaggatccggcactccgcttttcccttttccatgtacaccgacaccagaagcagatagtcgacgccgttcgacacgtatcgatcgacatcgtcctggcgcaacgccgggagacgtccgccgcgcccttcagtcgatttgacttcgtacacgtgtacggtcttgttacgacggccaccacgcgaaagagtcagaatatcgccatcgccgaaggcatcctgtgcgatacctgtccgcgcgttgacgcccatggggatgatgatccgctgctggccgtgtacaccgttaagatacttcgccgccgcaatctcacccaggatcccaacgaggcgcttcttgaattccacgttcgtgcgccacgtgtgaacctgttcttcgcgggtcagcacgtgaacggcgttctggtattccatggcgttgattttgatgatggcgatcggtttcatttgcgcgcctcccggttagcgcggcgcgttcttttctccggcgtgtcgatatcgaagcgaaggacagcctgatcatattgcgactccgtcagccccatgatcatcatgacttcttcgcgggaatgggactggcacagcgtagccagtcggttcttgcgtcggtcagtccaccgaacgatcttcccggatctcgaccggatgtcgatcactttgctggtatcaatggtccgcccgtcggcggccgcttttaaaatggatgctgctaaactggtcattttcttcgtcctcttgtgcttgttcgatgtgcgccgccagatggttagcggctcgtttcagtctgctgttttctgcgtcacgtagacgctgattgcgcgtgtactgctgcgcccttgctacgtgtttgttgtacgtcttagccactcgtcaccccttcagatggttgtttgttccggtggccttcaatatgtcttttacctgctgcttcgtcaacgtcacgcccggcttgatcctcacataacggcgaagcatgcgttcatcggtggcgagtaccccacaaccgcgcgctgaaatagccacgccgtcaatggctccggggaacgccttcgacacggcgctgatgaattcatcaaggccgcaatccttcgcggccttccacacttgcgccttactgtgcatcgtccagcagtccgagatcacggcgcatctgtgactgatcgatgtacagcgtctcgacccctgcgcggcgcttcgtgcctttgatgatgaacatcacagtccctttattgttctcctttccaggcttcccggttccggcgttgacgaacgccagacggccggacgacttcccgtcgctaacgatgttaatgatgtgcgacgccaagtctacagccatcctgaaccagaccgtgctgttatcgttcgggagtaccacagccacaagcccgtctttgctgatggtcgaacacttcgctacccatggtttaatatcatcatacggcggattcaggaacatgcgattaaacacgctccagtcttgcgccaggctgttctcttccttgcaaaaatacgcgtcgcacttcgtcgacttctcacacgccgcaaggtcgatctcgaacgggccatacatgagatccagccattgataaacgtgttcaggtgtgcgccagttcgggcgaacgttgtccggcgtcttgctgcctttgaagcgacgacctgttaccttctgcggacggacggcggcatagtgcgacgttgcgacaagccccttcgtcgcccatacacgattgctcatgagttgccacggcgtcagccctttctcggccgcttcagcatgcaatgccgggttgtgctctccgccgaactgctgcgccgcgtcccatgcgtcgatcgttactttgtctgcttcgtctttcatttctcacccttaactgaaaatgtgcgatattcaatacggctaacgtggaacgtgttcccgttcagatacagcggcgcaaccttgcgaacggtcacgcgaatgtctggcttcccttcgtggctaatgatggccgggcctatctccggcatttcgacggtgatcattctcgtctcttcgcgggatgcaaaaacgttgtaatcttccagcggcataacgaatttattcatggtggttagcctcaaatactgcgcgcgcgaatcccggcggcgttgctgatcggacgttcttcacgttcttacttttcccgccctgtcgggtcactttgttaaagtccccggggactggttcgactggcttcttatccggcatcacgaagccgttaccacaccagatcccggttttcttcgtgtaagcgtcgttgttcgggtagaactccgggtaatacgggtgcggagtgttatccgggagatagccgccatagtcgcaagggttgaacacgtgatcaggtctgcgccagcgcttattcaggaagtttgtagccggattctctaacatccaggggatggatttataagggccatccataagctgggaacatgccgccaccagctcgacgaacttcgccagcttgatagcgtcggccatgtccttcttgcggttagggtaaagcgggtgcggtcggcggtcttcgacggccagatgtttgtcgtccgggtgatacagccaacgcgcgccggatgtggttaaaaaagtgcattcagcgaacgacgcaatgaacgccacattaccgccgaccagcttggcgacttcgtgagactggatcgcggtgcggttcgcgtggaaccacattccgacctgcttgatcccgtccggcgtagtggttacaccttcagggtgctgaccgtcgaacgtccagcattcatagccagcgtccagccatggcttcagcatgatgcgagtacggttaaatagaaatattgcctttttcactcttttgctccttcttccactctttgaaacaacgtttacatacaacgacattatcgatcacgtgccagcgtccagggcggtcgcctgcgttgaagtacgtcccacagccgaccattttcccgcgctcgcttcccttaatcatcttacgacatccaaccatttcgcccccttaactttgcgttaacgcctattaggatccattggtcgtgatgtagtggaagcataggacattgatgttcagcggagataatgaacggcttcccgtctgccctgaactggttggtcacgaagatcgggacgtttgttactattgaacgcagaatcattcccggcttcatatccttgcgcgctacgatgatcatgcttcacctaccagatagttagctaccgaccccatagtgataaacaggcgctttgaaacgattttaacgaagtgatctccgctgaataacccggccccgttcttgtccgccttcaggatcacgacgtgcatcactcggcggttattgcgcttgaacacgatagcgtcattcaggtggttaatcacgaccgcgtcgctataacgcgagttgatcatgatctcgtccttcggtgcggcgttgcctttgccgaccagattggcgacgtgtgagcggcccacctgctcggctacgatgtacgcgagcgaaggctgatcggcgataattaccggaatacgcccacgacttaacgcgttatgaatctgcgttgacatttcgacggcgttctttggttgatgggtaataggttcagacatttttgttactcctgtgttttgttgtaaatactgctgggaacctgatattacgaaccctgaatatattaatcaagtccttttgttcggctcgcctaaaaaatctatgacggccatcttcgaacacgcgaagccatagaccacggccgcgaacgctcccttgctgtccgccattcccagcgccgccttctgctccttactgacaggcgtcgacagcgctttggtctcgcgcttcatctcgatcatggcgtatggctcgccgttcttccctgggtgcaagatcatgatgtccggcacccctttgcggactcctttcgcctgctggcgcatgtagtatttttttccggccttcgccccgttctcgttcggcgtgtggaaccagtaaacgtctggataccagtgattgaaccacgtggcgaagtcgatcaggtggtcgtcctcgctgcgcgtgtccggcttgcgtccgtcgcctttcttcggcgggtcgtagtattcgcggatcataaatcgtctcccccttcgaagatcttccgggctatcacgtcccgctttttggtggtgcctatgcggcgatgtgtgacacgcttcggcaccgcgaacaagtgcgcctcggccagaatcttgttcactccccggcgcatcttcccgcgctgtgttgggcttgccaggtgcttgtcgacagccacgcgccattgctgcttcgcgcctgggttgtcgctgtccggccaaaatatttcataggcggtaaaatccggctcgcctttgttgccgagcgtgtacttgaacactatcccgccgccgcacttcgtcggctcgatctcaaacttgcgcacgtccacgaagtcgtccttcttgtacgctttgccgtcgatcgccttgttcgggtcgatcagcgtgttgccgcactccgagcacgtccgcgacacgatgtcgtttttcgccccgcatcccttctgaaccagcaccccgcgatcgttcttgaagtccgagcattcgcgataggtgaaccagtgactgcaacgctcgccaggctgcaacatgccgccatactccagcggttcgaagtcgtcggcgatatggctacaacggcgcgcatgcttcccgttggtgtggccgaacgggcaagtcttgaagctgccgctggcgacgtctttggcgtaaacgtattgctcaaggaacggcgagaagtagagatcagccaggtcgtccagcgcgccgccgtagtcaagaacaaggttatcggccttgtacatccccagcttgtcgatatggaacgccttaagcaatcgcatgccgcgcccgatcagctgggtcagtagcgtcaggctcccgatcttgcgcaagataactatggtatcccatggcgggacgttgtacccggttgtgagacatccgacttgaaagatcactttacacttaccgttgaatgcgtcgtccagcaggcggtcgcgttccttctgcggcgtgtcgtcggtgatgatcccccacgtgatccccggcggcatataggcggcggcttccttacagtgtttctttccggcgcacgtcactaacacggcgttcctgttagccgttcgctttatgacgtccagcatgatcagctgtgtcttcgtcccctgtccgagaatgtcggcttccatagccttcaaatcggcgtcgctgaattcgtcgtccccttcctcgccccggctaacgtagtggctgagatcgtaggtcagatcgtcgtcaatgtcgccgtatattgtcggaaccacagccccgacttcgacaaggaactcggtcgagatatcgcagacagcacgacgccagaagcctggaagctccatattctcctgaatgattggctgtgtcccacggtagtcggtgccagtgtatccaatgacgaccagctcgcgcccccatttttcacggcaacgcctttgcatttccctgatgatcagcgtgtaaccagtccggccgttctcgatcatcttcgccagcgtgttctcggcgcggtgctgcaattttgcgttttcgggatgctttgccgccgtctcgcatgtcagctgactttccacgatgtcgtcgacgtttacgtgttggcactcgtcgatcaggatgaagcgcgggacgaagttcttcagctgcttttccagcgcgttgaccactgtcttctcgctgccgcaaatgatcgggaaggtggtcgccttcatgcctaaactcgcgctgaacacgctgttctcaacgccgaagttacggatctccgccgcgttctgtttgatgatcccaccctgccgcgacaggacaagcgcgggcatgcgtagctgagttatgcggcgacacgccaggctgatcagggtcgtcttcccagctgacacggcggcctttacgatgaacgcccc

SEQ ID NO: 135 - DNA, 115192 bp, Unknown
  source: /note="Description of Unknown: 8M-7 Bacteriophage Sequence"
atgaaagtctctagagactatattaacaccacagatgttattgactttggtattgacaaacgatttttccgtctgccagtctctagcattctagctcaagagggaattacacctaatgctcctcagattgcaatcattaatgcgctggaagacccaagacaccgtttcgtaactgcgtgtgtatcacgtcgtgtaggtaagtcattcatcgcatatacacttgggttcttaaaacttctggaacccaatgtgaaggtgctggtagttgcacctaactactcactggctaacatcggttggtcacagattcgtggtcttattaagaaatatggattacagactgaacgtgagaacgctaaagataaagagattgaactagcgaatggttcactctttaagctggcttctgcggcgcaggctgactccgcagttggtcgttcgtatgacttcatcatttttgacgaagcagcgatttccgacgttggtggtgcagctttcgatattcagttgcgtcctactctagataagccaaactctaaagctctatttatctctactcctcgtggaggtaactggttcaaagagttctatgagaaaggatttaacgaaacgctacctaattgggtatctattcatggtacatatcgtgataacccacgcgctgacctgaacgatatcgaagaagcgcgtcgtactgttagtaaaaactattttcgtcaagaatatgaggctgatttctccgtattcgaaggtcagatctttgacaccttcaatgctatcgaacatgttaaagacctcaagggtatgcgtcacttctttaaagatgatgaggctttcgaaacattacttggtatcgacgttggttatcgtgaccctacagcagttcttactatcaagtatcactatgatactgatgtttattacgtattagaagagtatcagcaggctgaaaagactacagctcaacacgctgcttacatacagcactgtatagatcgttataacgttgatcgtatatttgtagactccgctgctgctcagttccgtcaggacttagcatatgaacatgaaatcgcttccgcacctgctaagaaatctgtcctagatggtctggcatgcctacaagcactgttccagcaaggtaagattatcgtagatgcttcatgtacctcattgatccacgccctagcgaactacaagtgggacttccaggaaggcgaagagaaattatcacgtgaaaaaccacgtcatgatgcaaactctcacctttgtgacgcactgcgttatggaatttactcaatttcccgggggaaataaataagtataggatgggatactactcagttggtatcccattcctgcattttaaaatcccctttacaaattcgatacgattatgtatactatattcattgatcgggagaacttctcccataatagaacgtaaacaagaaaaattaatgctctacataaggtgtaggagattctatgggtcgacaaaagctaacaataaaagatataaatattagattagctgatcgtggaatccaaattgtcggtgaatatgtaaaccaacgtacaaaaacagtatttaagtgccagagagcacacgtttgggaagcaacaccacattctatactccatatgaggagaggttgtccgcactgctccaataatacaatatcgttagatgaagttagtaacagaatatctaatatagggtataccctgttaagcagctatactaatgctaaaacaaaactacatctacgttgcaataatgggcatgactgtttcattaccctagatggattgactcaaggtaagagatgtccttattgttctcttaaatgggaaaatggcggattcctctatatcatgtcctcctgcagaggtactaaagtaggcataagcttgtaccctgagaagcggctgaacgaggttaaaagagaatctggattttctgacatatacttgttcaccgtgtattatctgccggatagagagactgctctagatttagagaaggaagttcacagaaaatattataataaaaactgtgggttttctaattttacaggaagcacggaattttttaatgttgctcctgaagatgtattaatctttctaagtagctttggattggaggagtatggccactaatactaagtacaaacgtgatgccatttccataatgagggatggtataaaatctaggtatagtaaggatggttgctgtgctatatgtggtagtagtgaagacctagaacttcatcactatcatactatatctcagctaataaaaaaatttgctaaagaactccagctggatttcactgatgagaatatcgtcctttcaaatagggaagcattctataagaaatatgagcatgagttagttagggacgtggtaacattgtgccagcaccatcaccaactattacataaggtgtacactaaggaacctccccttttttctgctaataagcagaaggcatgggttcttaaacaaaaggaaaagctacagaatcctcaagaaaagacacaagtcaagactgaaactaaatcaggattcgcaaggttcttataatgggtttaaaaagctggattactgaaaagctaaatccgggtcaacgtattataagagacatggaaccagttagtcatcgcactaaccgtaagccctttaccactggacaagcctacagtaagattgagattctcaaccgaactgctaacatggttatcgatagtgcggcggagtgttcttatactgtcggagataaatataatattgtcacgtacgctaatggcgtcaaggcaaagactctagacactctcttaaatgtacgacctaatccattcatggatataagcacattccgtagacttgtagtcactgacctactttttgagggttgtgcatacatctattgggatggcacagcactttaccatgtccctgctgcactaatgcaagtagaggcagatgccaataagtttatcaaaaaattcatatttaataaccagatagactatcgcgtagatgagattatctttataaaggataacagttacgtgtgtggcacaaactcccaaatttctggacaatctcgtgttgctacagttattgactctcttgagaagcgttctaaaatgcttaactttaaagagaagttcctcgataacggcactgtgattggtcttattcttgagacggatgaaatcctgaacaagaaattgcgtgagcgtaaacaagaagaattacaactcgattataatcctagtactggtcagtctactgtcctgattctagatggtggtatgaaagcaaaaccgtactcccaaatatcctcttttaaagatctagacttcaaggaagatatcgaaggatttaataaatccatctgtcttgcctttggtgttccgcaagtgttacttgatggtggtaataatgctaacattcgaccaaacatcgaattgttctattacatgactatcattcctatgctgaacaagctgactagttctcttactttcttctttggctacaaggttactcctaatactaaggaagtagctgcactgacgccagataaagaagctgaggctaaacatttaacctctttggttaataacggtatcatgactggtaacgaggctcgtgaagagcttaaccttgaacctttagatgatgagcagatgaataagattcgtattcctgctaacgttgctggttctgcaacaggtgtatctggtcaagaaggtggtagaccgcaaggcactgccgatggggataaagaatgattgattatgatggtctaaaggccatttttggtgaaaagctgccagaatctcatatcttctttgatacggttgcagcacacaagttcgttccaaactacgctactctacgtaaagagtttggaattaccactgcacataccaaccgcaaggtttggaataagttcaaagaagcatacgaagttactgctccggttgttccggctctagctttcacgaagaatctggctaaaactctatctgttgatactggtgcagcaattaatctgggcgtaacagttattggtggtactgcaccatatacttatgcttggactaaagacggttctccacttagtggtgttactggccctaatttcaacaaagctacagctgttgcagaagatgctggtacttacaaagttgttgtaacggatagtaaatctacttccattacttctaatgagtgtgtaacaactatcaaccctgcgccggaggcttaataaatgacaaatgctgctattgactataacaagttaaaatcagcaccggttcatttagacgcttacattaagtctattgatagcgaatccaaagagggtgttgtaaaaatccgtggattcgctaatacaattagtaaagatcgcgctggtgacgtaattcctgcttcggcatggaaaacgtctaatgcacttgctaactacatgaaaaacccgattattcttttcggccacgaccatcgtcgtccaatcggcaagtgtattgatcttaaccctactgaaatgggtctcgaaattgaatgcgagatttatgaaagttctgatccagctatcttctcactaattaaaaacggtgtactgaaaaccttcagtatcggattccgctgcctagacgcagaatgggatgaagctactgacatatttattattaaagatttagaactatacgaagtttcggtagtttctgtaccttgtaatcaggactcaacgttcaacctcgctaagagtatgaatggccacgattacactgaatggcgcaaatcttttactgcaacaagttctaaggctgtcccagctcaagaacgtaatctttctgaactagaaaaacttgcgatagctttaggctacgttaaagaataacggagaattatttaaaaatgactattgatattattaagctgaaggaagaacttggtctgggtgatctggctaaatctctggaaggtctgactgctgctcagaaagctgcggaagctaagcgtctgcgtgaagagcaggaagaaaaagaactgtctcgtatgaatgacctagtatctaaagctgttggtgaagaccgtaagcgtctggaagaggctctggatctggttaagaacctggacgagaagtctaagaagagcgcagaactgtttgcacagactgtagaaaagcagcaggaaaccatcgttggtcttcaggacgaaatcaagtctctgttggcagctcgtgaaggtcgttccttcgttggtgatagcgtagctaaagctctttatggcactcaggatgctttcgaagatgaagttgagaaactggttcttctgtcttatatgatggagaaagacgtattcgaaactgaacatggtaaggctcacgttaaagctgttaacggttcttcttccgtttccatgtctagcgaagcatacgaaactatcttctctacccgtattatccgtgacctgcagaaggaactggtagttggtgcactgttcgatgaactgccaatgtccagcaaaatccttactatgctcgttgaaccagaagctggtcgtgctacttgggtagatgcttccaaattcggtactgacgaaactgttggtgacgaagttaaaggtcaactgactgaaatcagcttcaaaacttacaagctggctgctaaatccttcatcactgatgaaactgaagaagatgcaatcttctccctgctgcctctgctgcgtaagcgtctgatcgaagcacacgctgtttctatcgaagaagctttcatgtccggtaatggtactggtcagcctaagggtctgctgaaactggctgctgatgatggtgctaaggttgttaccgaagctaaagctgacggttctgttctggtaactgctaagactatctccaagctgcgtcgtaaactgggccgtcatggtctgaaactgagcaaactggtactgatcgtatctatggatgcttactacgatctgctggaagatgaagaatggcaggatgttgcccaggttggtaacgatgctgttaaactgcaaggtcaggttggtcgtatttacggtctgccggttgtagtttctgagtatttcccagctaaagctacttccgcagagttcgcagttattgtttataaagataacttcgtaataccgcgtcagcgtgctgttactgttgaacgtgagcgccaagctggtaaacagcgtgatgcatactacgttactcagcgtgttaacctgcaacgttactttgcaaatggcgttgtatctggtgcttacgctgcatcttaatattgactactataccctctttttgagagggtataccatattacagttcattcatatggtatacttgtatgggggttactaaatggcaggaaaagcgataccttatgaaataagggaaaagcaaattctagaaatttgcgaaaaagaagggtatgtatataaaggggtggttggtaactttaagaattcagaatccaaaatactgatagaatgcactaaggatggtaattgttggactccacgcatacgtaattttgtcaatactggttcacgatgtccaaaatgttgtcaaacacgttttttgaaggcaaaagaaaataaagtagtctctatagaagatactcctactattttctatattcaaagattgactaacaatcatcactcagttctaaaatatggggtaacttccagaaatattgatgttcgggttaaagaacaatcacgagcatcagtctatacacacgaactactactatcagtacaactaccttctagacaggaggcatttatgttagaagccttagtaaaacaggctattccttctgggtttcttactcctgctcttctccctgatgggtatacagaaacctgtcttgaaaaatacctgccagagataaaacatatagtttataattatatgttttcctagtaacggctctttagccgaaagagagcttcggctctcttttttattggaaaaataaatgcaaatcatcactgttgaagactacagactatatgctaatgcaaagcgacctgatatggaaactcaggttgagatgatgattaaagctgccaatacgctgattacaagccttctaggtatggatgatgcagatgcggtagatcaattaatcactacaaaacctagccgtaagaaatattttctgagttctccctcagccacatctattacaaagatgactattaacgagaatgaaatagacccggaacagtttaaattgtaccctgatggtgttattcttcttaagtttaatcctcctgaaggatatatggatgtagaatatacccaaggtggtttcaatccaatgcctgaagatcttaagctggcagcatgcctattagtagaccactggcataagcaagattatcgtcaagccaagactattggtggggagacaattacgtttaatagtactaagtctggtattccagagcatattcgtacaatcgtcgaagtatataggagagtataatggctctttctgatctagctacacaaattattaaagagcagctagatactgctggacgatccgagaataataagaatactgttgtatatacagttgagactggtttgaaagatcctacaagagacggtacagttgcacaggtatctttcaagttctcaaagccagtgtcacaagacttattaaatgttaggacagcatctatactgaaggctgtctcttctaacttagatctttctggcgatttaggcgctctagagaatctgattcaagcaaccgcaggcaaacgttctgctgttggtaaaaaacgttctaccggtagagttcaggtaaattttggagatcctagagatactgaagatggctattctggtgcagtaacaggtgcttctggtcgttttgtatcaaatagcaacatgcgtgttattcttgaattagttgctaaggaatacttaattaaggatatgaaaaaagcaggggcaccattgaagttcagaactggtcgcttcgctaactccttaaagattaaagacgttatgctacgtgatgcagaaactagtaaaggtgctccagagctgaatgtgacgtataactatatggttcgtccttactctgtgttcaaccccgcagtttctacatatcgaagactttctatacgaccttaccctggcgctcgaaaccctcaaaaacttattggggaagcaatcgcaaaagctgcaagagacctgattcactctagatataaaatcaaggttaatcaaggaacctaataaatggatcacagaacaagtattgcacaagcagtggttgaccgaatcgccacacaaatggatggttcacaacctgatgagtatttcaataacctttatggaaacgtttctcgtcaaacttataaattcgaggaaatccgagaatttccttatgtggcagtccatatcggaactgaaactgggcagtatcttccctcgggccaacagtggatgtttttagaacttccgatactagtatatgataaagagaaggatggagatattcaatcttccctagaaaaactcgtagcggatataaaaaccgttattgacacaggtggaaatttagaatatactgttagtaaacctaatggatcgaccttcccatgtgaggcgactgatatgagcattacatcagttagtacagatgagggtctactggccccatatggtttagcagaaataaatgtaacagtgaggtatcagcctccacgcaggtcacttcgcagataagttacagattaggagaaaataattaaatgtctttacaactattacgtaatactcgaatcttcgtgtctacggttaagactggtcacaataagaccaacacgcaagagattctagttcaggatgatatttcttggggtcaggacagtaactcaacagatattactgttaacgaagctggtccgcgtcctactcgtggttctaaacgttttaacgattccttgaacgcggctgagtggagcttctccacctatatcctgccatacaaggataaaacctctaataaacagattgttcccgactatatgttgtggcacgctctttctagtggtaaagcattaaaccttgatggagacacaggtgcgcataataatgaagctaacttcatggttaactttaaagataactcttatcatgagttggctatgctgcacatctacattcttactgacaaagcatggagctatattgactcttgccagatcaaccaggcagaagttaacgttgatattgaggatattggtcgtgtaacttggtctggtaatggtaatcagctcatcccgttagatagccaaccatttgatccagatgcactaggtattgatgatgaaacctatatgactattcagggttcttatattaagaacaaactgactatcttgaaaattaaggatatggattctggtaaagcatatgatattcctattactggtggtactttcactattaataacaacatcacgtacctaaccccgaatattatgtcacgtgtaaatattccaatcggctcatttacaggtgcatttgaattaactggttctctaacagcataccttaacgataaagctcttggttctatggaactgtataaagatcttgtcaaaacccttaaggtagttaaccgcttcgaaattgctctagtacttggtggtgaatacgatgaagaacgtcctgcggctattctggtagctaaacaagcacacgttaatattcctactattgaaactgatgatgtacttggtacttcagtagagtttaaagctattccatctgatctggatgcgggtgatgaaggttacttaggcttctctagtaaatataccaaaacaactattaataacttgattgttaatggtgatggtgctactaatgctgtaaccgcaattactgttaaatctgctggtaatgctacttctgttcggactggacaaactcttcagctgagtgttgaagttaccccttcttctgcaaagaataaggatgttacttgggctatcaccagcggtgatgcagctactatcaatgcagcaggactattaacagcccatgctagtaaaacaggtgcggtaactgttgaagctacagctaaggatggttctggagttaaaggcactaaagttattactgtaacaggtggttaaataaatgtactactctctaatgcgagagtcaaaagttatagttgagtatgatggtagggcatttcattttgatgccctatcaaactatgatatacagacttcctacgaggaattcaagactcttcgtaggactgttcatcgtagaactaactatgcagactctattataaatgctcaaaccccctcttctatctctctagcagtaaatttcagtaatactcttacagaggctaacttctttgaatggttaggttttgatagaaaaggtaatactttcttactcccactatatagtaataatattgaacctactatgttcaatatctatatagtaaataaagataataactgtgtatattttgaaaactgctatgtatctacagtagatttttctttagataagaatataccaattcttaatgttggtattgagtctgggaaattctcagaagtatctacccatagagaagcagcttctattatacagggtgaagtaatgtcttatagcccagtaatagtttctaccaacagtaatgttttaccagctcttttatccgcttctttatcttttcaacagcaatgctcttggagagaagataagaatgtttttgatataaataaaatttataataataaaagagcttatgtaaatgaaatgaatgcttcggcaaccatttccctgtattacttaaaacgttttgcaggagatatggtttacaatatcgaaccagaaaccgatgtacctttaaatataagaaataataatatttctatagattttcctttagcacgtataacaaaacgcctacaattctcggatatatacagagttgaatgggatgtaatccctactgcagactctgatccggtaagaatcgacttctttggagaaataaagaaatgatcaatttaaaagatattacccttgaaactcgtactattgagctggcttacccaggtatgcctaacttcaagctgcaactgaactacatgtctcgtgctgcatctaagcgtgttatctcttccgctaagcgtgatgagtgggttaacggtactatgattcagattcaggacgatgataagtttattgaagctttcgttgatactgcaattgctggctggactggcttgacgattggagatgttgagaagctgatgcttatcgaaactgaagctgatcctactactgaagttccgtttagtcgcgataatgctatcatgcttatgcagaactctgctgcgtttgattcttggatcaaccagacagtgttccacttagacacttttcgtagctcaaaagcgtaagcagttactagatgctgttgccgattttgcagataaatgcattaaatcctcagcatctaaaatgacaaaacaacaatatttaatgctttgcgagtctctaggtattgaacctgatcctaaggcaatgcctgttgaactcgaagattttccacctattgtatctactagtatgaatatttataatagtcttattgactgtttcataccaggtgactttcctatctttataggaaaagacaaaagtgcattaggtgttttatttgatatctatgggattactgatcctatagagaaagagtttgttctacacatcatcaatatatttgattcgaaagctgtagatgcagctcgtaagagagccgagaagcatagtaaacctaatggtcgtaccccgaacattaaaccacatgctagatctcgagctcagtaaaagtttcctccaatgggcgttccacgatgaggcttggctctgggtgatttgcccagagccttttttattgggaaaaataaatgactgataagctaatacgagaactacttatagatgtaaagcagaaaggggcaacccgtactgcaaaatctattgagaacgtttccgatgcgttagaaaatgctgctgccgcttccgaactgactaatgagcagttaggaaaaatgcccaaaactctttactccattgagagggcagcggatagagcagctaaaagtctaactaaaatgcaggctagcagaggtatgatgggtatcaccaaatctatggatagtattggtgctaagttagatgaccttgctattgctatgattgaggtatccgataagctagagtctggatttacacacgttggtaaatctgttaaggcgatgggtaacgatgtagctgctgcaactgaaaaagttcaagatagattatatgatactaaccgagcactaggtaatactgctagaggctttaatgatacaactaccgctgcaggacgtgctagtcgtgcaattggtaatacttctggttcagcacgtggtgcaactcgtgactttgcagctatggctaaagtgggtggtggtttacctcttatgtacgctgctatcgcatctaacgtgttcgttctacaatctgcattcgaacaacttaagatgggtgaccagttaaaccgtcttgagaagtttggtactattgttggtactcaaacaggtactccggtacaaactctagctagatctctacaagaggctgctggttatgcaatctccttcgaagaagcaatgagacaagcatcctctgcttccgcatatggatttgatgctgaacaacttaataactttggtctagtagctcgtcgtgctgctgctgttcttggtgttgatatgactgatgcacttaaccgtgtaatcaagggtgtatccaaacaagaaatcgaacttctggacgaacttggtgttactattcgtcttaatgatgcttacgctgactacgttaaacagttaaatgctgctaacacaggtattacgtataacgtcaatagtctttccactttccaaaagcaacaagcatatgctaacgcagtaatcgctgaatctactaaacgtttcggctacttggatgacgtacttcgtgcaactccatgggaacagtttgctgctaatgctgatgctgccctgagaaaggttcaacaggctgctgctaagtatttagggcccgtaattgattctatcaacgcagtgttctatacttctcaagcatctatctcggcctctgctgctagagcacaggaagaaactaaccgtcagattgacccaactaacgttggtgctgtagctttaagtctttccgcttctgaggaaggatataataaagctcttgatatgtacaaagaatctctagaaaagcgtaataagttaaaagctgatctagataagcgtatgcagcaagcagatgcatctacagcaggggctattcgtttagttgctcaaggtgcaccggtaggattagctgcaggaggttttgaagtaggaggagttcgcataggatcttctgaagaaaaccagaaattcattgcagatactgctgcattagctctccaggtagagcgtcttgataaggaagtagaggattcaactggcaatcttaatgcatggaaatcggcataccaagctgctggtgctgcagcagccaaatctaatacagaattccagaagcaaattaacctacagaaagatgcaaatgacccggatgcggtttatgactttaactctgcaactctgaaaggattgacagaacagcagaaagcgtatgaccaagctaagaaaactgccagtgacttagctaacgatatccagaacattgctcagaatactaatactgcggctaaaactagtgcatccctatcagatacgattaagactattgagtctctttctgctggtacgggtaaaaatgctgatgagtatgttaagagcctgaacttagggtataatactcttagtgagatgaagactgcttcacaagctcttgctggttatgtaaaattaactggtaatgagactaagaatcagctagaagttcagcagaagattgccgaagtgtataaccagactaaggacaaagagaaagcacaggaagctggtagacgtctggaaatccaacagttagaagaacaggaagcagctcttaagcgtgtcctagaaactaacaagggtaataaagcaatcgaaggtgagatagctaagattcagctagaacgtatcaagatcactaaccagggtatggaagctcagaagaaagttaaggattatacggataagattcttggtgttgatcgtgaaattgctctcctgaataaccgtactatgacagatactcaatatcgtttagctcagttgaaccttgaactgactatcgagaaagaaaagtatgaatggtactccaaacaggttgataagcataaggaagctgaacaatcaagacgagctcaggcacaaattgaacgtgaaatctggaaattccgtcaggatcagcaaagggaaatggctgctggcagggaagaggagcaacaaaggaaatttaccgcaaatcctttaatgggagctgcggaacgtatcaaggagcaaatccagctattcgaagaccttaagcaaaaaactttagggaatgctgctgctcagttagagtataataaaaagctagcagaaactagagcccagctcgcagctttaagagtacagcgcgatgcagaaatgcagtcttctgtaggtgcggctgtaggggctacatatactcctactactggattaactggagaagataaaaacttcgcagatatgcagaatagaatggcgtcctatgaccaggctatttctaagctgtctgaactgaactccgaagcaactgctgtagcacaaagcatgggtaacctaactaatgctatgatccagttctctcaaggatctctggatactacctctctagtagcggctggtatgcaaactgtgtcttcaatgattcagtatagtgttggtcaacaggtaagtgctattgatcaggctattgcagcagagcaaaaacgtgacggtaaatccgaagcatctaaagctaagctcaagaaactggaagcggaaaaggttaagatccagcaggatgcagctaagaagcaaatcattattcagacggcagtagcggtgatgcaagcagcaacagctgttccctacccctggtctattcctcttatgattgccgcaggtgttgcaggtgcattgtctcttgcacaagcatcctctgcatctggtatgtcttctattggagactcgggtactgatacagctcaatacttgtctcttggagagcgccaaaagaacgtggacgtttctatgtcggctaacgcaggagaactttcttatattagaggagatcaagggattggtaatgcgaactctttcgtacctcgtgcagaaggtggtaatatgtaccctggagttagttaccagatgggtgagcatggtaccgaagtaatcactcctatggttccgatgaaggctactcctactgatgaactcaaaggatcttcaaagagtacatcgggtagacctattgtgctgaacatcagtacgatggatgcagctagcttccgagactttgcttcgagtaacagtgctgctttcagggatgccgtggaacaggctcttaatgagaatggaaccaccctgaaatcacttggtaattcttaatactggaggaggactttatgtcctccttttctttatggaaaaataaaaatttcttgataaaattttccaatcctattataatattgttattaagaggagaaattaactatgagactaccagacccatacacgaacccagagctatcagggttaggttttgaaagcgttaacttagtagacaatgaccctatgattcgtgatgaattacccaatggtaaagttagggaggttaaggtgtctgctcaatattggggtattaatatctcttatccagaattattcccagatgaatttgctaaattagactcattcatcctagattataaaagaacaggtagctatattgatgtgttattaccacaatatgaggctttccgagttcgtggtgatactagtgctgtaaatattcctgctggacaaaaaggttcaatagttattatggacactaaaggcacacttcgtggactgcctaaaccaggcgatttatttaagttgtccaatcatccaaaagtgtataaaatcacttctatcaacacagcaggaaatacttggaatataagtgtttatcctgatctattcattactactacgggtagtgagaaaccggtatttaatggtattctatttagaactaaattaatgaatggagacagcttcggctctacgttaaatagcaatggtacatatactggtatttcactttccttgagggaaagtctatgaagaaaattcttgacagtgcaagagagtatttaagaactaataataaaataaaaactgcatgccttattactcttgaattgccaagctctactggatcaagttctgcctacatatatcttacagattattttagagatgtaagatataatgggattctttatacatccggtaaggttaagtctataacaacacataaacaaaatagagatctttccattggtagtctttcttttactatcacaggtactgctgaggatgaagtattaaaactagtccaaaatggtgtatcattcctagatagatccatctcaatccatcaagcggttattgatgaagaaggtaacattcttcctgtggatccagacactaatggtcctttactttacttccgtggtaaaatcactggtggtggtattaaggataacattggtacttctggaattagcacatccactatcacatggaactgttcgaaccagttttacgactttgatagagtaaacggacgtttcacagatgatgctgaccataggggacttgagattgttgctggccaattagttccatctaatggtgctaagcgacctgagtatcaagaggactacggattcttccatgctaataaaagtatttctattctcgctaagtatcaggttcaggaagaacgttacaagttacagtctaagaaaaagttatttggtctttctagaagctatagcctaaagaaatactatgagactgtgactaaggaagttgacatcgattttaacttagcggctaagttccttccagtagtgtatggaactcagaaaatccctggaatccccgtatttgcggatactgagctgcataaccctaatatcgtatatatagtatacgccttctgtgagggtgagattgatggatttctagatttctactttggtgatgtaccaatgatctgtattgatcctaacgatagtaagtctcgtacttgctttggtactaagaaagtagctggagataccatgcaacgtattgcttctggtcaatcaagctctgaaccctctgttcatggacaggaatataggtataacgatggtaatggcgatatacgtatctggacttatcatggtaaagcagaccaatctgctgcggatgttctagttaacattgcaaaagagaaaggtttctacctacagaacatgaatgagaatggaccagaatactgggactctcgttataaactgttagatactgcttacgctattgttcgctttactattaatgaaaacagaacagaaattccagaagttagcgctgaagttcaaggtaagaagattaagatctatcattcagatggtagagtaactgctgataagactagcttaaatggtatctggcaaactctggactacctaacctctgacctctacggtgctaatattactattgatcagttccctctccagcaacttattcaagaagcagctatcctggatatcattgatgaatcctatcaggtttcttggcaaccctactggagatacgttggatggactgatgctgtaggagagaatagacaaatagttcaaatgaatactattctcgatacctctgagtcagtatttaaaaacgtgcagggattaatagagtcttatggcggtgctatcaacaacttatctggacagtatagaataactgttgagaagttctcaaacaccccattagagattgacttcttagatacctatggtgatctggagctatcagatactactggtagaaataagtttaactcagtacaggcctctatactagatcccgcattaagctggaaaactaactccattacattctttaactctatatttaaggagcaagataaagggttagataaaaaacttcagctttcttttgcaaacatcactaactactatactgcgcgtagctttgcagatagagaactgaaaaagtctcgttactcacgaactctcacattctcattaccataccatttcataggcattgagcctaacgatccgattgcttttacatatggtcgttatggttggaataagaaatacttcctagttgatgaggttgaaaactctagagaaggtaagattaatattacactgcaagagtatggtgaggatgtattcattaactccgagcaggttgataatagtggtaacgatatccctgatgttagtaataacgtactgcctcctagagactttatgtacacaccaacaccgggtggacaagtaggatctattggtaagaatggtgagctatcttggcttcctagcttaactaataacgttgtttattactccatcattcattctggacatgctgatccttatatcgtacagcaactagaaactaatccaaatctacgaatgatccaagaaattattggagaacctgctggtttagcagtctttgagattagagctgtagatattaatggtagacgaagttctcctgtaacactatcagtagaacttaactctgctaaaaacttaagcgtcgttagtaatttcagggttactaacacagcttcaggagatgcatcggagtttgtaggaccagacgttaagttggcctgggatagaattccagaagaagatatcattgatggaatcttctacactctcgaaatccacgataacctagatcgtttattaagaagtgtacgaattgaagatcagtatgtctacgattatctactgatatacaataaggcagactatgctcttcataacgaggatgctctaggtattaataggaagttacgcttccgtataagagcagaaggtgataatggcgagcaatctgtggattgggcatctatttaaatgatttcgaataatgcaccagccaagatggtcttaaatagtattatgactggatatactatggcgtatatccagcattctatctataccgactacgatgttatcggtagatcattctggcttaaacttggcgaagaagtggatagaagagatttcactggaatcgacactttctttgttatgatcaataacttaactccctcaactacctatcaggttcagggagcgttttatgactcaattattgactcagaacttttaaatgcaaaaattggtattaacctctctaatgaaactaactttaaaacaaaagagaagccaataattgttgcagcaaaatctgagtcagaacctgtggatgttggggtgggcgcaccgatagttgttgtggaaacaactggtgaagcaagctactgtactattgagttaaaaagtacagccactgaagacagtccatggactaaatattacattggggctttaggttctactattaaatttggtggagttcctatcggagactataagatcagaatatctggtcaagtaactatgcctgatggtgttacagttgattcttctggatactatgagtttcctaatattctaactgtagcctataactttgttcctcctactgcacctatcgatattgtttttaaagctgcacgaattgctgatggtaaagaacgatatgatgttagaattgagtgggactgggaacgtggtgctggtgctaacgttcgtgaattcttggttacttatataaactccgaggaatacgctaaaactggatgggcgaaagctcaaaagataaacgtgggtgctgctagagctgcaacaattatatcattcccgtggaaagttgggcatacttttaaggtatcatcaattgcctggggaccaaataaacaagatataacagagtcagctcctataacatttactctgaatgaagatactcctctagataatagttttgtcaatgagacgggtattgatgttaactatgcctttattaaaggcagcatgaaagatggggaaatctggagacaaacattcctaattgatgcagctactggtgctattaacattggtctgctagatggagaaggtaaagcacctatttctttcgaccctataaaccgtgttgttaacgttgatggtaaagtaatcactagagatattaatgctgcaaactttattatgactaacttgtctggtaaaaataatccagcaatttacactcaaggtaaatcctggggagataataactctggtatttggatgggtatggataatacctctgccaaagctaagttagacattggtaatgctacacaatggatacgttatgatggtactactctgcgtatttctagtggtgtagtaattggaacaccaaatggtgacgtagatattggaactggtttacaaggtaagcaaacagtatttgtttataagttagcaacatctctaccagctaaaccgctagaacaagattatccacctcctggttggtcaaaaactccacctaatcgtacagatatgacacaaaatatctatgctactacgggtacacttgatccagttactaacaaacttcttgaaggtactagctggtctgatgtggttcagtggagcggtactgaaggtactataggacatgatggacagcgtggtcctgggatgtactccatgggtattcctggattaggtggttgggatgatggacaggctaatgcattcttccaaaataactttggaaaacctccagttaaatacgatgtcttaacacaatttaacagtaatgctccacaaacagcatttacccgccaatggaacgggtctggatggattaaccctgcaatggttcttcatggcaatatgattgttaatggaactgttactgctgataagattgtggcaggaaatgccttcttatcacaaatcggtgttaatataatctacgatagaaatgctgcgttatcagggaaccctgaagcatactacaagatgaagatagacctaaatagtgggtatatccatataaggtaattataatgagtacagaaaaccgagttattgatattgttgttgatgagaaagtaccttatggtcttatcatgcagtttatggatgttgatgacagtgtatatccaccaacagaagttcctgttaacttaaccggatattcactccgaggaactattaaatctagtctagatgagaacgccgaggttctcgctaattttaaaactcatgttattgatgctgctcaaggtgctactgcaattaatctttccattgcagacactactaatattggtgaaaaagcatctaaagaacgtgataagtataacccaagacaacgttttgctggttattatgatatcctaatgactcgtgatgtaattggctctgaagtcaattctttccgtattatggaaggtaaagtatacatcagcgatggagtaactcaataatggcacttaaaactaaaattattgtacagcagattctgaacatagatgacactacaactactgctagtaaatatcctaagtacacagtagttttaggtacttctattagttctattactgctagcgaactaacagcggctgttgaggcctctgctgcttctgctgcggcagcaaaagattctgaaattgcagcaaaagaatctgaaataaatgctaaggactctgagaacctatctgcaaattatgctaactcttcagaagcttctgcaactcaatctgctacttctgctactgaagcggagagacaagctggtttatctaaagatagtgccgatgcctctgctatttctgttgaggaatccaaaggattccgtgattctgctgaacttgctgcacaaaatgctgaacagagtcgtctattagctgaacaagctaagaaggacgctgaagctgctaagactgctgctgctacttctgagcaaaatgctgctacatctgctactgaatctaccaatcaggctattgctgctgctggttctgctacagaggcgggagaatacgctactactgcaaaagactccgagatagctgctaagacttcagaacttaatgctaagaattctgggaatgaatctgctatttctgctgaagcttctgaagcttctgcttctcagtctgctatttctgcttctcaatctgctgcatccgctactaaggctgcagaatcatcagcagcagcaaaaattagtgaaactactgctatagaatcatcagctgcagcaaaaactagtgagactaacacaaaaactagtgagaccaatgcggcagcatatgcagcagcagcaaaaactagcgagactaatgctgctgattccgctgcctctgcttctgactccaaaggattcagggatgaagcagaagcattcgctacacaagcctccacctcagcattagcagcaaaaaactcagaaactagtacaaagactagcgaaagtaactcaaaagctagtgaagacgccgctaagctagctcagcagggtgcatcagatagcgcgaacacagctacgcaagcggtgaccacaaccaaaggatacagagacgaagcagagggatttaaaaataccgccactactgctgcaacgacagcggcagacaaggccctggaggccgctggtagtgctacaatggcaggagaaaaagcaattgcagctaccaatgcagctgacagagcggaaatagcagctgcatcggcagaacaggttacgcaagcgtcgttgaagaaggatcagaaccttaaagaccttactgataaagttgctgcaaggaaggaacttcaaattcaagcggtagtgagcaaggactctaataatgtgggtgattataactcattcactagtcccaatgtatcatatgaacttagactggctaatgatggcggttggcgtgttgcaagaaatagtgataatgctacatcggctcttcctattggtgctggtggcactggtgctgaaaatgttgatcaagctagagttaacctgcaagtaaaccgggttgtgcaaactgacacattcacgcttctttgtgctcctgataatactaggttagttgttgctaacaataacgaggtagggtttcaaaacgcaagtggttttaacatcgcactaccaatttctagcggtggcacgggcgcaacgaatgcagcaggtgcaagggctaacatagaattaggcgaagttaatacacctagctttgctacggttgctgctagcttatataacggattcaattctggtctgtttttatatgaggaatcacgatgcttctagaaacttaatttcttattcctctatttacaacgaacttcaatctagtgtagcgaaaacaataataaggactacaaactcaaccgccgataaaacagctttctaccaatttgacgaaaatggtcaatttagtgctcagaaaataaaaattggtgctaattatagttttacaatggaaggtggtgaacaaaacaatcttcaactttatgccggggctaatgttcctttggatgattgggctaactttactaggtataactggtataatgatatgtcattatccggggctgttagatctggttcagacaagattaaatgtcatcgcataagagtttatagtcctggaattgatggtaatgattttgatttctacccaacaggctatcataaagcgcgtgcatttaatgcaggcactaagggtaacactcatggttggggtattgtgcagtcagatagtggtaatgcaattccattcaattcagtgagtacaactaacaataacgcattattcagtccggtagtcgcgggaggcacttcaactccaaacggttataacatacgtttcgcaattggtatgttgtccccgggcgccgctggatggtccaggacaatactcaagctgctaggtgataacgataaacatagaggatttgaatttggcgtagatggagatattacctcatgggctcactcccctgggggcgcatggggaggtggttatgattttgcaaaaaacccaacatctgatcgtgacttaaagaaagaaattgtttacacagatggaaaggaaagttatgaccgtgttatgcagtggctgcctactatgtttaagtataagtggggtaatactcaaagatatggtttgattgctcaggacctttctaagatagatcttcaatatgtaaaacttgtatcaggggctcctatctttgaagatgttattggcgttgacgcggaaggtaacgaatacgttcatcaccaaatagaaacagaccgggcagacgatacacttgcaattgacagtaacgtcgttctggctgatatggcctgtgctatggtttacatgggtaatcaacttgaacaacaaagaaaagagctagacgaactgaaaaaacttgtgagcgagctcattacgccagataactcataatatatacgtaatacaaagaaaccccagtggataatccactggggtttattattatctgctgccagcaataacacctaagttaaacactgctaacatagctctaagagtagaatcttctgaattgctacatagttcgacaaaagcctcttcatcccactggattacattgccttcacgatctaccttaagaactacgttattcacatccggttctgctaccataacatgatgatacgtagcgggatgttcaaatgatcctatcatattaggatcagcaaaattacttacttcctgagcttccaaagccgccttctccacgatcagtctcctctagttcgtcaacgatttcaaaatgatgagttgagtagtgtggtagtactactagttgacaaagtctctcgaaattctccagagtttgcatttcagaaccgtagttaaacaggttcatcttaatagtaccacggtagtctgagtcgatcactcctgcggtatttgcgatcattagtttacgcttacctaaagagctgcgaggaactaccaaaccaaaccaacctcgcggaatttccaccgcgacaccggtgtcaatcataagggatttgcctggtgcaatagcacgtaaatctgctgcaaggttagtaccaaagaatgcacgcagatccatacctgcggcatcattagaaccaatctttggcatgcaatctggatgagttagtttaattttaatcattgtcctgcgatctccaaaatatctttcgtaaacttatctagtacgtcttgacccacagcagcaatagcatctatacaataggtcggtaaatcaaccagaatcaaatttcggaaaagcaactcctccgatgcatttagattctgtatatatttctgtttcccaggcagagggagttgatcaataatatccagaacattaccaaattcacggataatattataaccacgttttgcaccaatgccttcaacaccacggatgttatcacctagatctcccataattgctttcagagagataaattggtcaacatcatcaacgttatggtgctcatacatatcacgaagatgatactcacgacgtgtggtaaaggagaagcgagaaactcgatcagtcagtaaggtatcccagtcaccatcagtagagatcagccaaacgtgatcatataaatgaccaatgagcttaacaatataagctgccatatcgtctgcttctacaccacgaatagtgaaagttgggaatgtggtttcacacaactcgaaagcatcacgaagatactcaaagaactgctcatccagtgctttctcttcttctgtacgttgtgcatacttttcgtcacggttccctttgtaatcaggaagatgttctaaacggaatacagactttcctttatcgccgagaacgattgtagttctagctgaataggattttgctaaagattgaattgtagaaacataacttgaagcgaatggtttcttactattattatgtttgaagcggaagcctaagttagttccatcaacaatcattaggttgcgacgagaagccagctcagcttcttcctcttcaataaattttccccaggatttactcattatttaattaagtcctcaacagatgcgtgatgtaaccacggttcgaataacccgattacgatttccatgtctttcttatttaacaccatatgggtacgactcattaagttgtcaaccatcgggtctgagctatccaaagcaattaaccactgtcctctgtctttcttgaatattaaggctggtttggagttcatctgttccccttcacgggaacactgctgccaccacttctctagagtggattcaccaacgttaaataaattacttgatatgttatcatctttataccacttaacttcgaagcagtatttactaatgtgtccgctttgtggtggaaggtagatgtcacccttcagtccatggctctggccaaaagcaccagaacctggaacacgttcccactcaagacctgtacgttcacgtagtatatctcttacctgatattcaccgcgtttacctttctctctactatctacggccatgttttattctaagtaggaaaatccttctgcatcttttttgacagtaatcttatgggctaatggatgcgtatgcccatgagaaacaatgatagaattcagactatcttcctcatttaataattcaacgagagtatcaagtcctttcgtatcaataaaactaataacttcgtcaaggaacagaagattaatattaactttactaatagatgttaacagcattcgaatagctaacagagttgctaggttaattctactctgctgaccagtagagcagttctccatactggtgcggtttccatcattgaagattactacttgtaatttagtttcatcaagttcaaatccaagtgcgaacttaccaccagtcataatagaaagatatttattaattaattcctcaaatactttcacactatgttctagtttatatcctaccagatttttcaatgcggcgattagaatatcaagatcagcaacagcttctgatactccatccagtttgtacgttatctcagacatttctgcctcagctttctcaatctgttctaatttcgccttatattttgcattggctaattcgacatttgcattatgctctttggcaattgcaactttagaacggccatcagcgatttcctgttctaattgtcggatttgcacctgtaggatctgcacattgagttcttcaaaagaagcatcactcattgaatttttgaactcgtctctagctgctactgccttatccaaagcatccttagctctagtatacgcagcgtactcgagttgttctttctttaactgctccaatgtagcttcgagagattgtttctctttaaacagaggatcgtattctgctctagccatatccattgctttttgagcagcagttgtatcaaggtgagtaccacaagtaggacattcagtatttgaagcctcttgcttgaacttctgataacgtttcttgacttctcctgcacgtgaggtaacaatcgttaggtcacgcgtaacacttgagatctcttcagattggtcagtgggcgcagggaaatttttgaaaggctcgaaatattgttcggcaacttgtacagctttgtccaaattacgaagtttagtaatattagcctcttgtgacttggctaatgccgccttaattttcgattcagtaagttcttgtgctaatggttcttcatcaaactctggaacttcaactggctcttgtaaacttccgagattgccttttccgttgaggatcttcgtaattacggccatctggccttgcaagttacttaacgtacttgccacttctttacgatcagccttaatagtttctgacatctctttatactgttcctgattgaacagattaacaagaaaagctttacgtgtcgcatcagttgctttgaggaagtctagattggaacctacagattgatagatcagtttagtgaatgtttggaagtcaccacccataatctcttcaatcatcttatacgtttgagttgctgtgtgtccactgatatcttctccattcttaatcagtgtaaccttagcagttgatttaactactttatgcaactcatactcatcttcatctttcgagaagtaagcgtgcatatcgtactctttcttcggagaaccccaagagaatagggcgtccttcttgataccacgtgagttcttgttatagaacaattcctcgataacagtagcaatagtggacttccctagaccgtttcctccgattaactgagtaactggattcttatcgaaatgaattacgatatccttaccgtaagacataacgttgctgaattttagtgtcttaattataatctttgacatatttagcagctctagccaagattctatcaatgtcgtcttgagacagcttttcaacttcacgaaagtaaagctcaagctcgcctaacatatcaagatcaacaagatttaacttagcatctttagtaactcgatggttaatctttttatctaagagatcggaatctttaatagactttaactgaacgacgtcaccagtgacttcataaattacacggtcatagtcactaggctccatttcctcaccaactccgattgttttacgaatcagttgtggtaagtcaccaagttcaatccattctacttttaatgtgtcggtatcaatgataaaacaaccatttgtaccttttgttcgttctctatggaacgatgtagttaatggagagcctggataaagaagtctagtagaaccaacagtttgactattagtataagaatgtaaatcgccagcaattacagtgtcataacagttatacctcgttagatcaatctctggttttacatgcggagggatttcaccacgaacatgcgtgaaacatagttttgattcagatggtttccactttggtttgtagatttcatcataagggataatatcaaattcaggagaacgatatggtttagtaatgacttcccaatttccgtttgttactttattaataactcctgcataatgatacagacatgaaatagttttagttaacatttcatgattccctgtgaagatcttgcctggatggtcaagtcttgacatgaactgttcaagaagttctatttcttccgacgatgggtcggcaacatcaagaatatcaccaccagcaatatgcagatcacagttatgattatggaatatgtcatttaaccgttctcctagcatcaggaagcgacgcttctgccattcctttggaactttatcttgtcctaatttgatatgatgatcagcactaaatagtattctcataagttaaaaagaaagggagccgtagctccccttggtttattagtcgtccagatcgctagcagcttcagcatcgatgcctttctgagaaccagcatcaccaccagacttagcatcaccgccgtcttgcttctcacgaccttccatgaaggcaagaatagcttctttctgctcttcgtaggacggaaccgggtaggtttcttccagagaaggaactttttcaaacttgatgaactcaccagtatcatcacacatagcttcaccgagaatatcagcatctgcggcgtgcagtttagcttctgcgctagtaggatctttcagagccatctggaactgcattgctgcgatctgctgtacatcgtactcagtatcgaagcctttacctttcttctcgatagaaatatcgatatcgaacgggtcggacagtttcagctgcttcatgatagactggatgcctttcaggatagtagctttaacttccataactttcagtttgttatcggaacggtcgataacgaaagcaatgtagtttttcttcggtttcagcggaacacgattaccatctttgtccagctctttctcgaagaagcccatttcgtgaatcgggtcagctttaccgcgaacgaagctctctttagtacggttgaaacgcaggcactcaaacggagctgcattaccatctttgttagtcagccagtagacataacgtggaagaacaccagaaacgatacgaacacgagttacaccgttgttgaatttcaggaagtcgattttatcgttagaaccaccagtagtttcgccccaagacttagccatattttatttcctctttaaagattatcttcgatttattgattgcaattagtgggttagtgtcgattacagaacgtggtatccatacgggaacatattgcatgtccaaactcggatcgtttgtaaacttatattcggcataatttcgtagacttagaattcctagatattctgccagttgtctattagacaatttgtaagggttatcaacaatagttgattcattcaagatgaatgaagaaccgaccagtagttggtgagcatcaggctctgcaagcattctattaaatagcttgacaatcaggtcggagtttcctctagctaagaggtaaattctctcgtaatcaaagaatttcatttttgtctctcatcaatttatgtatatattatacattaaatcgggaggatttgacaagtacaatttttatttttctgcctcggactttcttatcaatccgaaactttctctctcaaatttatgtatatattatacaataattatgagcagttgccaaatgcaattttacttatctaagtcctctcgtacacatctataacctttaaatatttcctgtatggcatctgaaccaaactgttctatccttagttcatttaccctatcaactgctgtttctagcttttcatatggaaataatccaccataaactgtagaaccatctgacctacacacttgtacttgccatttcttcttaaccttattccacgtaactcctttataaccagatttactataagggttacggtttttcatattttccgaatgagaagaatcttttaagttactctatttattatcataaggtattctattatcgtggtctactttagtaggcatatagccttccatgtacaagaaggctaagcgatgggctttataagatttcctatctatacctatgattatatatccatctttatcaggacttccagcaatagccccaattttacctcctctgcccctggacaccttgttaataaagtggccagaatctggatcatatattagtaattcttttaatctttgttgagttatcatgtcaagttttaaatatttcttgtgctaatctcacagctttctccggggtcattgtgattactttccacgcattattgcgatacacggccatacgtccagaagcctgtcttaaaccagtacctcctttcataattaaatctacaacaatcggatctagttttccgtcaacaatacgttgaacgcgacctgctagctgctctatgagagattcattattaatgagacttcccattactaaacaagatagctcgttaagagaaataccttctgagaagatactctgagctgctgcaagtacacaaggtccgccctccgctacatctttctggattctcaatcgatcatccaaaggagttgcacctataatctcataggttgtaacaccacgttgtgcgagagcttctagtattgtttgaattagttctgttctatcacttacaaagagaaccttatgccccatagacacatataaatgagctagatttataatagtctctcgatattcaggatggttatacacatcgttagcacgtaatgcccacggtacgttctggtttcctgataactcaacaggcacggagtacctatggattgtgggtggaacagtgttattgacaggcggactaaagatcttatatccaaagaaatctttgaacataacttgtaggccatctttacgttttaacgtacccgataaaccaatcttgtagcgagcacacgagatctctaagaaattagtgaaagttgtagccacacagtggtgaacttcatcaactataacagtaccgaacaccttagaaagattattcgcatgtttgttcactgtttgtatattactgactacgattggtggatcaatattatacttcccagaacctataataccgggctcgaacccaaaccatttacgaacttctgcagcccacatttcacgaatggatgtgttagtgcagattaccagagttttctgaccaaacttatacgcaagagctagagctaagatagttttaccaaatccaggcttaccattgataatacaagtatcatcacactcttcatatataggaagctgatcttcttcacgtagcttgaactgaggttctggtatttctaccggagctaatgtgcgtttatcaactaattcgtattttactcccttagcatctagcaaatccagacgcgtaatgggaatccacttaatctctttagcaacaacaccactattcttatacataatagggtatttactagtcattgtctcgatgtggtaagtggtttgtttactacaataatcccagagttcatcatcgggcttgaaataggctttattagatataacaaccttcataattttattctaagtctaggaatttcaggctcctcttgatggacttgataaataacagggctattatttaccagaatatagcttatataagctggaacataggatagcacgaatggatatgggactttagccacatagcattgatactttccattataaattcttgcagaatgcagaactttagacgtgataacatcgtagaacgtagttttcttccagttaatgagatttccatcagaatctatgaactggctacgctttgacccaactaattgggacaacattgatattctaccacgaataggatagagcttataaggtaattctttccgcttctcaaataaggctaacctacgttgagagaatgtgccaggcaactccctgttatctagcacatatttattataccttgttgtaattacggaataatcaccttcctgctcaattgatacaaatgcccgtaaagcatatacgggcaatttgaaatcaagcacctaaaatccttttcacattatccagatctttacatacagcaataaacttatcatccttgtacttgctgtggtctggatgctctttatccattgcagctaacttcttatactcgaaatctgcatcgagtaatacacccttaacataacgagtatattcatcatcatcaatacaagcgattgatgggtgctgtttcttcatcttaccacaagagtagtcacgagaaccacctttctcagaatcagaatcaataccgattgggcagccagggatactaataccacgatccttctggatgttacgaatcagaatctcgttatactgatcaatcagatcttcacgtacaatagcaaccacggagtcgtgaaccaacatgacgatcttcatctcttttcctagacccagtgacaggatttcttcatcagcatcaatagcacctaacaacaggctatcagaagatgcagactgaatgattgcgttaaatccagaacggatttcttcaccctgaacaccacgatcttcggaatggatgttgtgcagacgacgcttacgaccaaagtgactatagatgaatccaaagttcttgatctgatcgtggcacttatcaatccaacgcttaagctgagggaactgaccgaagtaagtttcgatatagtccttagcatctgcaacggtacattcaacaaacggttcgcctgtcttagcagcctgttccagaagagcttcgttaacagaatgagctactttcgctgggccagaaccatacagaataccgaaggtaattgccttagcagcctgacgcagagctgggaatagctttttaacatcacgtggttcacaggtcagtttaaataccatgtgtgcgatgtttgagtggaagtcagggtatttatccggctcattcttcatgttgataaatacttgttgcatgtttctgtcaccagacagtacagcagcgtaataaacttccgcagttgttaagtcccatgcgattacacgatatccagggggagctactacacaacccttgataatagattcatcacgtggtaactgttgcaggtttagcttaccagaagaactcagacgaccagaagtagtcatgtgttcgtggaaaccggtacgaatgcaaccatctgcatcgatgctcagaagaatcttctcaacataagtagagatcagcttagtcagcttacgaatctctagcagagttttcgcaatcgggtgctgagtagccaattcattcagagcttctgcgtttgtagaatctgcacctgtatccgtcaatttacccgttggagtcagaccaacataatcaaacagaagaacacgaagttgcttaacagcgttcgggttaaacgcttcgttctgatctttctctagctgaacgacttctggataagtatacagcttttcacgagccttgttcaggttgtgagttaactgatactgagcttctttcaagcgatcaacagaaattggtacaccacgatcttcaacacgttgcaggaatacgcaaccaggcatcagaacatcatagtatagactgcgaagtttttcattcttctcaattttcggtaagaagaagttatgcagacgcagagtagcatcggtatcttttgcagcatatggccacataatatcaaaaggaatcagatcatagctgaaatcctcttttttgatcttatgtgccttgcaataatcatccttgaacttatccagttcaaagtcataatcgcccatgtcagtatacttcatagccagagatttcaagccgtgagtaccacgacgttcatcaagaacatagtgttgcaacatggtatcatgaagtctacgctctttatgtgctttctcgaaggacagtcctagatgataggagtaaaagtgcatatcgaacttcaagttatgaaaaacgatctgatgattcttgctatccagaattttctggagataatgtacagctacttcggtaatgctgtcagagtcaatatagacaccctgatactcttggtgagacatagaaacaccaagaagataaccatcacgagcatacagagctgaggtttcggagtcgaatgcgataggtccgataaccatattatacaccatcttgatgtattcttcagcttcatctggatcagtaataggacgataatcaccagcttttgcaatcttctcacgaccattaataatgtcatgaatactttcaacagttgcatcgaaaactggtttcatttcaggtttaaagtgtagctgagctggactaatacttgcaatccagttggcatagccgccatgctctacacgtttaccagtataatcaccgatacctttcttacctgcgaaatacaggaaaggttcagcaccaactagtacaacaaaatcgtaatcgttcggatcgaacgggttatctggagttccgattgtaatatgctttttcagcaaacggccagataacttctcgttacacatatggaatacatcaacttcctcaccataaagctggaagtgtttatcataacgagtgttatttagagctttatcaactactgcaattttcaaatttagtctccttttggtaagtaagtataacttcagtgtttcttctctaacttaccaatatattataccaaatctttgagcgattcggcaactaaaatttcaatacgttgagccaacatatcgatctcttctttatttaaatcacctgggtcttttccttctggaagaaggaagttaccaactacaggtgttaaacgtgtttttgtacgaattagcttcgctagtgcttgggcagccttattaccagaagcatcgttatctagcaagataactactactcttactccagcaataatgtaaggactaaacttatccgcaatgttatcagatgtaaactgatgtgtaccaaagcagcaagaagcataatctaccccattgtcttctagatttaacatatcaaagataccttcaactagaacaagaactggtgtattatatcgtacagggaaaatcggtggtgaaacttgttttggttttactaagtatttaggaggggcagaactgtttatagaacgtcccaggaataggatattgcgtccaacagcatctgttattgggaatacaattctgccttcccagtctgcttgatgttggaaagcaaaatatttcttcaaggtcttagaactgatacctcggaaatcaccttcgaaaaggtaagcagattcaggaattgcaagattcgtagatccattcctaatctctgaaatctttttacgtacttgtgacaatcttggggactgtctgtactgagtctcattaaaataatggtaaatgctcggtattcctctaccgaagccacagctcaagcaatgcataatacctgattcaggatcaatacgcaagcttgggtgtttatcatcatgatctggattgagacaacagatgaggatgtccccacctgtgtctttgtattcaatgcctttcagatcaagtagttctgttattctactcatatatcgctggcctgttcacctgttgaattttcagctttgtctttcttagcacgtttaggttgagctggtttatccttttcaataggaataacgaactcagcttccatttgcgcaatatcttccattgctaggttggtagtgttatccattcgcagagtttcccagttcatcttaggcataaacttcacactatcagaggaacgagtcttaacgaagtcaaacataatagcaccttgaccattatcagcttttgcagcattaagattagcagccatatctgcggaatcaagaatccctttagacatacgcgttctaccatcttggtcaatctggtaaggagcaacaccagccacgttatgtttctggcagatagatttgaaagacgaactaacaaccatctgttccttccagtcatacatatcaatggtctttgaatctggaagtcttgtttggttaatatagtctagaagggctacagtaaccttatcaccatacttagcaactagtttatttaattctacgtcaaccgtcgtaatagacagttcaggatcgtaaacgatgatcataggagtgtgaagttcatagctttcaaggagtttactttccatatcatagaagtcactcattttagccatagtgtattgcttaacgaagttatcgaaaagctcttcaccaccattaaacatcctagccctagttctggctaatctcaacagagcagcaccttcaagagtgttattacgcattgctaatgcagatactccagccaacatagccagattacgtctaaacacttcgtgctctttcatctcaattgagaaatatggagcaacgtctccattcaaatattgctgaacctgtatgtttgaacagataatggatttaccagtaccacgccaaccaccaagcagtaacgtttctgtgcgagctaaaccaatttgagcgtcgaactcattacaaataccaagagcgatcaagttcagtttggtatcttcttctctctggaaaatacgcattgtgtctgcgttgaatacctttccagtattcgttactttctcttctaattttaagtgaagggaggcaactcggttgagaatttctccctgatccagcattgttaaatcttgaagcacgtctgtttctagaagtttcaggaatagatcctgtgtatattcggcttctaggacttcaagcgcctgttccatgctcacttctggaatttgagtgttagctaagacgacaagagcttgagaaaggcgggcgttcctattggcctcaagcatcagtgcgtcaatggacggcattgcgttatatttcttataataattctggacggcttggtaaattgaggagaaagcgtcattaaaatgatctttatgcagttttgagaatgtttccaatgctatttgcttctgttcagaagcgagaagcatcttcaacactacagcttgcacgttaaacaaggtcattctcctttgcacgctttcgtgccttctaaatgcaaaaaaggggaaggagcatagccccctccccttaggtttaatttaccagattattcagcagccgcagcttttgcatccagtttagcacgcttagcggcaccatcatagtccttagcaaccagaccacgacgagacagcatagatttaacaccgcgctcagacttaccagttttctcagcgatctcagcaacagtcatgttagccagatccagaccttctaacagatcttcacgagttttagcacttgaagtttcctgtaccggcatagcagcgatacgaccttcacgaagcagactcagagctttaccacggatctgcttaatattgcgaccgaagtgagcagcgatagcttcaatagtagcaccagcaacaacctgattaacgaaatcagtttcttcatcaggagtgaaggaacgaacagcagcagctttttcggttggcttaacagaagcagtcatttccagactcaggatcttaccctgaacctgcttagcaccgaactgaccaccagctacagcagcagcgatttcagcgtaagtatactgacccgcatgagcgttcaggaaatcaaccagttcagcttcctgctcaggagtccacggggatttctgtacttcgttagctttctgtacttcgaaaccttctttacgcagcttagagccaacagagcgagcggtaacgtctttaccagtctcggtagccagttcagcagcgatagcagctacttgttcttgagagattacagcaacacccagagcagtggcttttgctttcagagactcggttacaccttctacgttccagttcagtttagacattattatttttctccaatagttctttaatcgacaggatttctatcccattcgtttcggctttcttataagatgaggaagaacgttttgattcatcctcacagattaggtatttgacgtctttggtaacggacttcttaaccgtataccctagactttctaaatagtttgttgcatccgttcgatttgcaaaatcttgcaaagatccggtaatacagaccgtgattccatttggttgggcaactaaatcatctgtaatgatgatatcagctttagtacctcgaataccagttgagaatttccatggtaattcaataacatccttgccttgtggggaatttagccaggttttgtaattttctccagccttgccgtcagccttcacatcgtggaagctagtgcaattttgggacagtttctttgctgcaacctctccaataagaggaattcctaaagaaccgagaactgaaccaaagtcaatgtctccgcgaaccttagtatttaactcgctaatcaacttagcggcaaccttgctacccacagctccgaccaaatcttcttcggtcaggtaaaacagttctgagatcttagtcagctccagcttctcaatagttttcgggccaaagccctttaacttcatttttgtgcagaagttctcgattaacttacttgattgcgctggacagttggacttatccctacagaataattgcccgttgacaagatctagcttagaaccacaagagggacattgtgttggaatttcgattttcatcaaatttcttccttatcaatttatataaatattatagcaagtatttaagcatttagcaactacaattttaactaactttgcttaccctcgccataactttctatccctcaactgaatgataatagtatatacctaagcggcgaaaatgtcaataaccactttataattccgacatggtaaacgggtagcaaagggttacgaattagtcgtatactcgctctactatacaagggattacaccaccagcacgaatcactcgaatctggcaaccgatctctaaatcgagagcgttaatataatcaacgttattaagagttgctttaacgattgtggcatcatcaataatcaccggttcgaaataaccaactggagttactttaccagaagcccctacttgccattcaactttaacaagtgtggtaatttcgccttcttcatcctctttaatagcaaatgcaccacgaggaaatttattagtccaaccttcacggaagaatttgttgttatcattaatacgaacaactttaccatccgtcggaatccacttaaagaaggaacgaacattaacaactgtcaagaagttctcattctctagccaaagcatatcttttaaataggcttctgtaataccgactgtttccgctgaacactggataccatatgcaacgaagattaaaccaccttcaccaatacgttgcatgaaatcatcgctgtctttcaggttaatagcacccgaagcgtagttacgtttgttctctacttctttagtaatgagaacttcaccagtgatttgagttggtactttttgggaaatagttttggggatgtttagcattttaacattatgcgttacatcattccctagaataccgttaccacgagttaacgcttgaacaaactcaccattaatatataatagagaaatcgcacaaccatctaacttatcagtttcaacctgaccaagtgggttgaatggagctttatcaccacgatcgtaatagactttctgcaaagaatacatacgatacaaatgagggatatcacctttcggtccgatttcttcctctagtgggaatcttttaatcagacgatcatattcttcgtcagagattaaagacataccttgataatatgcttcttgacagcgtttaataaattcttttacattagtcatttatttatatctctcatcaatttatacaaatattatatatgaaaactgagtcgaaagcaagtacatttataaagaaaaagccaagaactaggcattcttggctttgagttcttcagctcgtttctgtacttcatgtaaaacctcagattcgctaagaatctgtgtaaaagcgtagaatagctgtgatgttgtttctagggtgtaaggaaaagagaagccggatttcgttggaaaccactctccagtaatatcttggagccagtaacgaattcccatgtatagattcccacgaaattcagatacggttagtcttacttgttccccctccttctcccaaagcatgatggactggtcgtcaatgtgtccttcatagttttgatttacctgatcgctcatttacatatcccaaatacacaaaaagccccatataggggctaattggtttcttatcggcctactggagaagcacgatctaactctgactggaggctcgtcacacggcgaactttcgcaacaggaatgaaacggaagctatcgttagtacgagagaaaacgaggatttcatcttctttcggcttacggatgcgctcacgtttaatacgctcagccaggtatttatcctgagctggatcaaattccatcgtaccctgaaggtacgtggttcctttctgacgaagtttttcgtaatgaagataaaactcaccaaatttttcgcattgagcaataatttcagctttattcataactgtattccttgtgttggtggatttatctaagaattacttggtgatagctcggatagcttctgccagatgagcagctgctttaccggtcagcttgtcgatgattgcgtcgtccaggaagtccggtgctaagccagcatcagagaatgcagagcgaagatcggagtgagcctgagctttggaagtacgagaaccaccagaagctttttctccagtagatgcgcttgatttagaagtagagccagcagctttcttgatatacagacctgctttggtcagcttcatacgaaaaccgttcggagttacaccattttcctgagcaatttcgctaacaatttccatgctaacgcccggacgctcatcttctgggaattgctccatacgagcgacgtagtcggaagacattttttcgaacagttcatcagtccactgagttggagtagtcatatttttcgatttccttaattaagaattaaacagaatagttctttcaaactatgagaatattatatcaagaattacaagattaagcaactgaaatttttcagtaactgctacacatctagttcaacgatctcccaatcgtcggccagagcttcgtctagagttagctcacacacttcgtcactaggcattagtgacgtatcggagggcatccacacgtactggcgtacggtgttgctatctacgaagaatttcaggattactgtgtaatctttgttgttttcccaactagtccgctggagatattttacgtctccagcttttaacagatcagttaatttactcactgcgtcttcctttttctttatcaagtttcagggcagccttaacagcttcattaactaacgtgattacttcttcacgagtatatttgaaacctaaagccttaacatcgactcccagctcttgcagatgttttacagaagctaattcgtagttcatataatgaacgttctgttgtttaccttcgcttaacaaccaaacacgataagctcctaccggattagtcaatgctttcttaacttcaccgatacactgatagccaggaacccaaacaagctcaccaacttcaaattcttctgccattgcatcatctggaaccagcggtggattcaacggatcaacaatatcgttaattcgaagcagagcaccataacgttcaagaacagatttaaccatagctacagaacgatagttacgatcggcaatttcttcgaaagaatcaccagataaatactgttcaattacgtttgcgagctcaacaccttgaattagtgtgccacgcttctttttcttcatttccgcgacttgaacttggcgatcctgccattcttcaatcattcgttccattgttggattagaagaaactcccagcatttcacacgctgctttcttcgtaccaccattctctagatgttcgataaccttcttgaatacatcatcagagatttcgtggatttgcttttttctacgagaaccagccatttaaatactcctctctcaaatttatgaatctattatacagaaaaattcatcgtaaagcaaataaatttttagcttgggtagagttcagttttaaatatagccctcacagttctagcttcttctagtgagtcacattgttgatatttgcgaaggtttcccttttgcattagtacacaatatttgctacctcgcatataaatatttggttcccctaacttattatccttacgtacatcgatattgtgcatttgatcagacctattagagtcttctagattatcaatgaaattgcaatcctttactctatttttgtgatctatttcttctggaatgtagcctttattgtacaaaaataccaattgatgctcaccccaatgacgacgtttgaagccaatcctaatataccctttatgtttaccaccagcaaattgacctattagcctcttttgtgtggttttcttccatttaaggtgcccggtttctggatcgtactcaaatgcctctctaacttcctcttgagttatcatcttctttgataagttcccctaactctctataaatttgatctagttcaaatcctattcgtaatgatactcgtatcttcctctgctttaataaccatatagatacatctggaataccagctaacctgtgaggaaccacacgacatagtttctccgcagtatcgtaaacagaagttttacgttcttttacgggaaacttccttgtttcccactttttattcttcgctgtcatttctagcccccaattcagcaagagcttcctcatgcatctgacgttcttcatctgtcataaacttaactggaatcggcatacattcgatcttacagtaagttctgtaccagtccacaatcttttccgtatccagatctttaccgatacccatcatgccaagatacatacgagcatattttgggttagcgctctgacctgtcttaaggaagaaatccttcttcttattcttaagagcttcgataaacggtttgattgttacgtttgaacactttttaatatcttcccagaacatgtcgtgcatcttatggaagaatgcagctctatcgtttggtttatccttgatatactgttcaacgtgttccactgttacatctttaatagaatccagatgataatagcgaaccagaagtaacttggcttcataggcatctgcatgacgtggtgcacaatattcaggagttgagtgcaaaatagctttgattcgctcttctgtatactcttttcctgcaccttcgatagttccccagctttcgctgaaaatatcgatagttgcaccctgatcaagcagataataacgcaaagtactagtatagtttctagattccagctcacgacgacgtgcgtacagttgttgggctaactcaatccaaccttcgtcaatattatattgctcggaacccgcagaaaatccacttgtagacttatcaatgaagtaatagatattctgagcaccacggtcgcgcctgattgcttgaaaacgcatgtttggcgcttggtttgaggttctagtgattacgaatacgttatcaaaatagttaaagtcaacaccactcgttacagatggactacataataaacaatcaatctgttgatcaattagctcattagttgtataatccagaatacgtcggatatctacatcagacgtagagtttgagtgaatttctttaactaacgcaccagtattacgtcgtaatgccattcccttctcattcagttcatccgggccacagtcagatactaggattgatttctcccccatctctaaagatgtttgaagtgcaacccaaatactggattcatcagggaattcataagcatgagctttcgccagcattttacggtggtgattataaaatgcgactggtttatcaaaatcaatcaaagaaccataggcttcaatcgtttctgcactgatatcaccatcggataagataacagttttagcagtaataaggatatcacgaagaacctgaatacattcacgacggtttttaacaaccggagcgaataacagatcattcattactgcgtcacattcatcaataaagatcgtatcaatctgacccacaaagctcttgaacttatggatagagtgaatagttgaagacatacgatcaatggcaccacgtttgaagttcagcatatcaactgacttatcatactggccagcaccaaatttcttcgcgtttgaagatacaagtgccctagtattcgtgattgcaataaaattccctggaagaactcctgcatctagccacttagttactgctgtagttttacctgtaccaagacttgccttaacaaatgttaagtgtccttttgggggtacaatgttaattttcaggtatggaacttctggtggagaatctgtgtccagacgttttaatggtacaccttttaagttgggtggaatctcacgtttggagttatttacaaaggctttgagagcctgcttacgaccgttattaaagtaatcttgaatattacgactattatccttagttgcaatatattcagataaggctggtttaatctcacgttccaaccacgtaaaatcaacaccatcttctaacgctctgtgataaagttttgggataatacgcaggtacactccatcctcagcttcttctagttcgctgatggtttcttccactttatcagatgcagccttcttgcctttaatttggtcaagtaaggagtagaattcttctttgaactcacctctagttgactcaaagtcaactaggttattaggtagattcaccttcgaacccttaacatacacaagacgtggtttattctccgctttaaacggatcgactataccatcatcaaataagggatctgcgaaatagtgaagctgaacagaagaataataagctaagtcagcaatatcaaagccatacttttgcttactactgtcattgatagatgtaaataagaactttaactgtccctgcgttaccttgacattagattctagcattaagtgcattcggatacctggttttaatccagccgaagacgatgcatgggcaataaaccctgcatcaagaggaaacatatcctcactaatactattcaacatcttaataatatgacgtgccatgccaacaagattaaacttgtcatagccaccagtatctacaataccatccacgtccatagcaataatatgactaggattggatacgttaaagtttcccctggtacgacgcacattatcttttggagctaaacatttaccacgaatagctacaatatgcgggtctttggtaagacgacgcatgataggtaacatttcagcaaggttttgcgggtcaagttcttcaagtacatcaaatttgaagggcatggaagctggtttaccttctggatgctctttagagaatcgctttgcaaaagtgtaatcttccactttgatctctttccagatgccagtggctttatctctggaaaatcctgcgtgaccttgtaggattgagaacacaacaatactcctatgttggttattcggatatctttctttaggactattcaaaagaatagaacaactattactaccatttacacaaacattaatcatcatcaagcagtatgaataagttatcatacctcagtgctgcgctctcttaactcttatccagatcagaacctaggtcattggccgctaagccgattctgattgccctcactatcctattggtaggtggctactggacgtgtcaccattcgctgctcttttcgttcgcacccccatataaagctctgcctatataacgagctaaatatgcacggtttggatttacctttccgaattcagggtacgcagatcacttaattgataattaactaatgcagtataaacactagtaatagttaaaacaacccttaatggggcagcctaactgttccgtattgcggattgtaaacaagaaaaaactttttcataaagctctagcaacgtaccttatgcagctatttacgggtcatcgattgctctcgccgtaaatccattgtcagcttcactaagaaaaattagtaaaaattaatttttactaatgtctctcaattcaatataaatattatatcaacatttttgcacgagagcaaatgaaattttcccgacggtcctatctttggtcttgggcgcagagaaaaccgagccaaaatgactcggtaatctgagttgagaaggttaatcctctctatccgtcaggaatggtacaaccagttcaaagctcttgagcttagcaatagcttcttcaagaacttctgagctgtactcccaaaccccatcttctgctactaacagatacggagagctaccagttccaacatctctagcaatagccaaacctacaggatgaaatactcgatagttaagagctactagcagcccatatgcagaaagctggttccagtctagatcacagccaggatcatcctctggaacctcatctggatcatcatcctcttcttcctgcccataaatatacaccccattacattcatcggcaatacctgtgaatgggaatgtgaaatttagaagaggaacttccagccattgcgccagaagcacctcagcatgttctaccaattcagggtctacctgacgccaatattttcgttccattatttttccttatgcagttaaaccggggatctgataaccaaaatgacgaagtcttttgataccctcgttaatttcttctggagaataagaccaaccctccaactcattaacgtggaaagcaggggattccccagtatcatagtctacaattatgcgatgctgggcaggcatgaagattgtgtagttgagagcaaacactagacccataagatccagttctttccagtcaacgatctcctcaagatcttcggagataggcacactaataccaatgcaagcagcctcctgcaaaggcccacgatatgccaggaagatctcattattttcacaccagatcttcagcttattgatcacttcattttgcataccatgaggcagagaacgccagaagttgagcagaataggattgatttcttttggaccaaacatatttacaccttatagttttggagggttttacaaagttctagatctgggctaaattctagcatatagctaacagcttttaaatcttgaagatttatcccagtcctaccgttgattataaccgttggatactgatacatcatagcacccgcatcatcaagcacacaccaatgtttgagcttatgcttttcaacgaaacgaagaacagaattacctcgagataaaccacctccagtaaaatctgttgtaccaagaaaacgatcgatcaaaccgagtccggtcataatctgaacgttctccatttcatttcgtacagaaaaccatgaagataccccaacaatcattattggggatggcttaagaaagttctgaaaagcctggagtaatggcttgtaaacccaatcaccaccaaagaatagcttctcactatctggagcatgatggtgagagatgctcgaattgagcaccccatcaatatccaggaaaatcacaggagtattacttatttccaccagtagcatcccacgtccagactttaacttcatcagtaaaaggaactggaaccttcaattcacctttaccccacataacagataggaacagagaataaatggtaatcataccgattaggttgacaaaccatactagacctttccagatacccttaaaaatcttcttcaccatattctccctccttaataaggaactctttccattctgctgtatcctcatagataacgcagaaatcatcactcttccatgagaagtcatcagtagcaaatttgaaacggtagcaccaactaccgtctggccatactaaaagatcacacatgcttttctgggacataaatatttctctccataaaagcttcaacttgatcaataaagtgtttattaccaaaaacttcggcagctccagcacgccacacagtaacaccacgtttctcgtattcaagctgttcgtcatagcgaacctgtgggttaacgaccatcattttagtaccgcgacttaccgccgggaatacttcccagttaaagttgataacttggttgctacaacccaccacaataaccatgtcattgctagtaagagtatcaaacaggttaatctgacccatataccaaggagcagtctcaccaaagaatacaacgtttggtttaacccattcgtaatcctccggggcgatagcagtatagccaacatcttcaatgacttgttctctaccacgacggtagataacctctttcaggtagccgtgcacatgtaagatttcttcgcgagggataccagcacgttctagtagatcatcaacgttagttgtgaagtttttaacagcacccgctccataacgttggaaccattccgcaatacgcagatgcgcaatgttaggttctacattctgcatttcttgacgacgcatgttgtaaaactcatgggttttggtgtagaagtctttaccgtcttcatccgtaccccaaacccctgattcaccagtgtagcaacggaaaccattctggaaggcctgtaagttacacacttcttcgagatcatattcttcccaaagcggtttgccacttgcagtatctgttcggaatgcctgcactccgctatctacactaatacctgctccactaacaataattaatctgcgcatttcattttcctaagttgtttagaaagatcacctaaaagtttgccttcctcctcatgtcctgcctgtattagttgccaactaatagtaccgagtgtagttgcacaacaatcaaccccatcccgaaagccagattcccattgtgtcataagcatcacatctagatctgctttaatcccatccgtaaattcttgtggtacttttgccattcgttttctcctctcaaatttataaaacaattatacaaaatttttagcctgaaagcaaataaaataaaagccgggtcgactagcaacccggctgattatcttacttaagatttaagtgttttactctaccaagaacttctttttgttttccagaattgaaaggcctactgccaggagatcccaggtacccgcaaaccctacgtgtaacctctatttcttcagacccacaactcggacatacaaacccacgttcagaggcaacagattcacccatatacccacagttgaagcactcatcaatcggtatattaacaccaatataatggctacattctagccccttatccaccacatactcaagagctttgtggaactttttcatttgaggtagttccacgaatgatatattaccaccattagctattttggtaaaatgagcctcgtactcaaatttagtatctggagctaccttctctcttacatccaaatggtgactattagtaagatagcctttgcctgttaaccaagaatactctgggaacctacgttctagtaatttattaaaacgattacatagagactcactaggagtagcatacaagctaaacccaagattagtctcattagctttaacttcgcaacgattttttaggtgagtgagaacttcctccgtaaattcaatacagtccctatgagtctgtggtaaactaaacattatttggcacatctcatagaccccaatatacccaagagatacagaggatctaccctcaaaaataggccatacatattcttccccttctaaacgtacaccaaacccaccgtgcatataaagaataggggcttgtttagctttaactttcttcagtctgtttaagaagaagtcatgcgcttcaaaagcctcatccacatatttgtctagaatatcccagaaatcttcaaaaactccatctgcctcagcagcaaccatagatagattaatagacactacacccagattattacggccggcaatttccccagaaggaatagcggataaaaaactacgacaacccataggtgctttaaaatcaccagtaacagctacaactttctcgtaacttaaatagtcagggtacatacgggtagcagaacactcaagtgctagctgttttatatcgtagttaggatcgcctggatttttatttaacccttctttaactgagaatactagtttagggaagataggggttgactcagcagcacctaaacctttaatgcgattttggaggatggctttctgaatcatcctttcctcccactcctgacctaatccaaagccaagcgtaacaaaaggggtctgcccattagagttaaataatgaattagtttcatactctagagcttggaatgcatcataacactctttttcagtaagctcagtagcgtatacggcagcttttctttcatctttgagccaacgtagaccacgacccaggtgtttattgtaagactttctgacatatggtgctagaacctcatcgatgcgatcaatagaggtgccaccatactgagcaccagatacctgggcaataatctgagcagtgattgcacatgcagtagttatggatttaggagtttcaatatttgcattaccaattttagtaccattcttcagcatgccaccaaggtctactaagcaacagttagtgtacccctgcgccctgtaatccatatcatgaatgtgtatcttacctagattatgggcgtctaatagatgtttgggtaattcctgcgatactaaatatttgttgatttctccggccaataagtctctttgagtatggaacatctcactaggcttattagcattattatgctgtaagtccttatccgcagttagagtgagcagacctttacaattctcaattaattcattctctgtcattgattatttcctcgataaattttatagctacttttggttcaatattgaagaattccgtagcgccgtcaaaatctttgtactggcaattctgctctttaaagtagttatgggctaatttttctattcgaactgcactactatattccccaatttcaaatactttaattatttccaaatcaataaggtggctactagatctaatatgtagaagtctacgctctggattgttagatctacctattttaaccccatgtgaggggctatacataacatatatcctagtactttctaaatctctataactacagtaaggacaaccgttcccccttaatacagaccctggagtagcttcccacctatgccctgcaccacaaagaaaggcggtcttagtattcgcattactatactcacccactattctgatatttctggcagcaagacgatcatttatagtattaacactaagtttctgtttattagcagcacaagatgggcagccactacctctattaattatactattaagtgtagtagcccactcatgaccacaaacacacctaaatttagtatttatatcggcactatttttatagccgttcaacaatgtaatacctctgccctgtaatatagtattaattttatcaatatctagtttacggctactaatagagcaagtaggacacttggtctttccattcctaatagcgtcaaatttagctgtccattgatgaccgtattcgcactgatacgtatgcctatacctagaattttgatatggcttatccaccatagtaaaaccacgctcggctaggcatttatctacttcttcttgggttaattttttcggcattccacttctccacagaatttttacacctattatactaaacattatccactatgtcaattaaaattttctttcgccatctaatactgtaatatttcgcgtataaataaatgattatctagtatcatatttctacctttataagcaagtaaattttttatttaaaagcaatatcataggtttatttaaaattatacttgctttttgctgtaaaccttgttataatatatttgtaagttgataaacaagatctctttgttgatcctctgttagaagcgaagtacactataggagtgttatttatgggaaaaccgcgtcagaaaagagagaaccagcgtaatggttcaagaaagcgtggcaacaagtatgagagtaacgtaattcaagcagatttctctggtgattacgccaatccagttgctaaatccctagttggtaaaaaccgtgagcaaaaatcatatatcaatatgatcaagaacaacacagtgactgtgggtattggtgaaccaggtactggtaaaacctttatcccgtccgttcttgcagctcaggaactcgtagacattcactcagatattgagcaagtgatcctcgtgcgtccgaacgaacctctaggtaaatctcttggtatgctcccaggtgatctagcagaaaagctagagccttggttggaaccaatagccgatggcatgaaatgggcaatcggtgatcacgcctacaaaggatatgtcgaacgtcagaaaatcaaattcctggctatcgaacatgcccgtggccgaactttcaacaactcctatgttattgtcgatgaagctcagaatatctccgttgaagcaatgatctgtctcttgactcgtgtaggacaagattgtcgtttaattatctgtggggatatagctcagaaagacatcaagggtgattcaggtctagcacttcttatggaagtctatgagaagtacgaaaactctcctttctctatgatcgaactgatcgacaacgttcgctcaccagagtctaaagcattctacgatatctttaaggatatggggaaggtgtaatatgggaaacgtcgtacatctgcaccgcaaaactaagatccaccgtacttcattgagtgctgctaatatgattacgcgtaaggaaggggaagaaagtcctaagactaccctagcgtggaaaattgtagcctctaatccaaatcggcctttcaactataatgaactgagtacttctatagacattcttatggctaaggaaatacgacagaaactaactgatatgaccgataaacttaaatggtaagacagacgagcctgggtatgaaaatatccgggctctttttatccttatactgggacacttaaatggaaagacttatataccctaccaaggaagagctggagaaaaccttctttgtagatcttgaaacaggaatactaatgagaaggatgaaatccggcaaagtaaagatagctggaactataaccggaaactatatgattgtgtgctataactaccaaagatacatggcacatatcatatctttcattctagacaaaggataccagccagaaggtatagtagatcatagagatggtgatactttaaataaccgtcctgataatcttagggaagcgaataacacacaaaacatgtgtaatgccaaactaaggaaagataattcttctggctttaagaacgtatttaaagaaaggaataactggagagtacgtatcagggttaatggtaaggaatactctaagagaggattccctaccgcagaagaggctaacgaatacgctattaaatggcgagaagaactacatggcgatttcgctagacatgaataatgtaaaattgtacttgcaaaatgacccaaaacaaagtagaatatttcctaaatcctgataactacaaaaaggaaagccaaatgagccatcgcatcgaaaaagtaattaaacgtgacggtactgttcaggactttgctcctgaaaaactcaatgattgggctgcatgggcatgtaaagatactgacgtaagttggtctgccgtagttatggctgccctaaaaaatctacccaaaggtgttgtagactccgatacactccaagatgtgttaattaaagccgctgaaggtcttatcaaagacaacccagcatatgatactgtagcaaaggaattacgtcttgcgcagatgcgtaaacgcctatatgattccttcgaaccaccttctctgcgtttcttccacgatcatatgattcgtgttggcgcttgggaagacatgagtgcatggattagcgatgaccagtttgacgctctgaaccaagttattgatcatgagcgcgatcgtttattcaccagtggtgggctgaaacagttcttcgacaagtattcccgtcgtaatattgcaactggtgaaatttatgaaaccccgcagtttgcttacatgggtatggcaatggcgatgttatctcaacctaactggacaattctagatgcaatcgacctctacaatgcaatgtcgctccacaaaatcaacgttcctacgccgccactggttggcctgcgctctagtgaccgtggatttgctagttgctgtctcgtggattccactgacacgctggattcaatcgacacagccgagcacatcgtcttcaaaatggtcgcagccagagcgggaatcgggtatcatcttgaaagccgatcaattgctgatccggtgcgaaatggggcattcccgcattccggaaaactgccatattatcgacacattgaccgttcagtaaaagctaacactcagcaaacccgtggcggttctgctactgtgtcttatccatacttcgatcctgaaatcattcagttgatgcaggttaagcagcaacgtgctacagacgagaataaaatcgataagatggattactctctgagctttaacaaccttctattaaaacgttacctgaaaaacgaagatattacgctaatgtcctacttctacgcaccagaagttcatgaagcgttttatggcgaagatgaggctaagtttgaagaaatctacgtggcagcggagaaacgtgtggcttctcttacaaagatcgaccacgaaggaaaaacaattccagcagctcctagaatctctgcaaaagaaatcctagatacttggttacgtatccgtatggaaacaggacgtatgtatgctcatcacattggtgaatctaaccgtcatggtaacttccttgacccgattcgtatgaccaacctttgtgttgaaattactcagccaacccgtccattccatcacattacggaactgtacaaaactgcggatcaattagatgatatgcgtccagaagatattggtgaagtatctctgtgtaacttaggtggtgttgtacttggacgcatggaatctctggctgagtgggaaaaaacttgctacatcctactgaaattcgttgatacaattattgaaattcaggattatccgttcccaactatggaatatacggctaagaaacgtcgtaatgttggtattggcctgatgaacgcagcaggtgcaatggcagcagaaggtctggcttatgaaggtattgaagcacgtaactggattcaccgtgaggctgaaaaactgtcttacttcctgcataaagcctctgtacgcctagctaaagaacagggtgcatgtgagtggtttgatcgtactaaaccatctaaaggaattctggtaatcgacacgtacaagaaaactgttgatgaactggtaactgtaggtctagaaatggattgggaatctctgcgtgcagatattctgaaatatggtatgcgcaactctgttctgactgctcagatgccaggtgaaagttcctctgtactgctaggtgttactaactctatcgaaccgccccgtaagatcgtatctatcaagggtagtgcagtgaataaagtaattgcaattgctccaggtgcaactgattgggatacattaatgagttataaactggcttatgatgtagatcgtatcgagtggatcaaatgggtagcaactatgcagaaattcttcagtcagtctattagtactaatatgtactatgactacaccaagtttgagaatgaaatcattcctggtccagtagtagttcgtgatttcatgactgctgttaagtacggttggaaaacttggtactacgctaacttcaacactgaaaacggtggaggagctggcgaagaagcagcaggttgtgcatcaggtggctgtaacctgtaacaaaactaaggagatcttcgggtctcctttttctttgaaattttacttgctaatcgctaccagatttgctataatatctccattagttaaggagattagttttgataacacaagatgaattaaaaaggattctggagtataatccagatgaaggaacatttacttggttaaataaccaagaagtacacaataaagtaagaggactacctgctggttgtttaaaaccccactcagtagatcctaaccgaaaagacttagtaatacaaatcaatggtaagaagtatcctgcacaaaatattgctttcctgtacatgacaggaaacttacctaaagttatggttgatcatatagatggagattcactaaactataagtggactaatctaagagaagcagactggcagttaaatagtcaaaatagaaaaaccagtaaaaacaatatattgggtactaagaatattcggaagaaagggtctggatttcaagttagaaaatccattaacggaaaagaatacgtgaaaactcttccaactctcgaagaggcgatagagtatcgagattctttaatcctctctataaccaaagacccaacactacttagaaacacagataaataggagaactaatgacaactttacttaacttaaactgggatcataccaataaagatctatttctcggtgattctcttggtattgcagattatgtacgagtagctcatccagagctagaaaggctggcgttattagctcgctctcaattctggactgaaactgaaattagtcttgaagctgataaaaagcagtggggtaatctcccgcgtgatattcaggaaattaccctcctgaacttagcatggcaaacccaaacagattctttcattagtcgtgctcctgaggcagctattatgccacttgtaagccgtcctgaattggaaggtatgctcaagcagtggagctacttcgaagatctgcacagccgtgcgtatagtaatattattcgtaacgttctgactgatccagcagaatttattgattctgtaactaaaaaccaagaagcatttgcacgtatcgcagattctgttgaactgtttgatgaattgtatctgttaggtcagtatttccttgcagtacgtgatcatcgtggtgataatacttatccagaaactgagttccctgaagttaaacgtgaaactcaggctaagctgttagatgcttactttgcaatctacggtctggaagcaatgcagttctacgcatcctttgcatgtacctttgctctagcagagaacgatattctgcaaggtattgctaagaacctgcaattaatcgctaaagatgaagctctacatactcaaatgtctaaagctatcatccagattatgttccagcagtttgataaagatctggtagatgaagcattagctaaagcaccaacacaactcctaaaaactctgaaaactgagattgaatggggtcactttatctttaaaggccgtagtctgattggtttgaacgcagaactgcttgaagaatacctttactttgtaggacgtaacgcatttatgcacattggtgtagaatggccaagccacttacctgtaattactaagaaccctattccgtggatcatgaactggttggatactacatctttacaacctgctccgcaagagattcagattggcgcagcatatcgtgtaggtcaagtcacagaaacatctatggatactctgaaagatcttggcaacgaatttgagggtatgttctaatgatagcagcaatctatgcaactgggccgaatggggagttcggcctcaatggtaaactcccttggggttctttcaaagaagaactagatatcttctatgctactttggattctctagcacctgacaatattattgtaggagcaggaacttggttagccttccctgagactctgcaaaaaagaatactaggagattctgacctatttatttatgcaaatagaccactacctaactctgtaggatcagccacacgcataagtaatattggatacagtctgcctgatttcctcaaggaagaagtaactgtagtattaggaggagcaactctgcttcttgaaatgtacgtcaataatcatctagatatggcgtatgtatctactattaattcagttacaccattatctgctgatgtacatcttcaccatcatattactatgactaattcaacagcaactaggatggaatatgcagtagggcataatgcagacaaaagtttatcttttgtacaagaactggtgacttattaatgcgccaatatattgaaactggaaaacgtattattgaagagggtgtatgggtaacgaatcctagaacaggggttcgttgcctaaccattattgatgcagactttacctttaacgtaggagcaggagaactgccgctagtaactactcgtaaagcatttgctaaacaagcaataatggaaatgatcggatatctccgtgggtacgactcagcagcacaattccgcgctattggtgttaatacatggaatgctaatgcaaatgaaaatattgcctggctaggtaatccattccgtaaaggcgaggatgatatgggacgagtctatggtgttcaaggacgtcattggactaattctgatggtatggtatttgatcagttagccaaagtctatcataatttgaaaagagggattgacgatcgtggagaaattttaactttttggaaccctggggaatttcgtaaaggatgcctacgtccgtgtatgcatacccatcaattctctattttaggtgatacactatacctaaactctttccagaggtctaatgatttcttgctgggccaagtatttaatatggtacaatgctatgcacttctagctattatggcacagattacaggtcttaagccaggtattgctcgtcaaaagattatcaatcttcatatctatgaagatcagtataatgttctgatggagcacaagcaattcgatcgtgaaccttttgcacctcctactttagaaatcaatccaaatattagaactttggatgatgtattaacatgggtaagtaaggatgattttactgttcgtggctatgaacaccatcctgctattgcatatccatttacggtgtaacatatgttaattatactattatttgtcatattctttctaaaacattttatggccgattatccactccaaacaccatatatgctaagaaagacgcataaaatagggtggaaacttccattattaacccattcgctagtacatgctggattaacatttgcaattctaatcctattcacatcaccaggaatgtctatagctttagctattatggaattaattctacactttattatagattattggaaagcacaacgctgtaaatacgctataagcgatgctaagttttggatagttttaggatttgatcagttactgcattatctgacatacgccctaataatcttgattataatctaattcaaatagcccttcggggctattatatttaaatttcatttgcttactgagtgaaattcaaatataatatacttctaatttgacagaaggatttaataatgacagccatagtagcatttaaatataaagataaagtatacttagctggtgatcgtatgggttctaatggctatacgaaactgctggttaaaaatccgaaagtattcaaaatctctgatgatttgtacttcgggtacactagttccttctacatgggacaattactagagcatagctttactgtaccaccacgtttagcagatatttccgatgataaatatttatatacggaaatagtacctaaattacgtgatatgtttaaccagaaagattttggcgaaaagaaaaatgaaaaatatgctgaacctaatctgggacaatttattatgctctacaaaggaagaatctttattttccaatctaatgcttctattctagaagttgaatatgccggtgtaggctgtggaggagaagatgtactttccagtattcgtacaggtttagatattgcggattgtcgagccacagatttagatgtagatgatatatttgaaatcattgatctggcttttacgcattgtgcagattatatgtgtggtgtatcttctcaacatgatgttttagtaattggagaataaatatgtctattcttttatctgctttagaagcaaaacaaaatactattgctagcattaaaaaggaagtaattgacctagaatcacttattgccgtagagattgacaaagctattaaagataaagaatttaactgtcacatccagggattaactgaatactcagaaaacgctagaaatagcgtcatgcaaaaacttagcaaactaggttatgttgtagaagctaagtatgaacagcgtgaaggtttttggcttgaaattgattggagcaaataatgtcggttttccacatatatacagatggtgcatgtaaaggcaatcctggtttaggtgcgtggggattcgttgtctataatgataatgatgatcgtattggctctaaatctggcttcagccctaaaactactaataacgaaatggaacttactgcaattgttgaagttcttcgttggtctactaagaaagataatcgtccagtaattatctacactgattctgcttactgtaaaaatggtatggaaagctgggttttctcctggcagaagaaaggctggaagaaagctgatggagaagctcctcttaacctagagctgtggagagaagcattctcattactacaaaaatacataaacttccatgacaccacaccgaccttcgttaaagtcaaggggcactcaggtgatcctaaaaatgacgaggtagatgctctctgtaatacagttataacagaacaagagttagccgagatgtaactatgttaactcaagaaatcttaaagcaattgttggattatgatcccttatccggtatttttacgtggaaaactagaaatcccgacaaaggaggatttaataagcagtttgcgggtaaagtagctggaactaaaaaatctggatatataagaatccagattaatggaaaaccttatgatgcacataggttagccttcttatacatggaaggttacataccggaactaatagatcataaagatagagtaggaactaacaatgcatgggacaatcttagaaaatctacagacagtcaaaatgctgctaaccaacctatcaggtctactaatatttcagggtataagaatgtatcttgggataaagccagaaataagtggctagtaaatgtcatgaaggatggtaaaaccatatacggtggtagattctctgagttagaggatgcagtaaaagctgctaataatctacgtctatccttgtttggcaactttgctatttacgaagaatttacaaaataatttaaaaattcacttgcttaaagccctcgaatttagtataatattcgtattgaaagtgaggagggctttatgcgaatttacaactcaaattcattaggatttaaacctttgagaaaacgcgcacaatctccgcgtcagatcagaaaggcaaatattggtgagccagaaactaggcttccaccacctccggagcaacgtctagtttacctagatgaataattagccgaaagggaacgcaaagctcaagaagaaattgagcgcaagaaactgtgtactgctccagcctactccaaaggggcttatcagtatatctctacagccgaagaggccaaagatgcggggcgtaaaaaaatgaagattactgaatttaaaggtgcttatagtttcttatctaacttttatttatcaccaattactttcgaatacctaaatgaaatatggcatgctgatactgtagaacatgcttttcaggctatgaaatccgaccaaaaagatggtgtagctcatgtattacgctccctaagtgcaggagttgctaaacgtagaggacgtaaattaattctacgctctgactgggataaggtaaaagatgatgtaatgctagagcttttacggttaaagtttgcaatccctgatttgagagacaaactgttagcaacagaaaatgcaactttgattgaaggaaatacctggggagatacatattggggtgtttgccgaagcatcggggataatactttaggagttcttttgatgcaggtaaggtctgaaattaaaagaagcttacagttaataaattaaaaattcatttgctaaacgcttcaaaatttcgtataatatatctcataaattgataaacaaaaaggaaaacaaataatggctaagcagaaaaacgcaaaaactcaggcagctccggcagttaaaactttcgctcagaccgaagccaatcgtaaggctcgtctggaacggcatctgcgtaagcatcctactgatgctcaggctcagactgccctgaagtccccggccccgatccgtcagaagccgaaggctaagaactccactcgcgcaactgctaagcaggttgtgttcatcaagggtgaaggtcataagtctgtaccggtaactctgagctttaacggcggtgctgagatgttcgcccgcaacggtatggctctgaaagattacgaaaaagcagtcaatcagaagcgtaagccaatggctgacgtaatgcgtgaatcccgtggtcagttcggttccgttaaaccgaatatcttcggtgtagagtacagccgtgacaacgttcgcgctctgtgctatggtatcggtattaagtttaccggtgcttctgatcgtaaatccgctaaaccagctcgtaagcgtaaaacgaagtaatgattgatggggcgaaagccccatacactaactctttctctgattaattaaggatatttttatgttctctaagaaaccacgttccgttactgaaatcgttgcttcctctactactattactgatgaacttcaagctcgtattgaagccgatcagaaaactgctgctgaaattcaaaaacagcaggaagaacttgctctgaaactggctgaaaccaataagagcgaaaaatctgctcaaactattaaggaaaatatccttaaactgctgggcaagtaatttaaatcagggggcgaaagcccctcttatttggagaaactatgcgtaacttcgttgcaaagaatgattttaaccgtgctagcactcacaagtctgctagagactacactcgtctttctaaacatgagcttctagaagaaatcatggaagaaaactgggatgttagtgaaaatggaacagacctgtttgaagaagaggaacttcctctgaaagaccccaaacagtgggagtctattaaagagacagctctttaatagttttctacaacaataaaggacataattatgaaattcaagccctttggtatgctggacattgaatctctaggtactccaggaaattgcggtactactcatattgcaatgccttctttcgcttttgtagcgatgcacggaattgataaagatcctgatctggtattcgttactctagacgttcaagatcagcttaatgcgggtgctaaggtaactgcctctactattgcattctggatggatcaagctaaaaacagtccatctgcgctccatattatggaggctctaaatggtcgtaatcctaaactgattgccttccgtgatggtaagcatcactgcactaatgacgtaggctctaattatgctgccttctctatggctcagaacattatggaattgtctctaggagataatgctctgtattacggcaatggcccagagtttgatatgacaatctactctgcaaatacgttccatgccggaacccatgaagaaatagttccgtggaaattctggaacttaggtaacgttcgatctttccgtaatcagtggatgcaagctggttatagctataaagatctagaagccgaaggtgctagctgggcaaaagctaaaatggaaaagatggacaccattcgttatggaatctatcctgtgaagcatgatccagcattcgatgctttagttgaaagttattgtgtagccatcatgatcgaaaaaatcaaaatttgatttgctttcagctccaaaattctgtataatatattcataaatttgagagaacaacaaaaggaaaataattatgccagtatctaaaaacgtccgtaaaaatggtaaagtagcaaaacgtaacctgggtctgcgtcgtatggctgagcgtcagtccggcatccagaaaatctttaatgtactgaatcgcgccaatccgaatattgataacagttctgatactgttctgcgcactatgctggcaatcggtctgtaataggccgtttttaaacaaattcaaatctcaaacttcatataaggaagcaaataatgactactcgtatctctaaaactcgtgctctggcaactatcaagtctctggaagttaaaatccgtaaagctactgaacaacagcttttgatcgctgttggtgaaggtaaggacaagaaccaagttgtcgttggcgctgcaatcgaagtagatgctctgtctacccgtattaagactgatttccagtctctgctggatatgatgtcccagcgtgatcgtctgaaagctgcgctgatcaagagcaatgctgaaactgttgtagagatcggttctcgctctatgactgttgcggaagcaatcgaagctaagcgttctatggaactcaaagctcaaagctcagttgctggctaacatgcgtaagcagttccatgctgctactgttaagtttaacactcagaaggctcagtttgatgccaagtatgagcgtttgcaggataccatggctacccgcgacaaaaagacttccgaggatgaagttaagatgcagcttaacctgctggaactcaagaacactccgttcctgatcgatccgctggagctggaaaagctgatcaagcaacacgacgaagaataccaggactttgcaactaatgttgactttgttctgtctgagtccaacgcctctacttttatcgaagtagagtaatgaattaaaaggctagtaaatcggtagacgaaagcccaagcatcttacctcgcagcagcggttgaaatacgaggttaaataagaccgctgaccatactataaagtataatctattggagattatgtttattacatcagacatttaatctgacacgtaaaaacaaaaggtcgttggtagtaccaacacaacttcaaagatcaacgctcaagtatgaaagctgaaaagttaaaagcactcaaacttctaaccttctaaagctaaaagatgcaaagtattcgttgatgattcaaaccctagatcaaaggtacatggctcataagatatggcctgtggcgcctctaggctgtttatcggtttactagtctctcaatttaaaaatatatttgctaattagtttagttttctgtataatatatttttaaattgatgagacgaggctcctatgactttacatattttgtttgatgatgtacgtgacttaaatggaatggatatcatcatcagaaaccctgatgtagcgtacgaaatgctctatcagttacaactccagggtaattatctttatttagataatgacatgggtagtaaagtagaaggccaccatttgttaagtcgtatcctagaagataaagatttgtaccctaaaaaggtggttttagtcaccagcaattctgttgctgcagaaaatatgcgccaacagttaaaaacagctggttatcaagaaaaccccaatcgtattgagtacgattggcaggagtaaataaatggaaataacccaggaaaacctattatccttatttcactacaatagtgaggaaggtagattgtactggaaagctaatcccaataaagcccctgcatggaatgccaaatgggcggataagcctgctggggctaaagatgggaaatcaatagtagtgtccattgataataaatcatacagacaccatagattagtatttttatatcataaaggatacttaccagtacaagttgatcataaagataggactaggcatgacactaatcctttctgcgataaaatagaaaatctcagagacgccactcattcacaaaataatgctaataaagatattgggaaggccaatacttctggctataaaaatgtgtataaaacacctcaagggtggagggttattgtaaagaaagataaaaagcctatagagggcggaacctttcttagtctaaaagaagcggtagatgtagcaaatgatttaaggtttgacctattcggtgaatttgcactataccagccgtataaggagtgatactatgttgaaagtattactcctgctggccactactataagtagcttacctgcttatgccacatatgatgctaaagagatagactgtattgcaaaaaacatctattttgagagtcgtggtgagggcactaaaggaatgatcgcagttgcacaggttactaaaaaccgtgttaactctggtacttttcctgattcttattgtaaagtagtatatcagtctaaccagttctcttgggtggccaagagaccaaaagttgataaaaccgatgaggcttggcaagttgctaagaatttagctagagtgatatactacgttgatttaccacaagatccaacacatggagcgttatacttccatagtggtaaagataaaccgtactggacaaagaagtttaagaaaacaacgaagattcaaggccatacgttctacaagcctgtggttaagaaaacttaaaaattcgattgcttaaagccttaaatttctgtataatactttcataaattaatgagaggaagcgaaatatgaaatcagttgtaattattggtgttaatactcgtggtatccgtactacgaaaacagttaaaactactaacgttgctgaaattactacaaaccctaagaagtttgatttcgctaaagtctcggcagttatgacagaacaatcttttaaccaagcactgggaattaaataatggaagagaatattctagatgttttgtgtagggctttgcaggaatctaaggttgatggttctgataaagaagtagctaaaagctaccagaccataatcggagatcttcagcgtgttgataaagacttcattacttctgaacagtttgtatcttatctaaaagctcaactgaaaagcattaatcagacgaaagctaaacttcacggtcaagaccttgataattatagcttgcagtctgctcagtatgagtatatactgaacaaatggctacaacagtatctgccgcctcagttatctgattctgagattcgcaaatactttgcagaattagttaagctgaaccctgggattacaaaaggtatgctgatgaaagcgattaaggaagagtttcctggtcgttacgacggtggcattgctgctcaggttgctggcgaatttaattaaaaattgatttgctaaacgttccaaaattctgtatcatatattcatgaaaaggaaagaataccctactaaagaaatacttgaaaaatattttgtagctgatcctgataatgggatactatataggaaaacaaagaaaggtttgaaagagtgttgtgccaataataagaaatcacatccagatgtgggatttcagggcgacacctatcaactgcatgtcttattgtttattatgtactatggatataggcctgaagaagtagatcataaggatactaatcctagaaataataggaaaaataatctaagggacgcctctagatcgcaaaacaatgcgaatagaaaccaacaatgcaataatacttctgggtacaaaggagtaagttgggaaggctcttcctggagataccaagtaagacatgaaggaaaaaattacagtaaaagagggtttaaaactgcggaagaggctttcgaggcctctaagatattaagagaatccttacataaagaatttactaactttggttagtaatagtggtgtgtggaaatcacttatgtagtaacactgccgtcctagtataattggtattatcaagccgtaactggtggaagatgtaggttcgaatcctacggtcggtaagaactggataactgatgcttttaacgtaaaagcttcctaggttagttacgcactgcctaaaccacgcggtagttggttccaggctaaccaactagtctgctgaatagttttattacgatttaactatgtccaggctaaagaagaactttagaaggtatttctaggatagtgaagttctttctccatatcggagtagtttttcaagctatccacaaagtgggaaatgctggcatatcaccatagtggatgaacgaaatcagatgtataagtagaagcagctcagtattatccaagcctaattttttttgattatataacaaagagttaggtattgtcgtccatccgtagttttctaagactgtaaaaccccagcgccccgctaaaatcattggtatgctttcacgacgaatttttttatcgtttgatatcatatagataagtgttaatttaatttttttttgagaaaaagtcatcgtcactactagatactaataagtaattatacttattagtatctagtagtgaccctttttagggtggcgtgtacgccacccttataatgtaggtgggttggcctataaaatacaaccacagtttacacattgtttatccatctgctttggaggtattatgactacggctatcggtaagtggggtaatggtgcgggtttgcgcattcctcagccgttcatgaagcagcttgggcttagtattggtgatgaggttaaattccacgtcacggagaaaaaattagtaataactaagtctggcccaacgctcgaggaactgctgggacagtgcaatccggaaaatcgccatcaggaatatttttgcgagtctcagggtaaggagatgctgtgacacaatattgtccggctagaggtgatgtgattttgttggatttcaatcctcaatcgggtcatgagcaggcaggtaaaaggcctgctcttgtcatttctgatgacatgtttaatcaggtgactggctttgcagtcgtttgcccaatcactaatcagtcaaaaaattatccattcgaggtgcctgtagttggtgctaaaaaaactacaggtgtcattttggcagatcagttcaagtctttggactggaaatcaagacaagcgcataccattgatgctgtctcggctgctactgttgagagcgtagtttctcttgtttcaaagataatcaaagcttaaaaaaaaggccggctagatgccggcctttctaaagtgatctgctggtaacagaacactttaaggtaactgctctacaagggaacagtcacccgaacttgtgatgttagtttagcgttttatcgctatgcgcatcaagatattcgcttgcgattattttatcgcctcccttgtagagtttttaccgttggctactgccaatggcgattcgtcgtgtcttcagggattggattcaagagagtagttgctctgaaggcgtggtagtcgggttgaacggggagttcgtgcatacagcccagcttggagcgaaccacctaaaaggagcccagttgcacgggaaggaatgagaaaacgccaccttacggcggtctgcaacgggtaaacctcacggtgggaacaggagagcgcacgagggagcgacccatcggaaacggtggggatctttaagtcctgtcgggtttcgccacttctgatttgagcgccggaaatcacctgatttctgtgaggctcgtcaggagggcgaagcctatggaaaaccggcaatcccccagacttttttcatggctttctgtatgagctagtaacgctcgccgcagagtcatgaccgaacgaagtgagtaaatgaccgaggaagcgtaatgtctgtaatgctgaacagggctcgtatcgctcggtacaccattttccaccctggttacacgctctgctgcaacggtttcctgccgttttccacttttgcctgcatagctataccacggcaacgtccgggcaggacatgtaaagtggtcccactttacgcctgccttattcgcatgactgctcaaaggaaaacccatgactgatgatcggacactgcaactccgcgtaaccgggttccgtaaagctgaggcctctctcaggcttgaaggtatggacccgtccggaaccccgctttatgagtccgtaaaggcgcacattctttccggagagatcacctacgacgaaggccgtgctgagatactggcttatcaccagaagcgggcgaacgataactgacgcgggcggacaggaaatgttttgtggccaccgccgcttcgccggcaccagaaaactgtcggacaagatgtgtttttggagtaccgccggcaccaaaaacatttcatcaggcgcagcccgataccctgaatttcgtacgtacgaaattttgcttttgttcagatcgagggcaggattcgcaaagtgctggcgtttgcactcacatcctttagacgttgcgatgcaggatagggcagacgccgcaaaatgacgtcatttgcggtatctgccccgaaaacagaatgttttctcctgagcttgcagctggctctcagaacccctaccgcctcgcaaagctcgttgctcaacgcctcacgaccgcacagtaaactgtgcacccgttcaccgttatcgatggggttcagcgagccttttgagcagttcgcaggattttagccgctaaaattccggccaggcatgttcgtgcatagccatgcaggtgcgcagaaatcatcaggcgcgttttttcacgatatggacagggaaaggtgccggaaacgcagaggacgcggcagaaacgcgctgagggcctctgctggggtgcggccaagagatgttatggtaaattagtacttgagggcgcatcttgcaggtttgctaaaatgtcgatgagtggttctataccatagacattgcttaaccccttatcaccgctcgacttcgaccttatctttcttgttattatcttttttttcaataacttatttattgttctttgtactgttcttggatgttggttaattctgtctgcaagggttgatatagctggaaatgctggcatgagagatgtcactaatggtgcccaatagtataggtaattcgcgataattcctgttgagtggcagcagtaggctgggagtcatgacctaagcctaaccgagttcttcacatacggagaacataaccacaaagtcaccctgacttaaactggaggatattgtctgacggaagggctgcagagcttaatctgagggggctgaccctacctaccgtcgggtatctttaagagcttttataagagttcttaaaaatacctaaacggggtgtagtctaagggataggcaggagtcttctaaattcctttatgcaggttcgaatcctgtcacctcggccaattttattaactactaggaaaataaagtgaaaacacgatatatagtaaaagtagtaggtgaacattcacaagtaaataccaccgatgttacagcactagcatttgaagtagtctccggtatagtcatatttcataatggagatatcaaagctcctgaatttgctgtggattcccgcctgtttatttctgcaactaaagtaactgtagtagctaactcttctaaataataaggaaatatatgtttactaaaaacactaaagaactgacttctgatcaaaaagtaattcgtactattaaacgttggggtattggtgctgtagttggtcttggtgctcttattctggccctcaattcctatacagttgttcaggacggtacggttaaaactcaaactttcctgggtaaagttagtcctaatcctgtattgccggggttccatattgtcaacccattcgcttcttttgatacttttagtacgaaagatatttctatgaaactggataaacttcaggttcctagccaggataagtttaagtctacagttgacattactgttatgttgcagtttgatggtgctaaagctcctatgaaccgtgttaacgcaggtactcaggatcaagctctgaacaagtacgttgaagagaagatgctgtctacgattcgtgagtttggtaagtctgtaccaaaagcacaagatctgttcgacgctaagattcaggctcaactgcaaaccgctattcagcaagaagtagaagagtacgcgcgtccttatggttacaccgttaagcaagtattccttcaggatattactctgccaccggtaatcatggaacaggtacaaaacacaaaagttcgtgaagaacaagttaacgctgcaaaagctgaactggctcgtgttgaacaagaagcacagcagaaagttaagcaagctgaggcagatcgttccgctcgtgaaaacatggcagtagctaacgaacgtgacgcagatgctaaactgtacgcagctaagaaagaagctgaagctaacaccgctctgcagcgtaccatcactccagagatgattcgctggaaacagctggaagttgatatgaaacgcgctgaaaaatatcagggtggcgttcctcagactgttgtaggtactggttatgatggccagatgattatggatatgcgtaataagtaatagttacacgtaatcttcgaaacaagcccgcgtttcctccgagagcgcgggcttttctgtatttaaggcaaaagaaaagcccataagttattcaactaaggtctttagtatttaattatttagaatcatatactattattgcagcaacaacgtgctacccttaagtgccctgcgattttcctctaaaaagttaaaaaattcgattgcttgaatgctaaattctctgtataatatatttataaatttgagagaggaatcaaatatgattaagactggtctagtaattggtaagttcgcaccattaacacgtggtcatattaacctaataaacacagcagcaactatgtgtgaacgagttattgttgtagttagtcatgataatcgttggctggataagcagaacacacgtgatcaggaagtattacagttaaagaatcgacttcgttggttagaacaaacttacgcggatattgagcacatttcggtagagtacattattgaagatgatattcctgaatatccgaatggttggccggaatatgctagaatccttaatgaaaattatggacatttgcctgagatcaccattttctctagcgaactagactatgatgcagaatataagaaatatctgccgaagtttggtcattatattgtagattatgatcggactcgtgttccaatctcagctacaatgattcgtaatgatcttatgaagtattgggagttccttcctagcgtagttcgtaaagattacgtgcgtaaggttgtaatcattgggactgaaagctcaggaaagactactttaacaaaataccttgcgaagctatacaacacttcgtgggtagaagaatatggccgaacgtactgtgaagttgatctagttggtaacgaaaatctgcttaccagcgaagactatagtaaaattgcgttcagacacaaagagctagagtttgaagcagaacgtactgcaaataagatcatgtttgtggatacaaatgcttttattactgagttctaccacagactttatgaacatagtaagaaccctgtggttacagcaattgcaaaagaagaacactacgatttagtaattgttctagcacctactgtcaagtgggtagatgatgggttacgtattaactccgatcgttcaattacttctgaactgttcgagcagatgaagaaagaatttccaaatcagttccctgaagggcgtactgtttacatcgactctccggactacaaagttcgtatggacgaagcagtaaacgcagtagactggctgattcatcactttaacgttggagagttttaatatgactaactatctcgtaaatgactttaaaaactggaaacctttggaatatctgtggctgtttatagcggttgtcttcattagtttagcaaactataatggtacagctctagattgggctactgcaataaccaatgtggtttgtgttattctggttgcaaaaggacgtgtttccaactatatttggggcttagtgggtgttcttacatatggtattacagctttaaacgcagatctttatggtaacgctgcactaaacctgctatactacgttcctatgcagttttatggaatgtacttatggcataaaaataagccaagtaatctgccagatgttccaactaaggttctgactaaagcccaagctctgctgactctagggattctagcagtagccacgttagggtatggtagtttcttagctactacggctgatccatttccaatgttggatgcatttactgctgtaggtagtgtgatcgctatgtggcttatggttaagcagtatgccgagcagtggctgatctggattgctattaacattggtactgtgtacatttggcttgtaactgctcaatctacaggtgcatcttatgcaatcctagcaatgtggctagtattcttaggtaactctattatgggagcctataaaggatactttgtacgcgttaacaaataaagtagttatagccctcgcttagagggctattatacagaaattttcacttgcttaatatagaaaatttctgtataatatatttataaatttgagagaggaatcaaacatgaaacgcattgtacttgcattgactctagtatctacttctgtatttgctgctccacaacaggaactttgtcaagttcaagtttgtaataagctagaacgatttactctagacatttggtcccacattaaagataatatgggtgaacagtgttttgatattgttctgccaaaagaacaggctgttactggggctgttctcagctcagaatcacgttggtggcaaggttcttctatcaacccaactaagaagtcagtgacacgtatcaaacaagtatatcagtgcaacgttcaggaaaatttcacttgcttaatgccgaaattttctgtataatatattcataaatttggaagattaggaactatttatgttagactatgagtctatactttatagattccgtttagaagatggtgtactagtgtggaatcccctctctggaaactctagagaggagaagatatttaatactaagtttgccaataaacctgcgggatctttacacaaaagctctggatatatcagagttaacgttgatcaccaagattacttagcccatatcatagtatttatgttgtattatggatatagaccggaaatggttgatcataaagactgcaataagttaaatatccatcctataaatttaagagcagcagatagtaccactaatacgcataacgctagtaaatcttcaagaaatactagcggatttaagggagtatcctaccacaaagcatctggtcagtggcaaggtagaataatgtttaaaggtaaatcatattccgcagggctgcacagtactcctgaagcagcaaatgaagctctaattcaactgagaaagaaacttcatggagaatatgcccgaaatacttaaggaagaatagcataacggtattgcagcagattgctaatctgtcggtttgaaatatagccttgtgggttcgatccccacttcttcctccaaatttggttctcaagctcatttggtatgagccgtcgcctcataagcgaaaggtaggtaggttcgaatcctccgggagccaccaacttaattataaagtcataaactatgagaactgatatactagatagaaaggaagaaatagctcagtggatagctcagggaaaatctaaagcagagatagcaagaatgctatcctgctcctcgaacactttggaagcatatttaggaaaactagaaatagtagttattcctgcgaataggcagtatgataataaatataagtctgcaacagagtatttatataacggcagccctatttcttcctataaactaaagaataaaattcttaacgaggggctaaaaccacataaatgtgagagttgtggcttagaaagttggttagataaaccaattcctttagaacttgaacacaaggatggaaatcactataataatgaatgggataacttagccctcctatgcccaaattgccatgcactaacacctactcatgcaggcaaaaatattggcaggtatacagaaaggactgtaaatacgtgtgctatttgtcactgcgaaattagctcaagagcaacacactgtaaatcatgtactcctaaagaggtaactataaatccagatattactgtggagcaaatagagtattgggtatctaagtattcctggattcgtgcctccaaagaactaggattgtctgatactggattaaggaaaaggtataagtccctaacagggaaagatcctaaaagtattaagaaaaatagatgatataatccctaccaaattaaggaattaagatgtatagacctccgccaacacgtcgttctagagaagttatcctcatggaattgactaaaaacttcaaggcgactcttgaagatagagatttaggcacggatgaagacattgattttatttgtagactattaaagatgaaactggagaaaacaaatggctaatcctgaaattacggcacaacgctttatgctgaaaggaattattgctgaagcaggcatgacagaagaagttgcagattttcaaaagcaattcctcaatattctcactcaagccaaagagctaggagagaaagaacatggcgcggctattatggcaatcacattggttgggcttgatctggctgaagaatcaggagtttaactcctccaagcagaaattttaaaaatgtacttgctttttacttaagatttctgctataatagttatataagttgatgagaggaatcagaatgttaaaacgttttgcagcaactggtattgaaagctcagtatgtaaatcctggggtggttgggaaggtgagatcgagtggctttatttctacaatgtagaacttcttccagagatcaaagctcaatgtattgaggctggtatggctcctgatgctacggctgatgttgaaatcagcatgaataagctagagggtcgagtagtcactgttactgatgaaggtgaagaggtattcgaacttccattcactttgaaagtcactccttcatttgattaactgatacagcactgagcaagttctttaaaatttgacttgctcaagtgccttaaaacttgatataatatttatctaatttggaaacatatctgaatgagaagtaactaagcgagttgtttttaggggtaaagtcaggatttcctgaaatattccactttgagtttaaccgacttacttttcattcaaatatgggggattggctcagtggcgacggcgcctggctgtagaccgggtatatcacgcggaggttcgagtcctccatcccccaccaaatttaatgcacctatcgtctaatggttaggacatcaggatttcaatctgagaatcggagttcaattctccgtgggtgtgccaattaataattggggtacgcataggttgctagtgggcctccaaaacccatgaaaaggtttcgaatacctttacccctgccagataatatgcaactttagctgagaaggattagcgtctccctgaaaaggagaagaggtacgatcgttgcgtacaggttgcaccagttaagtaaggcttatggaagaaaaaacatgtagtaagtgtaagaatacttttcctctgactgtggagtacttctttaaaagtggtatccaaccttctgggaaacaaaaatggaaacctatgtgtaaacaatgcgaaagcacttctcgtattgactactataataatacaattgccgaggtatttccagacctacattgtgcagtttgtgggtataataaatgtccacaagcaatagacttccatcatttagagcaggatgataaggaatttaatattagtgatgctagacgtggaacctttaataaagaaaaacttatagctgaattagaaaaatgtgtacctttatgttgtaggtgtcacagggaatatcatgctggctttatagagctttaaaagtaaaaatgtagttgcttaaccgcttaaagttctatataattattatataaattgaactggagaagcaaatgaaaatgttagttaaatttaagtgttgtggttctgaacatattttcactcgttatagagagtttaagatgtgtgagtgcggtaaatcaggctacgatgctggagatggctattatgctagatctataggacattctaaagatctagagtttactaatctcgaaaagcatgataaatcgaccgttggctgaatggcttaggcgaaggattgcaaatcctttttatgtgagttcaaatctcatgcggtcgtccaatttgctgaaagaattgttaaaacagttcaggcacgcgtaggaacactgcctcagtaattgaaagatgaggcacggtttggagaggtatgccgctacacgctacggtgctaactccgtctaggtgaaaatcctagtcagcaatataaatttagggtcgttggctgaacggtttaagcgccggactgttaatccgtatccgcaaggataaagtaggttcaactcctacacggcccgccaatttcactaacaactgaggaaatagatatgacaactcgtgcaattgctcgactagaagctgatcgtgataatctgattaataatattaaggttcgtggtaatattattaaggctctgaaagctgaacttcttgaagaacttcaaggtcaagtagagcgtcgtgaagctctaaaagaggttgaggaagctatcgaaaaactcaaggctgaataaattatgtacggaatatccttacccattccagggtttgaggagtacttagtaagtttggatgggttagtatttagtatcaaatcaaacaaaatactaaccccaataaccagtaattacggatacttatctatacgtctccataaaaatggtcaacagagaaataccggtgtacataggattttagcatgtgcatttaagaaattaccaagtctagactctgaactagaagttgaccatagtaacacagacattacttattggggtcttaataacttacaagtgctcacaaaagagcagcatctagaaaagactttaaaagataaaggatttagtaaactaaaccatgataattgttgtaaggattgtggtaaagctatttctttaaaagctgaaaaatgtcaggagtgctcttcacataaaccaaaagatatctctataactaaagaaataatcgaggttacagtaagagagctaggctggtcaggtgcagggagaaagttaagttattcagataaggggttgcgtaaaagatacacttctttaggaggcaatcctaaagaacttaaaaagttaaaggtactatagtctaacggttaggatactcccctgtcacgggagaggtagggtttcgattacccttagtaccgccaaactatacatccatagctcaataggttagagctaccgcctcttaagcggagggttctaggttcaagtcctagtgggtgtaccaaataaacattctagcgtggttgatggggaaaccagtctgccgagggttgagatacggttcaattccgtagaagtcaaatggccagctcgtaattccgcaccagatgatagcaggttcgagtcctgcctagattgacttattatgcgttcgtagttaaaaggtataatttttggttgccaaccagaagttgagggttcgattccctctagccgctccaactttaaggaaacatttatgcacgtttttgagtttcgtgataaaaataacaataaacgagttattgttattggagaaacatacctagcatacgaacaaactgacggctctgttatcttgaatgatgagaaagcaaattttagcttttatccagaagaaccttatgaagagtttcgtactaagtttcttttaccagactggctagcagtagccgagcaactagaatccgaagatggctgataacctgaaactaaaggttgacaaacaaaagaaacgtgtagagattgagcttggtgacgaacgcctagcactatccttcgagtttcttcagcagttggcgatgacagtaatgtctgataagtctcctgtatttgaaaaagaaatcccgttgaaatgacgggtttattgctcctaaagcattgctggcgatgcagttgccttgtaagcatctgaactgggttcgactcctggtgggagcaccaaatttaaaaattcatttgccttctctcttatttcttgttataatatttatataaattaatgagagggaaaccaaatgaaacgttatctttctgtcgtgttccaaactggtggtcaacgctacacttatgaatttcctgagtcctggaaaattaaagaaggtgatcaagttgttgtattaacacctcgtgaaggcttcaaagtagtaacggttaaacaagtctttccaaaagatcacgaaccatctaagtctattcagtacaagatgattcacggtctggtacgaaaagtacctagaacagaagtcgaagtagataaaactggggaagctaaataccagtatacttcttacctagacgagatgatgtaatggacttaacagaatttaaggaaataccagagtatccagattatttaatttctagagatggtagagtatattccaaaataagtaataaattacttagtatacgtactaatactactgggtataaatatttcggcgtcgaaaatggaactaaaaatatactactaagcagagcattagcgagagtatataaagatctaccctcattaacctctgatttagaagtagatcacgatgatacagatatatctaataatgatttagataacctgatagtgaggtctaaactggatcattatgagaaaacttgttttgataggggaatatctccgcccaaacaaagtttttgcaaagtctgtggaataagaatagcgggtaagtctacttattgtcttaaacattatagcgagtcaaaagtaaaagataatagtgtatctgctgaacaaattgaatattgggtatctaactattcctgggtcagagcagctaaagaacttggttattctgataatggcttaagaaaaagatataaagccttaacaggaaaagatcccaaaagtattaaaaagcccgattagttcaatggtagaacagagagccgataactctcagacctaggatcgtaacctagattgggtaccaaattatagttagttggcagagtggttatgcacctccttcatacggagcgactacagtggttcaactccactactaactaccaaagataagatcaggcctttgtgccagatctctgtgtttattaaactgaatgggactatcaatccacaagccggactacgagcgattatcgggtattcacttaataaacagcctgcctcccagtttttatcttgcttctgggttaacaaaaagctgagccaaattctaacatcagggagatctaatgaaagcatatcaaagtcttaagtctggcgtaattaaccttgttcatgataaccagatcattcagctatattctaaagatggtgaacttaaacaaaaggttctagttgaagatctagagggtatcacacctcattttgaccctgaggccttccgcattgtagatgtagaagtggttcctcaagtcgagggtggtcagcacctaaatgtcaatgtgttaagccgtgatcagcttttggatgcacagaaacatcctgaaaaatatcctcagttgaccatccgtgtctctggctatgctgttcgatttaacgcattgacgcgtgaacaacagaacgacgttattagtcgtacatttactcaggcgatataatggggtttggatacgatttctcccagctacgcaaggtagtcgagcaaactccatttatctcccaagttttaggagaaatgtgtggatcgagcattaagacgccatcaccggcaacgtgtgaaaaacaatcgcaagaagtactggacagtcttcccacatgaagaaagccctaagcggttaggcattatcactaccactccttgcatctgttcttgttggatgtgtggtaatcctcataaatactatggtaatagtaagtcaggaatgaaaatttcggagcttagacaaatgcaagacgaatttgatggttttgtaggatggggcgaagacatttcaaatgaggaatttgatggcttcgtaggtttcggtgaaggttaattaataataaaccccagctattgaataagtagtctggggttttcttgtatataggattttcgaaatgaaaatttttaaagtgaactatagcggcctgtggttaggtggtacagctattgttattgcggaaactgcggaagaagcaatagaactggctagaaatcatagaagttctatataattcgagaatgtgacagtagaagaactccctagcagtggggtagtatacaacgacaacggagattactaatgttatattttgaagttcgtccacattaagttaatttaagagacttaatggaggtaatatgagccgtacttatcgtaaacaatctggaaatcgttactggcgtgatggacatcgttccaagtataactttaacatgatcaatcctcatcgttacatcaaaggtaacttctggcatatggatggtgaagctgttcctatgtcttgggatgaagttgatgcagaaattcaggaaggcatcctgaataacgaaaagaaagacggtcactggtgggattctatcaaccagagtgttaaatggcactctaacaagatggttcgacagggaaaccgccgtgagttacatcgtgtaatgaaagatccagaaaattacgactacaatcgagatcacgaccttcgtaagaaaggcatctggtggatatatgattgaggatactagtggaaacctggaaagatataacaggttttgagggtaaatatcagataagtaataaaggaaatgttctaagttacttatctggtaaaattcttaaacctcaagtgaatagacaaggttacttaatagtaaatctttactatgagacaggtaagtgtagaaagtataggatacataggctagttgcagagcattatgtgtataacccagataacaaaccttttgttaaccacctagatggcaataagtataacaacgaggaaagtaacctagagtgggtgacggcagaagaaaatatggaacatgcgtacaatactgggttaagtggcgctgagaagagagctaaaggagaacaacacggaaggtgtaagttatcagatgcagatgtatactggatacgcgcccattatcaacctagaagtaaagaattcggacaagcggctttagcggctatgtttggtgttagtcaacctactatatctaatattataaaagaaaagagtagataacttaaaaatttacttgccgaaagtcctctttattgatataatatttatataaattgataaggagctttgaaatgaaaactcgcctcgcctagactgtgctgttcacgtacttgagcatgatgttgttgggacttgtatgtcttatcatgaagtaggtaaaatgattgttaaacgtgttgctgatgtttgtagtttgaaaatcaccgaagatgaagcagacgaactacttggacaggcaatagagaaaacagaaattttcttgtgcgattcttgttcttggtggtgtgaagctcacgaacattctttcaatgattatgatgtatgccgtgactgtaaagaggacgatgaagatgaataagtttattattgttctggtgatttcagcagttagtttcggttctcaggcaactaccaaagtttctatgaaaaatggtaatgttaaagttcaacagaatggcattaccaccgaatatggtaaagtacgtgatgttaaagaacgtaatggcaaagtagaaatatatactaataaaaacttctctactccggctgttactgttagcaaacgtggtgaaatcactactcaacgtactaatagttctgattcttttacttgccgttatgactgtggctttgaaggtgaagatgagtaatttagaccctagaattaaacttgcagttgaagaaatccaagatcaaatcgatgaggacttcactgtttggtcaagatttggtaatggtgaaggttgtcagctttatagtatgaaaatgggtatctcgattgaacttagtatcaatcccgagggcaacgtagaagtccaacccatgttcagtgtcccaggcttctctggatttgttatgggcatgaaactatgcctaccaaataaacatcttcaccgcgttatctgtcagctagaaacaattaaacatttcttaccagaaggcaatatcaacgattactatcatgaagttgtggcagcgtacatgatgaaagaacgcaaacgtcggagagaagaatgtgaaagagctaaatctcaacagtctagtacagattccagcaactgatgctgtattagaatatcttagaaaggatcatgttaaattctggactgattatagctacgagcataactcagatttagctactgattttgcaaataaacgaatagctgagtatacagatcctagagttaaaaatggtatgattaccttaccactttgggatgtaatggaaaagtttggtaaagatttgtgcccaggttgtataccattgtttgttactattctaattgacgaaaaggatcttaaatgattatctctccatttgctttgtggtttgttattggtgcagttgtcgcgatttacagtctgattgatgatctgtatatctctaaaaataaagatgttattctttatgttataaacaaatatcgttcaccagaattagcagaatttgacgatgaaaagatgttcaaattcattatgtcaggtatgcttattatggacaccttgttcgggccagtagctacttatttcttctttcgtaaaactcgtaagatgaaaaaattccgtgctgaaatgcagagcaagtaaagaactcgcgtaggaccgagttgcgtcacctgcaactgttacggataagggagtcgtgccccttagtgcggtaagtggtgagttggtcgctgacctcaactttaactggagatatcatgagctttattttattcattgtagcagcatggtttattattggtttaggctatgctattgcagttattcgtcatctggatgaatattctgctgaatggtttattaagtacctacgtttagacgatcaagaatacgagttcgacagtgatgaggaaaggcaggctgtccagtcaatgactcccaaagaatgcttgctttacatgcgtgtaattggtttctttggactgttgctagcggggccgctaggtcttactattgctccctacaaagaagttgttgacgacattaaactatggagaaccgctggatcgctacgtcgtgctagagaattaagtaaacaagagtgatgataatcacctcctagcaagaataataatgacaaagcccagcctgcaattttgcgactgggctatttttgtaataaaatttcagttgctcagatgccacaagtattatataatatgtttatagattgaggcaagaggattaaatatgagaattattagtaaatgggcagatgtgtatgatttgcagaacagtttatttgacgcagatcgtgtttgggagcgtaaaactgaagagttaacaataagagctccagatgatggcagttatatgatcatgcaagaacgtatgattgctcgtattgagggagagattggttactttaaaattttgcccttcttcctagccggagaggtttactggttataccacattgacgtgctagatacccaagtaaaaaccttcagtctggacgaggcgttagaaattttagaggagaatggatggtcaacagggttttctttgctagacataaatagagggaagccaaaagagtctatcttatcatggcaagaagaagttaccacgaaagctaaagaagccttatctgagctaagagtaccgttagcagttctagattcattagttccaaatgataaagataacaataaatacttcaaggttataactaatccgcgtctacacctatcaggtattccgtggcaggaaattgaaagcaacctatatcgattacaccagagaattgaacaatatatctggggtgtgcttggaacaggggaaccagatatgattactgtatcagataaagaccgcctagtagcacatggatttgatacggttacgtcattcaggaatatgaaaagatgataaaaaactttattagttctatttggaataataaatggtatatcctgggagctggtttggcgataggcatcggattcggtgcttatcacctagtaaataaggtggaaactttagcaggagatctagcagtagctactaaaaagatctccactctagaaacttccttaaacaaggtgaaagctgagagtgaacttcgtgagactcgaatgaaccagtatttcataatgaataatatttcgcaagcagatctagacaaaaagattaagcagttagataaagctcttagtcgtcaagatgttatcgctgcaaagcctggattggtaacattaattgctaaaaagcagaataaagagttcgaggaaagattagcatgtctttctggtagcttggagtactgtagggatgagcgtaaaaataaataaagaaatctttaataaagatttagaagctcaaggtaggacagtaagattagttggggaatatgaacataataagacaaagacacaatttaagtgtcttatatgctctaatacatggttaacagcccctacaaatgtcagaaataaaggcagaggatgcccaaaatgtgcaggcaatgaaaagttaaccaaagacaggattaactcactcctcagccctagaaaaatcgtattactaagtgaatatactaattctacttctaagctaaagtttttatgtaatacatgttcccatcagtgggagacaaccactaaccacgttttacaccatagtgggtgcccaaactgtgccaaaacagcttgggatacacaaggatttttatacatatttgtttccgataatggcacaaaaataggtataagtaagaatgtacagaaaagacttctagaagttaaatcttgtagcaattttaaagacttgaggatactatcttattatatttgtggcaatggttctaaagaagaaacagctaagattgaagctgacctacatagtgtttataaaaataaaagatgcagttatgggggattcagtggaagcacagagtttttcgatgtttctccggaagaagtagaacaatacatagaaacacattatgaggtgcaaaaatgcacaaagtaaaacttggagtactgcttgcagccgcaatcacaatcacaggctgtgcagaagaaataaaaccggagccatcccatgagttaaagcaagctcatgtagattggcctaaaggacttcagccgtgtagttttgatttcaaattcgaaaagaaattagctacaaatggtgaagatggcgtagtagttgttgtaccttacaaagattggaatgcaaaagcaaaatgcgaggaagcagtttactcttacatttcacgactgactggtatggtttgcttctatcgtcaagatttacaagaaaaacgttgcttagtttactatccacccattacaaataggaaagattaatgtcagtattagtcggtttacatggtgaggctggtgcgggaaaagataccgttgcagaattaatgattgactggtgtaatgacacgttcccaacgtgtttatcccgtcgttacagttttgctaaacccgtttacgaacttgcatccgtaatcctcggggtaactccagagtttctgggagagcgcaggggaaaagagattgaccaatggtttacggtcacacaatctcaattggagcgagctagagacgtatggtttaagtatggtattgataaatttgaggacttctcgtacgtttggccgatttttgaaggaaaataccttgatcctcagcagttaattgggcaagctgatgatgcgctgtatagcgtgtttatctccccaagaaaaatgctacagcttgtaggtactgagttgggaaggcagctggtgcatgaacgtatttggctcataattctggagcaatccatcgataaagacgacccagacgtcgcaatcgttaccgatgtgcgttttcccaatgagggagagctaattatggaaaccaatactctagatatggattccatacttattaaggttgaatctggtattactaataagtatcgcatcgagacagatcatccgtctgaaagcggtattcctgaaaaatacatttctcataaatttgagaataccttcaacggacttgatgcacttcgtaccgatgtgtaccacttctgtgacttagagctagaaccactagttggataattaaggatcactatgactaagaagaaagaagaaaagactaacctgtttcacactgttcgccaatctaatgagtatacctttttctttgacgaagagttaggctcaccggatgagtatcgtgatctatcaatgatactgatgcaggctggtgaagatgatgaaattaatctgatgattaatgggcctggtggttatgttgatactgctgcacagctatctaacctaatcgctaactgtcgtggaacggttattggacacctgctcggtcctagtgcttctgcttactgcacaatcttcctatcttgccacggttgggttgtacatccacatgctacgcttatgggacatacgttctctggcggattctgtgagaaaggtcaagaaatcaagaaagcatatgaatcctacaaccagtttgtagaagatatgatgctagatatttactacccgttcttcagtatagaagaaattgaggcaatggtaaaagagaataaaaatatctatctcaatagcaaagaaattaataagcgtattgaaactttggcagaccatagagaagaaatgttaaaaaattcccagaaacctcaccctgaggagcatggtgaggtttaagtgcccaaagccagagtttaacgactctggcttttcttttacctaaaattcttcttgacaacgataaaaaattgtgctccagaagtgatctttaaaaatacattgtaatctatctctagaattagtataatattattagttagaggaggttacaagtggaaaagtttctacaactattaacggtactgcttcaagaagcgaaagatccagcctcgcttttaaaacgtctgctaactatcttagttgctgtcattattttcttgtttgtaagtaacactagcgaggtgatgtcatttttaaagactttctccacgtctgcagttttacaggatgttcaaacccaaaggatagataactttcctaatatagcacgagagaagagtatggttcttttttcacagacgggtgcggatgctgtttttgtagtcaagtataaacctgatgctatcaatgattattctaacattattgcatgggaaagcaatgcgcaattggatagggctgacttggccgataaagcagtaaacaagacgtctgatatgtataggcgtcacctagaaggttttaactacgtttcggatactagtataaaagtaaataaatatatggggttaaatatacctccgtttaagaatattacatttaactacgtttatacatgcccgtatttcaacctgagtaacatctatgctggatacataggtattgcctggaaggataaacccgtagatacagccgactcggatcaattttatgaatacttaacaaagctttgttcaccacaacaaagatcactaggtagagcattatgagttttaaatttggtaagaatagcgaaaagcaattagctactgttaagcctgagctacaaaaagtagctcgtagggctctagaaatctccccatacgactttacaatcgtacaaggtattcgtacagtaacacaaagtgcccaaaatattgctaatggtacttcattcttgaaagaccctagcaaaagtaagcatgtaactggagatgctatagattttgcaccatatattaatggtaagattgattggaaagatctggaagcattttgggctgttaagaaggcttttgaacaagccggtaaggaacttggtatcaaacttcgttttggtgccgactggaatagttctggtgattatcatgatgagatcgatcgtggtacttacgacggtggtcacgtagaattagtctgataataaatcaaggcggggtaattcccgccttttaaagcaaaagggggctttaaaaacttaatgataggagaaagccatgtttgcagaactattcaccatgatattactaggaatatggaaaataagcctagtagttttcatcttaatgataattctcactgttgtcgcactagttacccaaaatgatacattaaagaaagtcgttcatgggctagagtatataattatgggcacattcggcgtttgcaaatgcaactgccagaggaatacgaaatattgttggctttggatggagttagagaactgcatcacagtagccctggctgtatcattcggtatgattcttatggcccttactctagcattgataccactaatgttagctgggggagtcacggcttatttcacccttttctcccctatacttatgtattcaatatatccaataactatgtacttagttaggaagagattcccatatcaagcacattaatataaaaaagtaattgactttcagctgaaatttttatataatatttatataaattgaatcagaggagtttcacaaatgtcagatcgttactatactcagatggctaaccattacaatatggctccgtatgaattgaacatcgcattacgtgacctcgattcaccagagcgtgcaaaacttgagaaaaaggcgggaattcgtatgtctagcaagggcaagaaacttactcgtattgacttaaataccatgctaatggaagagcttggcgtgaatattgagggacaaaagttgcctctcaacgttttggaaaccatgctggataaagttaaaaacaaatcttataagaaggtgacagttccagagggtcgattgaaagccccttatcaagaagcactgactgagtgtcttggtgttactctggatctgagcactgcaactgtaaaagtaatgaaggcatttttggaggccattaataaatgagtaaattagtatatctgttaaaaggatcaacctgtgcaccttgtaaaatgttcgaacctgtgttcgacaaggtagtagaggattacagtctggaagtgcataaagaagtagataactctgagctgatgcaaaaattcggtgttagacaagttcctgtggtagttctagcagatcgtttaccaaatggtcgcattgaggctaatcacattatgattggtcgtgatcttcgcaaagaaacgatgcactcagcaattaaaaacttcctggaagataatccagaagattaagcaactaacccagatcttagctaatctgggtttttctttatttgccaaacgcttaaaattttgatataatatttatataaatttgagagaggaactggataatgaaaaaatttaacctgcacgaagtattagtagtaccagatgatgtgaatctcttctttgttggggatattcacggttgtaatgatatgttagatgatgctctgaaattagctggctacaacgcaaagaaagactatgttgttgctgtaggtgatctagtagaccgtggctcacagaacttacaggttctagcacgatttctgtacaatccacgcttccgtagtgtccgtggcaaccatgaccagtttatgattggtggtgactatgctaactggatgtacaatggtggtatgtgggcgatgaacgaactagatactgacactattaagtgcattgcagaagatatggcagctaagatgccactattcatgactgtgctacatcgtggcaaagcatacggagtagtccatgcgggtataccattccagtacaaagaaactggtaatgaagtagttatcccgaactggaatgatattattgccaacattacggcagcagaagatcatccacatgatgaccctatctattatatagagccatatctgtgggatcgtgatgtaatccaggaaattggattcatcctagcgcgtaatggagctacccatgagtacttcaaacgttatgctagctttaaagatgaactgactgtggaagtgccagaagttgaaagtgtagatttcgtattccatggccacactggtgttccttacccaattctgtacaagaaccgtgtttatctcgatactggcggtgttttcaacgggcagttgacggttgcgcaagttaatgatgaagccggtaagatcatgacatttaccacagataaaaatgatagctgtggtgtgcagaggattctataatggaacgtgattttgatagatatgtatgtgtaaagaactcccacgctaaagaagctctcaccaaagaagagcacaaagagctttatagactagctatgaaggttgctgcttggcgtaaacaagtaggaaaaaccccatttgagtgtgtagtagtagagcatgattggcctgagtatgaagaagtatggaagatgattgagaatcgtgttgaatttgaacaagcacgataggaagagcttgataaaggataccaagaagcgaaagagcatcatgaggtttatgatgaaatattcaaacttcgtggtatcagtagccactatcaagggtggaacaaatatgcagaggaagttctataacgaaagttatattctggttgtatctaaaattgatgctggagatttagcgatgggagttcataatgtttgattttgatggtatggctcgtgagatatttatagcaatagggatagtagttcttatctctttctttacgggcctaggcttaggccttttattttaaaacttcatttgctaaaatgctcagttttctgtataattactttataaattgatgagagggaaacaaaatgaacaaagttgataaagctctagttttcgcagcagcagataagtttgaacaagttaaggcaactttccgaaccttgttccagtcttacgttcaggataagtctaatcccatctctgaacgtttgatggtctgggaatgtcatgcttgcaatgccctattaattgcggattatcgtagcgatatagataaagatctgtgtgaaattcttatccacgaggaagcagaacgttatcaactaatctctttccaagatttggcagagcacatcatcactgatgatctttgggataaatactatggggatcctgaagatgaaggaatgactccagaagcctgtattgagctgatctgcaaagatcatcctgaaattgcagagaaatttgaaaaagtttttgcttctgagttctccggcgttgttaacgattggtaagtaattaaaaaattcagttgctttaagccttaaaattctgtataataagttcataaattaatgagagaggaaattctaatggaaaacatgactaaagacttcgacgcctctaaccttactaagactgagatggccaatgtattagcaattctcctcgatatgcaaggatttgaggggcaactgatgaaaatgtctattccggcgatgaagaagatgtacgattcccttaacaagaacgctatggcctttaacttagcaaaacaagaggcacgctttgccaaggagcaccaagcagtggcagaacgtcgagcggctagttttgagcgtgaagttaagcaattaaagaaaaaatgctaacacaagaaagattaaaagagctatttgaataccgcccggaaacgggcgagtttattagaaaagtgagcaggggccgagctaaagcaggctctgtagctggaacatcagataaagatgggtatattatcataggtatcgatagggaaaggtataaagctcacagactggcctttttgtacatggagggtaaaattcccgaagaagttgaccataaaaataggattacatgggataataggtgggataacctgagagacgtcacttctagtgaaaataacaagaatagaactagctacagtaattcagggtatttagggatctcttggcataaagctgcccaaaaatggcaagtacaaaataaagatattaataaaaaacctgtgtatggtggactctttgactacttagatttagaattagcgattaaaagagctaatgagcttcggttagagttacatggagctagtgctattatagaaacttttgatcctacaaaacccttacctactctagaggaattaaataaatgattatcgaattattaattggagcattaacaatttctgtactagcaaatatagcagcctttttatgttttctatcacaaagagaaacaatacagaacctggtatcaactaatagtggactccattgccgcttaatagaacaggaagaagatatcgaattagcccaaagacgttcagatcttcttaaagaaaagctaaataatgttgaagctcttgttggtaatactaaacttcctattaaagtcctgcgcgctcaggtaatcacggagattaagaaatgatgttaattatcttagctttttatctggttattgttggtattctggttactaagtatcatacctggactccgaagaacgttggtaaagtagcactgtttattctgccagttcctatcatcatcgttgcaatgctgttcacaatgttggccggtaaagtgacaaaaactgacgttaaacgcattgtagacgaactacagcaatcttctgacatgatcgaggatattctgaaagatgaagcttaattttagtgaattaaccctgctggacgagtttctaggttttgttactgaacgtgggtttattaatgtagatcctcagacactagaagtcttgcaatccatccagaataaaactaaaacagatctggaagacttatggcgaccactttctgagctaactcctcttaatatgaaagtgattgttaaaaatattgaaactggtgaagaacgtgagatggttcgtaaagaactggctaatagttattctccagagtccctagtgatgcatcatgacgatgaaccagaaacactttggacagcccattatatttggcgtctgccttgattgatttaacaactgttacggcaatcctaatcttcggtttagtggttgccgttttcataatcgttgagcaggccaaagtaatacggagacttaaaaacagatgattaatttttataaccctaacttgcagaaagcaacgtgggattactttataattctaccagcttttatgttaagttgtgcaatcattaacattatgtatcaagaagctggttggacagtccaagatttccacatttcacaagttcttcctttcatgtatgaaggcgttatcgcagcaataaatggggttcgtaaatgacagcactgcaaagattacagaattactggtttgatggccaatttaatgatttattcatccagttgtttgtcgaaacgaacggacattttaattaccgcttctttaatactttccatgaaacgaagttctcgcatacagagattaacgcagcgattcaagatctcaccgggtctaaggtaattccttatcgtgatgtagattttgcacctgactgttttggttttgagctgttcaagaaagcgtataagttcggtaagtttgaaaatgcacgacattgggttcatgacttctggtataataccgatatcgtccctagccgtgtactgatcctcaactggattgctaaacaacatccgccgaaggcacaatcggcattccttccaactgatacaggaaatctttaccatgacacaaaagaaaaatccagtgctagagcagatgaagcagttggagaagcagattgaggaaggaagcgttgatggacagtcaattgtcaatcatgctttcgatcttacagtaggatgtgctaatccgctggtggcaggcgaaacagcagatattcttgggcttttaatggcagttggccagttaatcgagattacccaagaagagctagacaatgatgaaaaagtaactgttcatgatgttctcggtgctctagatctgattgttaatgcttatgcctataaacgccgccattcaattgatgaatatctagtttctcgtgagattaccgaatctcttctggaaactgctgatatggccttaaacggcaagcaacttcactaatcctagaggccaggacttaattgttctggcctttcgtgtatacagaaatataatatgaaatcactagataattacttaaaggctaaatacagtcctacagaagatcaatatgctgtaacctgtgaaataagcaaaaataaaacagtacgattagctcaaaaaggtggaggaacatccccaaatattatttggctatctgaagaacaagcaaaagacttatactgtaaactaaataagttatttaataagtaacatgcgtgataaaataaatgaattactttatgaggaagctctagcattcccatataataagttcacaaagtctgacggatctattaatagaactaagatcagacaactacatccagactttcaacaagaagcactaaatcttatttttattaagagagctgtagaagcacatggtaagttctttgggtatgagagagttaagtatagaactatgcaacagcaagttgagatctattgtccagatcatgatggttacttcttgcaaactgcacggtctcacttagaaggacatggttgccgattatgtgctcataaagttgtgacacgcttaacagaatatggagtgtacaccgtaccagcacctttccacaaatttgtagttgacggtgagcacataatttggtatgataaagatcaaaagttaaaacaggagttaaagaaagatggagtacgtagtctggtcaaaccccttagctctactctcccacaaactattcaatacgacgtgggggaggcatgagataactgttaatgagaatccacttaatcatcagcatcctttagtcccaactctctataagattattataaatgatacagaatacctagtagatgatttcggtaaagagtttgtacaagaagccatagacaacaataacatttctatgggcgaattaattaatagagcatctaattttgataagagttggatgctaatctggggttaatatggaaacattacttcttgtattactaggcggctcactcttaaccatcttaggcttgataattgtatgcagtcgcctcaatgttaagaatctagaattaaatagtgagaatgagattcttaaccgagaaattaaacaacataatatcgcagctcgtaagctgttagataaactggagaatagataatgtttacacaacaaaccattaaagtagttgcagaccacgaactcgacacatgggattacagctttaaagatctgactgctacagtacagtttaaatctatgcaactgtcgtttttgcacactgatcttcaaggttgtaaagagtttcaggctaagctcatgaatgctcgtaagatttttggcacagctcgcatcccggctgataatctgattaatgcactgatcgatgcaggatacaaactcgtgaagactgaggtgaaccgcccgagtactccagtaactattcgagatccgtggcagtcagggccaatcgcaatgctgaataactccgataaaagattaatgtcggatatgcacaatgttccttgtggtggcgtggtaagcaatacgcaatcatataagtttggggaagattgcagtccttccgtacaactgaaacatactcaagaagctcttgaatctgatatgcgaagcgtagcaccagcggatgctggagtttctaggaactcatacaccattcatctgagtacaccatctaatagaaatgagagctttgctgatgcagttatggaagctcttgttgatctgactaatagtaagggttttaattaatggaactagttactgaatttactataggccactgcaaggtggcttttctcaatgaaaagtcttttaataacgaagaaactattgggatctttgaaattaaggaggatgaatatgaacgtgtggaaaggctagcgtatttattctttgctgatggtcatttaatgaatgatctcaaagagctagtatttaggttgccaaaagatatacctttcacagctagaaacatgtctcatattgttgctcaactaaatctaatatggattaaattagatcccgctatagatagagtcataacattaaaagaaagaccagttaaaaaatttacaggtgatcaagcctgtgatatctagtaataaaagcacgagcctctacggaggctctaaaataaaaagaaggtcacaatgaccttaaaaacgagagataaataatgtataactttaaagataaactaagacaaaatgctggtaaaggaaaagctaaagagaacaataatattcctaatgctaaaatattacctttccctgaactaacccaagaagaaaaagataaactagcatttatgttcgatgcacttctaggactgaatggacgtttatactctacgctctcgttaaatgagaaacgtttagtagagttctttgggaaacgttatcaagttacatctaagggtaacgctcttaaagaaggagaaaaaccttacacagttattaagattagcgcatatgcacatcgtttcttaattcgtgcgctagagacagaatattttacgctaccttcatttagtgcattccacatctttgaagatgaacgaatgaatattgatgatttatatggagatcgttatcaatattctggaagcccgttccatgatgccttaagaagctatccaaattgttaccttccaattagagtatcacaaggtaaagcaagtgtctttgcagtgtactcagggtctaaagcatcggatctagaaacttatatttataaagaacgtagatctgctattccagaagaagcacgttatgaaaatccaattctaccaactaaagaagtcaaggaaaccaaaacttctactactcaaacagaatctccttatctgaagtttgagaaacaagttggatgggttctagaaatgggtatagcttcaccgcttgctgcagcatttatcaataggtatctagaaattcctgacgaattccacacgcgttataacacgaatattcagattacagatgaattaatagctattgcaaaagatacacctactgacactgaggcgtatcaaaaagcataccaagagttactgtaagatcctgcatgtctcggtgcacaatacctgtaccgagactcaaatacaaactctcgttgacagataactaaatgtatgttatcataactctatgagttaataaaattaaccatttagagttgccacacagaaggtgtggtggttcaggaatcttaaattactgacttgtagcgtaggttacggagcgacaggacaagtcaacaggtaatttaataaagattactagaaacatcacgagaccttctggcgggggcaaagctctatatgagaaccatggggggatcttatacttatataaaaactaatactgttgaatagataaattaacgttcaagatgatacactcggttgccgctcatctgctaggatggcacaacactttctagtagactcctaagtttctaggaatagttaagcactaactctagagtttacactaaactttaaatctgtttctcacgcattctagggcagtttctctccaacgttacatatcctagggcggtttcctatacagggcggttatagggagggcggttatttctagaagacatttttccaaaacacatttctggaaattgctatcggatttgcacattatgtttctagaaatttatggtcggatttgcacattgataggagtctccaaagtttttaggaacactgaaaatagcagcattatttcgggccgaaggcccatatttgcctgagtttttagagccacaggaattttcacttgtcaagctattttgccccattttgctaataaaatttcgctttatctcccctaatctcaattctagccaaaacatcccgcattatccccaaaaacgcagcaaaccggtgctgaagcaccaccacagctgcccactccagtttctacccttattttctctcactctctcaacttctcccacaaacccacacaatcacacaccctccaatcgaagtcacaaaaatcttgtcggttttgcacaccttaacacttgtcggatttgtacatactctagtaaatccagctggattgcatcgcagttgcggattgctggagtttttaggaaaattcattgtcggattcgcacactataaaaatatttgccatcggatttgcacactaccaaaaattgtcggattcgcacatacacgctggcacgtaatccatgggggcaaatgtcggatttgcacaaaagcgcagggcaattgccctgcctgccgaaatgcgaatgataatgagattgattctcatttaaaaagtgaaatgcgaatgagattgattctcatttaaaaagtgaaatgcgaatgagaatgattcgcatttaagaagggaagtgagaaatattcaagaagtgaaataattctcatttaagaagtggaatgattatcggttagacagtgaaatgagaatgattcgcatttagaaagcgaagtgagaaacactgctatttaagttatccacaggtttattaacagcacgatttgacttgacaaaatcctagcgattttgaggcgttttcaacagacttatcaacaggttattctactgtataaatatacagtattcctatgtagcgaataattctaatataggcctaaaacgtcctgaatcgcattctaagcgatttaattttggaggaggtactctaaaagggaaatttgtttgcaggcagaaaaggggggccgatagttgcgccccttgattattagtggtagatatattgttgccagtagcggcggatattgtcgccaccgtggagatcattagcaggcttaatattgcctataaaaatatatagtttcatagtgccattgctcctagaatgagaatgattattattaacattgtgaagccgttcccaaatcgtaaacgctgggaatgtttcccagcggtattattagatttatgggattgcgttttacgccaccagctattcattgcgctacctttcgaaacgccatttcaatactatcagcagtggattgaatatacgcgcctttcataatcaggcgctccgtacatactttgcggaaaatgtcaataaattcattttcattttccgctattaacgcttcccccataacctgaacgtcacaagacccaaaagttaaaaattgaaacgctaattcacgggcgacaacggcagaaattttataatgtgctttgccctcatagatattaaccacgcctttataaactggtgaaagctgatttaaatagtttgctaataatgccggacggcaattaattacaaatcggttgccctcgtaaattaccattttataacactccccgaaacgcagcgtaaaaggtggcaaagtgtttaaccgtttcggctaccaaattgccacgcttgtcaaatttcttttctgtaacacggaaagcgtttttgttgcgtgctacatattcaattttacagtctggacgctcgaacgtgttaacatccaccagcttgaaacctttggaacgagcaagagaaacattgcggatcatttttcttctcctttattcatgcagcccagcaaataagaaaatacagcgatacccgcgccaataataaccacgtgaacgccgaaagctattgcaaacagtgataaaatagcgcccaagatacctgctagaactgatcgaaaaataaccattttattagctcctagaaattaggggcgaaagtaacgcccctttaataattacattaaaacaatttttaccgcttgctttttggtgcagtggttagctttcaattcatccaacaaaaagcccgccgtttgctggtcaattttatcattgtcgtaaagttcctgaatggtgatataagttttaccaatcccaaattcagaaaccataacgctgataatagcgggaacggatacccattccataccattaaaaattgcagaagatgatgaatgtaccattttaacgcctcctagaaatcagggaaaatttttgatccaccgttttggtgtaaaggcattataacaaaaaaggtcgccaacataggcgacctttacaaaactttacattagactaattattactcgctttcagcattttgggtaaaggtagaaatgtcaataccttttaccatttcgtcgatcatttccgcaatattgaaactctgtaccatttctagctccctgtaagcgtacacaaggctttattataataagggcagcagtgagaaaacgccgtgtagcgtgttctagacctcttaaatttgattgcggttgttactgctaccattctaccctgtatatttatacagtaggataacctgtacacaagtctgtggataagtgcttaaaacgccgcttatcgtgtcaagtcaaaacgtgctgtggatacctttgtgaataacctaaatgatagtggttctcactaactaatttatacagttattatataacaaaatatagttagttggctaataggattttaaagtgattatgagtctgctaattaaacctgaaaaactcattagctagtctgctattaattttgttataatataaatgaaaataaattaattacatagggaaacaattgcatgggtaaatataaggaaatggattatgagttatttaatcattacttttattatgatgaaacagcgttatcatttttacgttggcgggaagatcacgccgtcgcaggtggtttaaatggtaattattggcaggttgaactattagacatgggacaattcaagattcatagaattatcttttgtataatgaatggtggtattgatagcgacctaatgattgatcatattgatcgtaacccgcgtaataataacatctggaatcttcgcgctgtaaatagttcgcagaataactataataagactcctagtgagtatgaaaactataagcgtgctaatggtttacctagaaatatttataaaagtaaaagtatgcctcctgatagtttcgggcgtgactatttgactgctcaaattaagaatcctattaataacaagcgtattagtaagtctggttatgatttacctacgttattattatggcttgaaactaaaaaggctgaatttggaattgtcaattaattaatttgataaattaagtcgtttggtcttgatttttaaaagtcaagaccttttctaactttatttcatttttgcttttgttaaatatttgttaagtccaatttaaggcgtctagatcactttctacggcgttctaatttctagccatcccatcataaggggaggtgtccgaaaacttcaccacgaggattttagattttgtcaagtaggcaagagcagaaataaatgaaaaaattacttgctaaactgcttatttgtgtgttattcgcgcgcccgtttcatttaatttagtgcgccgcgggacgtggtgcggtggcgtttgtctttacgtttctttacaaaaataaggttgcgcccttctcggtattctcttattatttatcacgtagggcagcaatgacgaactacacggcggggataacagcgattgacagtctgtttgacctttcaaaaccctgccatgctctttaaaaactagggaacatcttaaagcctatcggtggcaaacttatacattataagggaccgacgatatgaaacaaacgcttttgatcactggcaagcctatcaagtcacttgatagcagaacaaaaaatttgttgacagtagcgcaacgatctgtaaaatacagattcaagcaatacaagaaaggcaagcaacaagggctggaaatggtgtggcgtaatataatgattgatttatataactcccatcaaatcgaaaaaagtttaaaaaacgcttgacacgctagccgataggttttaagatgttccctagtttttaaagagtgataacttgataaaatttgacggtcggcacttaccataatgtgccccgccccctaactgggatatagcggcccgcgtggagttctttaaatttattatattggcgagcggattataatctaatagcgtttcaaagtatcgaggcgctattgtggaataatccccaataaaccggagtattaaaaatgcaaaacgttattaccgcgccgaaagtaggtcaatctgtatttattcctttcgttactaaaacggatgaactaactggaaaagccgaacgtattaaaggtgcggcgctagatcctttcgataaaatcgatgcggtctatgcggaaacggaacgtagtaaccacggcaagccaatttataatgttcgcgttaaatccggcgacgttgtaaagatcattcagaaagatgataaatggcaagctattagctaattagtgctaactttatattcccctgaaatatggggaatatatggattaacattagttaatcataatcccttaattaataattgaatggagtattaaattatgtctaacgttaaaaccgaaaaagccgcaaaattctcttggaatgaagaaaacactgaaaaagccgtttctatgtattctgaaatggtcgctaaaagcggaattgaatttgctaacactgacggcttaaaagaaatcgccgccgccgttggcgcggcttctcccgtgtctgttcgctcaaaattgaccagcgcaaaagcctaccagaaaagcgataaacctcgcaaagttggcggtggtagctcaatccgtaaagctcactatgtgcgcgtcattgctaaacatgccattgatagcggcattgtaaaagacgccgacgatctggcaagtctggaaagcgcaaaattggaaacgctggacgccgtagcgcaattgttaggcgtagcggaggaagtaaaacaggccgcaggcgaataaatttaatcagtggggaataatccccactatcccttaaaggagaataattttgatcttttatcctagtgaatccctcattctaggtttgtttattatggcggcctcattattgtttgcttattttcaaaatgatttagattcatattattttaagcgtaaatctaaattcgcaaagagtttaggtcttatttgttttatcgtcgccattgctcttggcgtaagttctaacctaatgccgattagttaaaactgtatttgcttaactcctcctattaatgagatactattagtaggaggatttaagtaaatgtataaagaaatagcttttaataaagtatctgaatactttatttatgatgaaactagcccaacatttctacgttggagaattaacaaggggaataaaaaagctggcgatatagccggatataaaagaaataagtattattgcgttaaatttgatggcgatgattattatgtgcatagggtaatatgggtattatttaatggtggcattgatgcttcattagtaattgatcatattgatatgaatccggcaaataataacattaataaccttcgtttagtgccccaaaaagttaacctgaaaaatcagggtaaacgaattgataacggtttgcctaaatatgtgagacaaattgaacgaaatggcaagccttattatattgcgcagataccaaatttattaactggtaagcgtataagcaaatcaagtgctaacctagatgtaatcatcgaatggttagaaaataaatttaatccctttaatagagttacttaacttatgaatatttccgcagaaaaacagtcccagatctctaaacttgccgctgattttaatttctatggcaagcgtttacgcgctactaaattggaagtttgtgacgatatttcaaaagctgtttatgatacgccgaaacattcaacggcaatttgtgactggctggaagcaaataaaccagcgaaaccgaaagcggcaaaagccgaaaaggcgattaaaaacgatgatcgcccagaggcggcgggaattgtttctagcaccgttgagcaatgggaagttaaatccggtcgccgttttattctaacgtcgattcagaataatactttcccgcataaaaactttttagcctcgcttgaacaatatgctaaatttatcggcgctgaattacttgttagtaaattcatttataacaaaaacggcttccagaacggggaaggcggcgaaaaaatcaaatacgatcccgcatttgataaatatatttgcgagaaaaacgtatttttaaataatcgccgctttgctttcatggctgaaattaacgtattaccaacggcagactacccgctttcaggattcgcagaaactgccaccgctttaaatattgaaggtctggcaatcggtcacgcaaaaattaccgctgaaagtgtaccagcgttaaaaggtgaagtagtgcgccgtatgtactccaccggaacggctacacttaaaaactatattcagcagaaagcaggtcaaaaagctgaggcgctgcataattacggcgctttgttggtagaatttgacgacgacggcgaattttttgttcgccagcttgaaacaatggatgaaagcggaatgttttatgatttgaatatttgcgctatgcctaccggatgttttgaaacgtccgatcatgttctaggcttgcaatatggcgatattcacgccgaaaaattagatgaggcttgcgccgttgcatcatgggtgggcgaaaatagcttgcttgatattctcaagccgaaatatcagtttattcatgatgtgcatgattttacatcgcgtaaccatcacaaccgcgcaagtggtgtattccttgcgaaacaatacgccgccggacgtgacaaagttattgacgatctcattgataccggtcgcgtattggagtcaatggagcgcgatttttctcaaacaatcattgtggaatctaaccatgatttagcattatcccgctggctagatgatcgtaacgcaaacattaaagacgatcccgcaaacgcggaattgtatcacagccttaatgctgcaatttacgcggcaatcggtaatcatgacgatactttcaacgtgctagattatgcgctgcgtagcgtcgcaggctgcgagtttaacgcgattttcctgaccactgaccaatcgtttaaaatcgctggcattgaatgtggtgtacatggtcacaacggcattaatgggagtcggggcaatcctaagcagtttaaaaagttgggacgcctcaacacggggcacactcacacggcaagtatttatggcggcgtttataccgctggcgttgctggtagtctcgatatgggttacaacgtgggcgcgtcaagctggacgcaaacgcatttaattacatatgcaaacggtcaacgtaccttgattgatttcaaaaatggcaaattctttgcctaattaaatttaatcagcggggaatattccccgcttatattcccgaaaaagttaattaaataatttggagttataaacatgaaaaaccaaaacattcctttcgatcgcgctcagtcttccatcgttctagtttattctaatggcgagcgttatcacgttgaatcgggtcatattattgatgaactgctagactttaacgaggcgctacaggtaacaacgtttgcatatattaccggtaaagcgtcaagccatacaaaagcaaaaggcgtttatattgataccgtaaaagagcaaaccgttattattgacgctgtaaaatcaggtctagcgtttgcagttgtcgcaccatgccctgcttgctttgataatgctcttatgtctgcaaaggtctacacttgcgcgggtatccgttctagtgtatccggcgaggatattagttttatcgctgatgctcttgcttttggtctttaatagctaacttattattgcccgcttataaatagcgggcaatgctgaattaactatacccttaaatggagaacgtaacaaaatgaatcaagttaaaatgaatattaccagtaatttcccgcatatttcccgcgtcatgatttgggatttagacggcactattattaactctttccatcgtgtagcgccttgctttgatgataacgggaatttaaatttaaataagtattcccgcgaagcctgcaaacatgaattaattatgcaggattccttattaccattggttgaatatatgcgccaatgtatgaatgatcccaataccttaaaccttatttgtaccgctcgcttaatgggtaaatctgattattatttcttgcgtaaacaaagtctaagagggcgcggaaatagtaatattcgcgtattttcccgcgatacattacataaatactttgatgcaaataaggttagcgaaatatatcacagcaaagacgcagtatataaaagctattactttgaactgtttaaacagctatatccaaacgctgattttacgatgatcgatgatcataaaggcgtattatcggcggcggcaaatgctggatttaaaacgctggacgctcaagccgttaacgatatcctatcaatcggcgtaacattgatcggggaaacctttattgatgaatcgttagatgatgataatgattatcaattcctagccgaacgtttaaaaatgtgttgggaaggtatgaccgaggaagaacgcgcggaatatagtaccactccgcaacaattcattgataaattaaaagttgcataacaattaaaaataaaatagtttcatcctgtaattaaaaaatggttacaggatgaaacagttagcatggtaatagtaacacagggggattattagactactaactatccccagtccccatgagcacatccgcatgtgtaatcttatgaaatttcaagattttcaaattagcgctattaaccgtggtttgtgaactcaccacatactttctcacgtgcttcccttatcgcactttcagcttcctcaagactctcgaaataggccgagataaaatacttaccttggtgtctaccgcgtgctctccacttcttacgagtgttatcccagtatactcccttaactcccgagatattgttcttagatagacgctgattcgctaagttctgctcatgtgatgctttacgaagattattctttctattatctagtccctcacagtttttatggtctatgagagattctccgggatcttctccgtagatgcaccaccaagctaggcgatgcactctaaactctccgaactgtgggtgacgatatatgagataaccttcactttccttagtataccctataataggcaggaatcgccccgtatctggatcatatgaaaaactaccagctatttcatcagggattttcttaaatatcatgaacttctcctatctactggcttatctcctgattctgacatacgaaatctcctccgcgacgcccgagatccatcagaccattctcgctcaaactccgcacgtttctccgcaaacttccgctccctttccgaaagctcccgcgatactcccgcaatatattcacgatgtttgttaatagccccgagtgttccgaagattcccgcaagtaccccgataatgaagatagctacaaaactaaacattatttatctccccgcagcttacgttcgatacgagctaaatggttatctagaatgcactgtccgataattaccacaactagtaaagaaataattactacttccattataaccaccccgccatagctgctaaccaaaagagtacaaagataaagaataacacagtcccgaatccgaacgaatttatccaactttcgtatacttctccacgcttgttctttttcatttatttagctcctctattccggatactttatatcctttaaatatttcttgcacaccacgtgtaccatggagatgtgctcttagttcatttgtttttgtacagctaactctagctctttataattaaaatatccaccagatatttggttgcccttgttatcttgtactctaacttgccactgttgttttactttattccatgaaatcccgctataccctgatttactccaggaagatctatttcgcatattttcctgcctagaggcatctaagaggttatcccatcggttatcctccctaatcctattatcatggtctacttctaccggcatgtagccttccatatataggaaggcaagcctatgtgctctatagggtaatttatctatacgtattactacatagccatccttgtctttagtacctgctatgcttccagctttttttattacctctactttgtaggtttatgaatattcctgttgctggatcgtacgttagaacttcctttaatctttcttgcgtgagcacgttgcttctcctgtaagcctggtatttggaagattctagcaattgcacgaaccattacgactgtcccgattagatccattacttcgtcgaagccggattcttctagtaagaaggatgttcccatcacgtcttctactgtatcttctatgacgtcttgaatgatttcatcaattgcatcatgtattgctttttattcctgggatttatttcaaagttaacaggttcctgaaaggacttttcttcatcttgcattgtgtttgctacctgtacctcatcccagaaataaaaatttttgtttacttcgagatctttttactttatactaattacaagtgaccagattgttctagtttaaatttgcaatcaccatatttgagatcaaactgtgacaaatcccaccacccaaacttagtgcgtaactgagttttagggaatcggtagcccacagtacgtgcttctcgaatatctaaagcgtagtgttcttcaccaacatgtccataagacttcacgtatgccttacagaatggctcgggagctggtacacaaccagtcaacactgctgctgcaactacgatagctagtaactttttcataatcgttcctctgtttaatttataaatatattatagcaaaatagagggatctaagcaaatacatttttaaagaaggagattgtatgagttttttcgcaggaaaatttagtgatggtaaaactgtattatctctaaacgctgctaatggtggtgatactggtgagcactattctccaaatactaatagtatcttccactcagatatgcctttcgtcctggttgatgggacttatgaagcagccctaggtaatgcaggtaatggatactttgttactcagatgccttgggatattataaacattaaatccaatgatccaggtagagttatattaactgctattgagataaacggtactcatagaggattcctcaatggtactcaatctcaggttggccagttcttatcattttttgaatacccaccacgtgctggtgctgaattatctgtaacatctgcttttgcgatcggagatagtttagctcatggtacttatatctataatggtggtcttggtcatgaggaatctattgctaggcaaggttctggaggcagtttactacagtcctctggtttccagatctttagacctggtggtgttcctgctgctgaagccattgccagagcctggagtcttatgggttttccaactggtgtctctactgttcctttaaatggtggtaacgctgattattgggatcctaactggcaggcgcctattggttctgctggtagaggccataattggttttatgtttgtagttctaatattcgtggcttcgcaggtaaaaaagtcgtactaccagataacgtaaacattaactaccaatccccctcctttcctactaaagtatacgtttgcaggggttctacaactaatatggctgcgcaagccactagaaaggtatatgtacaggactggtacaacgttacgccaactaaggttatttggtatgtactaaatctgcgctattctaatggtagtatgggagtttctggtaatccatttaccggttcagatatcttaatatctccatctaactttactattaaaggtgttagcctaccaaatacaggctataaatttattaaccagaatgctttcggaaacttaggctatcgccctgatatggagtatgttggtaataacgctgcgtataccggagtttttggtgataatactgcacgatgtgaatttatcggctctagtaatggcggattgtggtctcctgttaactatgggggtgcagcttctcaaattagcttatataaatttggtgtaggtaaacaatggtatgtagatactaataccaactccattggtaatgaacatggacctgtatggagtcctagtactgtacccctcaggttattcccaggcaacgttgcaagtacttatgtaggggatgatataactccatcctaccctggtgctggtgacttctacacacctttggccacagtttggttgggattaccaaatgctcactctactgttatattaactactgaagttattatgggtaatcttaatactgctggaatgcctgtgcgtacttatggtggtagtgcttggcgggtacaaggtagacgtcaacaaagttatacagctggtgatggtgtattccatcagattcttactctgccacctggctatctagtaccatatcacagtacaacttcctatagctatacccaaacgtgggctagtaggcctgatgagtttgctttccgtaggaacggatatatttatactattaaaaaccttggtaatggcaacgttgagttgggtgttatcattcacgctgcagaagcggcagctgttttcttgccaagactacgtgtaacagttcaacgcctaacctaaaggaggatatatggcaaatgatgtattagttcccgatctcatgtctcctgagggcatggatgttattgaagcctatttacagtgcagtagtgatgttcctgccgccgctcgtagtcttggaatgtccgagattgcatttcgtgatataatgaatcgtggggaagttaaaaactatctcaacgatatctttatggaaagcggcttccgtaatcgtgaccgcttattcggagttcttgatgaagttatcaaacgcaagttggaagaactcgaagaaactggcatgggttctgaccaggatatcatggatattctctggaaggcgcacaagatgaagatggaagaaatgaaaatgatggtagaactggagaaagtgaaggcagcagcccgtaccccagctaaccagactaacattcagaataatattattgctggaagtggtgacgaaaactatatgaatcttattaccgctctagcaggaggaggtaagagata

SEQ ID NO: 136 - DNA, 145366 bp, Unknown
  source: /note="Description of Unknown: 8M-8 Bacteriophage Sequence"
ctggcatagtgtacaccaggccccggatcgccggggcaacttttactggtaaatgcaaatgatacgttttctcaatatgcgatctggtaaaacctatcgctggattgaaaaccgcgttttagttgaaacgccaaaaggctggcgacgtgtagatcacttgcgccccgccgatctggcttgctttcctttcatggggattaaaaaatgattagtgtacgaatgttttattacgatgaattatcagaccaggcaaaagccgccgcccgcgctaacgttgtgatccccgaggtggaagcactgatccgtaatgttggcaacgctcgccaggcctggaaggaaaacattcaccgggcaattaatgacccttatcacgtccgccggatctacaatggacaaatggcgctttacaaaatccggcaccagggcgaggcttatttgataccttacatccggcagaattgcacaatttatctagccgatggatcatatgtttactatgattgcaacaaaaaacggatcgctattgttaacagtggttatcatggattattacccgacgatctccaggtggcggcgcgtgatgaatatgtaaaagtaaacgatcgaggcccggaatactttagaaaattatattccgacattgcaaaggcgaagagatccggcccggcatgataggaaaaatctttacaattccagggcttgttttcggtcctggtttttgttattctgtttttgaagcggcaacgatggacaccggaggaaagtcactggaggtgcccgctattccggtaatgagaattactctcaacaacacctaaaatcttatgcaaaatagtgaatatggcgagatctccaataaaatgggctagggtacagcctggacggaaaaccgcttaaaacgcgttacaggacgtttaaatgccatataaaaagaacttgacacgggaaaatggctaaaaagtaatttcaccatgaaatcaattgcatagcgatgcataaagatgcaaaaagtgaataatgtaaagatacgtaaaggtctattgacagcgatacccgcttatattattatttatttcgtagggcaaacaaacgaaaacaacttaacgaggtaaacatcatgcgcttaactaactttgaccgttactacatccgcgacgaacaagccagcgctttcgggtatgatcgttctatgtgtatgcagcagcacaaagaaggcgcacgtttacacgttgaaaccgttgcttttgaaaattatttcatggctacttttaccgatggtttacagatctctattgagtacaaaggcggcgtgatgacgcttgccactgaggacaaacttcgcaaaaaagatcttttgaatcacccaggttttgcaatcaataaagaattattaatccgtgtttatatccgccacgttgtaggccgcatcgctaacgaacagcagatcgccgcccttgttgatctggccctaaatcttgatttaaactaattgacaacggggccgaaaggccccataatacagactcactaaacaaaacgaggtaaacggaaatgactaaatcagaattctttaaaatgctggataatcatctagaatcacacaactacactttcgatcattttggaaatcgaatcaagcgagaggatcgccagtatacagcaaacgagatcgaggccttcacacatagcgaaccagaagagaagatcgtgaaacttaaagcggcggattcaaattatccttggatttttcattcttccggttggtgccttgcggattgttggtatatcaccgctatctcacatagaacaaaagcggcggcagaaaagcaacataagatttttacccgctggatcgctgagtataaagagcttaacaaataatcaaaccggggcgctagccgccccgctatcctttgaggtaaagcaattatgattaatattagtgttgacaagttagccgaaatcatccagaaggcaggagatgagaaatacggcgtaaatgatttttatttcatcgggcagtatgaggacggtcgctattatggcgtgttgtctaacaaggtgaaaagccgtagcagcgccgcacaattgcgccgcccggagtttttagaacaaaagggccttaaagtaataaaagtaatgaaacgcaaaaaaggttgatgattatgaaaactgtaaaagcaaaagatttaaaaggcggaatgatcatcgaattaccggacattgcaccaggctttaaacctggtttagtgactatcacacaaatagaaatcgaagcgccccacattgtggaagtatctttctattacaaaaagcgctatatggccgacctttatcaccctgaggcggaatttaaactaatcagtgaatgaggctgtaaagaaaaggcaaaacgcttgcctagccagatgttttcgactattatttatttcagggcgggaagataaccaacccgcaaaaccgaaggtaaataaaatgtcaaatatccgctacaatatcaaaagcacttcaaaaaccggttatgtgtcttatgttcgtcaggggtctacaatggcttggacctttgaagaatgtatgaaaattgttactacgctttcaggtgatgatcgctatatgggcgttttatttgagattgaattagcttaaacatcggggcgctattgcagcgccctttttcgtgtgttattcttttacctccctcattaaacgagtaacaccaaatgacaaacatgatttacattgtaagcaaaacaagtcttttacgcgctaccctgctggcttgccttattgctttagtgtctaatacgtgttttaactggctggcctgtctggtaacgacggaaacaatggcgcaagggtttaacaccatgatcgacgttttacaattgacgtattacactctgattaaacttaatcgctttaagcgcttggaccgttatgatctccctttcttgatcgctggcctgctggctatcgcgctgtaaggctccactactccccaaaaataatgccgggcaactcccggcttttgtgtttttatgtgttaggttttatcaatcaataattaaaaagtgataggtgactaaaacctgcataatcgagatctcccagcggtaacccactagccagggtaacctataaaacctctcagaatggcgcatagcgcgctcaaaagggtatggccctacctaacaaccccaacaattaataacgaatgttattaactgaataaaacatgcatttttaagcattatgtatgcatagtgtgagaatcactctcaaatgataacttttatcatctaacctattgtgtgaactggttttattgagcataaaaataaaatcttgtcaataaaaataatcgttcgcgtaatcgtggggagtggcgcgagcgtagcgagcgacacaataacacgggagtaactcaaatgataatccttatcattttcgttcgcgttatcgtggctcgtagacgcctaagagcgaatgagaatgattattatttaaaaatactcattcactttcagtgaatagttacacaatgaaattatcacactcgccacgataacaccgatcaactaacgttgatcgctcccgtgttattgtgtcgcgaggtgatgaaagtcaactaatttttattagcaataaatcgccgttaatggttgacaaaccatgattaatcgatctgtaaataaggccgctggcctgctgaaaggcttgtttttgagcacggaagaagtgtaaactgtcaagtgtttttattatcgaaaatatctatcaatcccttgcgtagcaataaagaaaatagttacttattgtaactatttcaatgctttagcattgccgggtatccggtccgtaacggtgttgatgggaattagtcacaaatgataatgatgctcaaagaggatgtattgctattgattgctaaacacgattctcttctcttgtcaagcttttatttataaatttacaaaatatttatatttgcggaatgattctcatttcgaaattgaattcgaaatcgaaataataatgattctcattcgtcgtctcattcacaaaacaaccctataacatgaataatcacacatgaaactatcaccacagtaacagtcacaccatgtaatgacctgaagcggctggcctatgcgtcacactggtaacattgggacattattagcttgctatgtgttgttagctagtgcgtataacgtgttttatgttaaatggcgtaattcatataaatataaacaagtcaatagcaaatcgtgctctaagctggcaaaccatatgcttgctatctgtcacatttgattattattaatttcggcaagtaactatcatgtctgaggaggccccgaggaaccgggaaccggatcggccttgcccatgatattttgtaaagatccgtaaaaatatttgacgcccggagctgtacgtctagcaccgcagatggtgagaacaggatatttttcggcaagtgatattttcggcagggggcctgttttgatttccccacgggggcgggggtggttatacggggaaagcaggcccctgtttacggcatcgatatatcggggagtcacttcagattgtatgttaatgagatgtgcactattcttggcggtggtgttgctttggcaattacctgcaaagtcagggaaaagggcttgcctttaatggtcaaacagtttacaatcgtgggacgaaaacacaaggagagaaaataatgacagaagcctcacatacctcagaggttgtccgagagtggacaaagatgttgcgtatcgcaaaggatacagccttcacccctgttatgggtcgtattaccgatgaggctgcaatggagaaagcggtgaagaccaggacacgccaactctctttgcttttggaaaaaagggagattgggagctctaaagctctagaagtaaaactcctaaaaagtcccgctggtattcacgatacccctgtgcgaattacacttccctgcggttcatgcgtcacacttccccttgacaactttttgtgtggaagaggggatacttggaaaagggagggtgaggttttttatatttttgtgtgtaccacagattgcgggaagaagtttctaaagtacggagtgaccagtaagctacagacacgatataaatataaaaacaaaggtgtccacatggatcttgtatactctaaagaggtctcttatcgcgccaaatctcggtacatggaaaggattgttcgtcgtaagtttggtaagggagttgtcgatagtcttaccatgccggatggccattctgaaacactgcccgtggaagtccttacacttttaccttttgttatagaggagatagatgccctattttactgtcaaaacccagaggcctatgaggaacttctggatttggggtggcatcccggaagtagggaggtaatggatatgttatatatgcaggtaattgactggtgatgccgaggcctcctctgggaggctttcttatgtttgcggcgtcgccacgttttctgtggtgtatctaagaaaattacaaaatacgcacgtcacgacgttgcataacaatatggcagggggtgtcgcttacgcgatgaactttcgttcatccgtataacggtcagaggtggcgatacagtcaaacaatctgggcgttagatgcccggttgtgattgttgaatgagaattattcaattctcaggtacggagaacccttggtgattgtttcgtgcagcctcagcacctattgctgtgtacaggataacagggttgcctcttcaggtcaagcgtttgaggcaatgaaaaaggggcctcttcaggctcccttgttgtgtgggtcagatattcttgactgcgatcagtgttggaacatacgtacatgttggggagtacggagtatccttcctgcgtagctgtgtcttgcacagagaagcatgggattgtgtgtcaacaggctcacggtcatagaacgggtatccgctgcacatgtacgggcgatcctcgtatattgagcacttgttgtctttcagctttgtgcaggtaaagtagctggtgaagtgatttgttcctttaccaacttcctcacgacctgtaacaacaagagggttccgtctgtatgcctcatccctggagattggtttcatcatctccccgtggatagcagatattcttccggccctgattttttcgtggaagtcttcgtgggtgatgttgtctatggcaataacttcacaacaggcactgcaattatggcaatgttttatcatttataacctcatccaagtttgatagtcagcttctgtgtggtgctcatcccgtgcaaccttttgtggtggagcagggttctttgcagcagcttccatgattccccgtgggtcggggtcttcaatcaggtgtttgtgttcatcacaggcgtaatgcttgtaccagtcacgcagtccccacggtggttggtatttcgtcataactgtgcagcgcctgcggatgccaatggctttgcagaatttgcagtaggttataggtttgcacttcttcagcgggatatgtttcattaataataatcctcaggtccacccatataccaggagtctggtgcatcacccagatcagcctctccccagtcacggctctttttgcctttggtctgttcctttccaaaaagagcagccccgtcaagaaggtggcccatagctttctcgccctttttggcgatccttccacgggcattccattcttcaaatgttctgtaggccataattttccatcaccaaagaattacatagttatgcttcaagcatctcttcataccatgaaggtcggcctgaatgcacatgatgaccagctcacgatcgaaagatgtcatgccgtcttcatggcaactctttacatagttttcgatccaaacttcatctgttaacagcgcctctgtggtagcaatttcttgctttatccactcacgctcttcaggtgttattggggtccccatccttgcatccgtaaagatattcatggtgtcatctcccaccaaacattgaacatccatgctgaaagaaatgcatgggcaatcatcatgagaccagggaaaacaaacggatcttcttttttacgaagcaggagtgttaatccctgcaacccacagcaaaccgtgttcaaaatgaacaggaaaaacgtaaatactaaagcaagcatatccttactcccaaagaccaaagtgattaagtaccgcgatgatgagaacaatggctacgactttcaggataaaaggcagacatccgaggttctcataaacaccgcttctttccgcattgaagtgatcgcggacgatcgctctcattatccagaaattcatagctcctcctcttgattagataccctgaggatatattactatccatgaggtgtcaaggctcttttccaaaaagaatacgatcatgaccaacaatagctttcgtcttttctttcagagcgaaccgctttgtccagtcaaccatgtcctgaatgtaccgacaagcctctgccgctgcacgaatattcgctacatatttgagtgctccctgatacccacaagaaaaaccctccacccaccggataccggggcgcgttgtatcaagatactctaatgccttcttaacattttccatcatcaacctccaggagatatttttgtctacgtcgcactctcacatcatgcatacctgtactgccgagaagatttgcgatcttccatgattttacttcaggaaattccttttttaccacaccctgaagatgtttgtttatttttctacgggtctccactgcacgtttataacctttagttttgaacaggctacaccaggtgtctctggtatttgcatcgatgctgaaacttctcatcactaattgaaagatccgtttacggtgacccgtacatgtctcatcgaggacataataatttttcacaagaactccttcacaaaaagatcgacggcaaaatccaggccccggcgtagcgggggtactggatttggacggcgcggcgcttcgcgcccatatgttaacgccattccagcttcacgcaaccgtagccttcacccttgcattttaccatctgccgaagggcctcgtcaaagctttctccctgccagaatacgtaatatttatactcaccctcgtgggcgtttgtccagtattgaacagtaaaagtgcttcccatttagtcgcctaatgattttctaatagccgccaaaaacgatccaggaaaaggttagcccagaatgcgaatgctattccaaacaacaacatccccaagaattcgcgaaattctgttgtcagtaccaagccagtccccatgataatggtcatgataacacatcccaaggttttccagatttcaatcataaagcaccatcccagatctcaaaagattcactaccaagccgggggaggtcatgctcatgaattggacaacaacgaaacccttccagcaggcacattttgtctaaattgtaaacaagatataaactgccttccttggacatgtagatgtaaatgccctgtaaccacttcgggtccctgaagtaaattccattgctccgagatttcttcagagcagactttatcaaaaccaaatcatcgtaaatcatatttttatcctcattaaggcttggaaggaggggctggtggtggacctgggcgcaccattttagcagagactgcggagataatctcttcccgtgttggatagtaaatgcactcatcctctttttcctggacgtgctctgcaatctttgccattgcactttctttcgtcaaagaggaattccaaatggttagccacaggaacccaaagaatttttcctgcacccaccaacgtccaccttgacattttagcctaaatttattcatcgtaagaaatccccttaacataacgccaagttttacggtaatatgccagccacttggcaagttcgtcttcaccgacaccagatttgcacaaataccagccgttgtcaacgctcacccgcccatagatgcagaattttttcatgcgcccctcttcattatgaaatcgccaacatacaaaagctcatcgatagccactgtcatcgctgcccgatttaatgagcctctctcaaactggtctctctttttctggttgttggtgacggctttaacaatatgctcaaggatttctcctctttcttgtagcctacccatctcaatcaggtccttctcatatctccccatgatttctcctctgaaattgtttatcctggcattatgacagaaagaaagacagtgtcaaggattgcatttcataaatcttttttatatacttcctgcataagttctaaaagggggcagagtgaaattaacagaagagcaatggaaagaaagagtgacgttggcagctaatgaaaaaggccacatgttcaatggttggtatggagaatataaaaggcaaaaaaccaagttaagattgtactgctcagagcacggtgaatggacaaccactagtattgataattatacaaacaaaaagagaacgtctggatgcccagagtgctcatctcgttcaggaaaggagaagctaagaggaaccacgaaaactttcatagaaatggcaaaaaacaagcacggtgataagtatggttactcgaatgttgactataagaataaccgtttaaaggtctccatagattgcccccttcatggtccttttatgcaagcgccgaaggagcacctctctggtaagggatgccatttgtgcggaggaagttacaaaggaaatacagatactttcataaagaaggcaatagaaaagcatggagagaaatatgactatggaagagtaaagtacaccaaaagcaatagaaaagtggagatactgtgctcagaacatggccccttcagacaaactcctagttcacacctgaatggtaatggatgccccagttgcggaaaggtaaagtatactctcagtctgagaaagtccttagaagatttcgttttacaggcggagaccattcatggacagaggtacgattatagctcaaccgcctacactaacagttcaaaaatggtttcaataagatgcaaacatcacggttattttgagcagttacctgccaaccatcttaagggttccggttgccctttgtgtgcaggacatctccaaaatcaggcgtacatccaccttgtcaaagatttagataccgtgtgtgcattaaaattaggaatagctagagattggctcaaaaggatgttgcaccaaaacaaaagaaacactttccaagtagaaaacgttggtgtttggcagtttaattcggtaatgcgctgtaaggccgcagagcgcgaatgtaaacaaaccctaaagacaggtgtccttaatgagagagagttgaaagatggttggacagagacagtttctgtgttagacttagaaaaagtcatcgccatttatgaaaaacatggtggaaaaagaatcaaataggagataaaatgtcagaagaagttcttgaacaagataagtacaaaatttacgaggtcgtccttgtggacggtaaattcgaagcaaccattcgggatatctacaccagaaccgtccgtaaggacgaggataccgttgaggtttatgtgtcttatcgtcttcacgagaaggattggtggtggcaggaaattctccctcaccgtgtacaaaagttgaatggcgaacttaactttggagataaaaaatgctgaaattagaagatagtggtatgcctgatcgtaacgagccagaccataaggtttgtgttgattccatctgcctgctgtatggattctcggaggataatatccttaatggaaaacgctgtcttgtgctggagaagaccatcctcggtctaaatggatattaccctcgtaacgaatcatggtttctttgtcacgttgatggactcccatatctgcatgatatccgatctgatcacttgatgcacctggacgattcagatcatctcgtgatagaaaagctatccaaaggtcaataaaaaaaaaaacccggcaatcgccgggtttcttctatacatctttcaaccattcattcctttcggtataaatcatacggtttttcttcttcctgttgagggcagcaggtatcacttggagattatcaccacagttaaggccggacactttagttgccctaaggggaagcatgtggtctggttcccactttattccagtatcttcacagcgaacagaacacaagtgatcagcctcatctctgacaaactcatcccactcactatggagggtagcacgtttctctgcttcaatacgagcaagacgaatacgtagttgttctgctttaccttccggtgtggaacgccgctgacggtcaatctcacgacgacgtgcggcatactgacgataatactcctgacgatctctcataagaatctcctcttaatgcaaggtcagaaataccgttaacaggccgtagagaactgccgccagaagaaaccagcggttattggaatttctgaaccagtcttttactcggtattttacacctagcgtttccttgtgttcactgataatcctatccaacgatctatagagatcacgaatagaggcttcgaacccttcataactatcaaaggcctcttccagatgttctggatctagcttccccatgtctccaacacgaaaagtgtaagttgttggtcttatggtatttgaacctctagtgacgtccagactaccaactttgatagaaaaaaggatgccgtttttggcatcccttatgacgagaactcgttcttctgtcacaggctcccttacgagagcgatgcaaccttttgagttttctataaaacccttttccagcagagtatgccagtgctctcgaaggatagggtgttcacgtacaatcttttgaaacatactaacctcctatcttaatgatagatccattttatcatgaaaaacagggttatcatataagatagggacgattcagcacttaaaactgcacttgggacaaggacaagagatgccgtggaagcataaaccagtgccatcttttctaacaccagtgccaccacaattcggacaagagtcatgcaagcacttcacagttccggtatcacctgaagaaggccatacaactttctcgatgccttgctgggcatagtatctttctctcataatctttgcctgttctggagtgagaagaccataactcatactgtataccccttacattgtagccaaacaaagaaatcctccatccaatcttcctgatctctggtgtcgggccagttctcaggctcttcggagagattcctgtgcattttatattctgattgccattcggaaatcagttctaccattctacccataaactcaagctgtcgcatttcttctcctcataacatagtggattaaggccccgaagggccatgcaaaaccaatggcaaaacaaatttcagaccaatcccgatccgtcttggccttatagatttgcttaaggactgtgtccttttccatcctgattgagtataccacggctatgattgaatatgcaacaccaaatatccctaccagcgcttcaatcataccagtttactccaacacatatcttgagccgtcatgagaaccctagcaaacagatcgagatccgccattttaggaagctgtgtctttttgtacaaatcctcacggatatagcgatccttctcatcagcccatgagagtagctcatcaagcgtccacttacctgcacggatatcgagaagttcctgagcatcaggacgcttcacgaggaccttcccatcagaaagaatctcttctgccatacgcatcaggcgtacaaggtgcatcgcatgtttcgtgtcataaccaaaatcaacttcgagctggtgacgaacttcatttcggttctgtttccatgtccaatagttacgatgcttctctttggcctgtttgtgttcctctgccaaatatttgacaataaagacaggttttctccgcttgtcagagtcagaaagttgctgatagtcaacatggcgaattgaaccgtcagcattgaacatccctgagctactgaagttttccatcaccccataaatatcgttcccatagggcacaaggatgcacatatcgttgagattgttcattgcttccatgaaacgatcatgtttaattgccccagcaaggaactcgttctcactatagttgtgaactaagcggaagaactccctttgtgtaggctttgcctctggctgcggattgctgatccacttatcatgaccgcgaatacgcttcaactgagccatcgcatacccagagaaggaaaatgccaccttgctggtcagcagtgctggggccattgtgcgaagatattcataaacttcagaggtttgcaggatatccttatcatcgacaaacattagttcaataatgttgggattcatttctgcaaacaatttcatgaagtttgtcagctcataaatcttcccatcctcttcatctttcagcgtctgctctttgatgttaaagaacggagtgcgaatgaatttaggaggggcgcagaacagaccccggatatccacatcactagttggcagatttgtgccataagctaggctacctgagtagcatcgcatcacttcaaaattttccatcgtatctccttctgccttgaccatgctattctcctttcagtcggaaagatttgatcatggtaatcaggtctttctccacttgggtatagttgtggataacatttcccatctcatcacgatactgattcgcaatttgtggacctgacagttgacctggtcggtatacgagatctgtaacttccatgtattgtggattgtacatatactctggtagcacaacagcaactgccgtcattgccccgttaagagcatccttttcctcgcagaacgaggcccacgggtacgtagctgaaacagggatcagcttttcacacagggattgaaggcttgactgataaccgccattaagaacaatgatagtcttatcttcatcagcccattccaatactaacttacctgcctttgtcttggcaggggtgtagtcacggaatacctcggcgatcgcatgagcggactgaattccggcatggatacctgcaatatattgatttactacgcaatacatacgtgtcttcattatttctttctcctgtacacaactgtcctactattcagatgcttccctacccaaccacaaatggcacataaaatagctaaccaccaaaaaacaccgcaggtcagggaaattaaaatatcttcgaccctcagtaaatcttgttcacgaagggtgtgataaattatcgctcctgctgtgatgataccgagacaaatataaataatggcaaaaatcattttcctccccttcccttcacaaacttaaccagaagaaatatccccaagcctatggccgcagttatggcaaggaatataaatgcgggaagaagcagaacccccagccctatgattaccggaaggaataaaccgcacataacagctataaacgctgggattccatatttatcccatgtggtgtcgtcctctgcacgataaacgagaccaacacacaatccagccaagacacttagaatgacaaccagcaaggctgcgttattaaagataaatctccatacagggagtacaacgtcatcaagataattcatttttctatccttttttgaagaactctgtgtatttaaacatagcacccttgtagcttggatgcaagcgataattacaacctttttcgatacaccagtctgtggccttgttacgcagggctactaaaccgcaccatgcacaaacttgcttccctgcatgtttgtctagaaagaaatggtgtttctcgtaagtgtattcctctttgtccttaggcattattctgctcctccagccaattcccgagttcatttctggtctgtttgaaagactcaagttcaagcagtttttcatctttttccgtgagcctgtctgccaggttgaaaagtcttgctaacgcatggttgagcagcgttttctcaaactcagtcgcccaagaaattcctttgaaactgattgagtgatgagtcccatactcagttatatcgaagatttccaccttctctatgcggaaaggaagctctccatttctccacacaagaaatttccttttcccttcatttgtggtcctaaagttgctcgcctctttttccaagaacttaaggaattcccaagcggggtagtcacatctcgccacaagtcgagcatactcttccttcgcacctacagtattctttagaatccgccacaagttaaaatcttcgtgacttacaagtttcatggtctctccttaagaacattacggattgcatcgatacgtgcaacacggatcgcctcaccgatctccttaccgcttttgcctttctccagcattgcgaaagataccgccttgctatccgtatttacaaccgcctcgaaagcatcaaggagaatttttccttgcgggtattccttatctgcgtgcgtggcaccacgaccacgggcatcgcagaaacaagcgtctgctaaggcaaacaccttgtcctgtgtcttctgactagccacgttacctgcggcttcgaaaagcttcatcatggaacgtggcttgattcctttattattcccacggcccaaaatgcaatgcacacgagtatggtgctctgtcacgtacagtgcaatatccctgaattcgttaggaactcgaatccgactgcacagcgtccgcacaggatcaagaccagcctcttcatgaccgaggagattaccgtacttacggaaagtgatcgcctttccaaagtcatgacacagcaccgcaaatttcacctgaggagagcaaaaggttttatcggcctgttgcagacacatcaacgtatgaatgaaagcgtctccctcagggtgatgttctggtggttgctctactccacggagggcatccagttctggaagttcgcccataatcgacatgtggtaggcgtaattatggaagtttttggaatttaaggccttttccatttctttccatttccgctcagggctaatctccgcaagacggtgacgattattaaacataagtgtgtatgttttatggtcaacagaccaactctcacccaactgcgacttaagacggaaaagacgcagaatacgcagcgggtcatccatgaacgccgacgtagtatgacgaagaatcatattcgacaggtcatgcataccattgaacgggtcaatgataaatccagtctccatgtctttagccatcgcattgatcgtcaggtcacgacgcgataaatcctcttccagagttacatccgggctgaagaaggtctcaaagccagtatggccttcaccagttttacgctcagtacgggccagtgcgtattcttctttggtttcaggatgaaggtatactgcaaaatttgcaccgacctgtgtaaatccagcggcgatcatctcttcgtgtgtgtacccgacacaaacatagtccttgtcatgcacgggcctaccgagcaaggagtcccttacggctccaccaaccaaatagatcttcttatcttgcattaccattctcctgattctgtatagtcctggttatattcacagaaataacctttgtggtgagttcttagggatcttccttctctaatccttcccgttgccatttcatgcattgcccccaagtgtaaatcattgtccctgcaaaacttgctgaggttgaataccttctcttttctgccatcggggaatgtaattatgaagcttcttgatttcccgtgctctacattcctttgccgagacacccactctaagtttccaatccaattgttatccctgacgtggtccttatggttgacctcttcttgataaatacctccagagtaggactccaaggtaaagatatgggcctgcctacgtatttttctgcccctctcatcaattagggtataacgtaggtatccgtctggcattctttctggtttcagaaatttttcagaccgatgagaatacacagctccgaaaaagttaacagagtacaatccctccaagcccttaaccggaacaatggatctcattcttttctccttagaaattgtctgtgttgatgaagtgtataccgttcttcttcaacaagtcaacctttaatttccgtaaaagaagatcgtggtcttttttaatggaaataagggtattcctatgaccatctatctcatgtgacggcctcacatggaggaccttttcgcgattgtatgtgccagatgccgttttcacatcaaaattctcttgcagatcccccaaaacaacagtgtaatacgggtacagatcatatttcacaaatgcagttactttcatagtctcaccacatcacgtaagttttataaatttggggaagattgtttttattcatgaagatatcgtactcctcaagaccattttcaccttcaatgaaaaatgtaaactgaacactattccagccgtttccatgctcattaagagttatggctgtgctgctacgatcaatagcaacttcaagcacagagagaatttcttcctcatcatgagttttcaaaaactcttttgctcgtttctcatcataaggccaacccgcagtcgggttagtaagctttgcgtaaagattcattcagtaatccccagctcttccgctgaatatacatcgttaccttcgtacatatcattgccaatacggacaacaaaggtacgatcaacaatctgaccgaatcttgaagttcttgatcctcctcccgtggttaagtagacatcccgaagagtgcgtgaggtcccgcacaacgtatcatcggaatacacagccacttctgtcccggcagggattgctacgactgttgttaccctttgtccaacagtagatggtgttcccacagtttcattacacaggtctttaataacggtataagttttattggtcattgtatttctcccaagagttcatataagaaaccagatccttaagcgagcgtttgtcagacaatgggtaaataccgtctgaagggacgccaccagaagctagcattttgttcaatcgattatacacggcctcaggacgattgcaacgtttaattttccatcgctccccatccgggctgaaatctttctcttcacaagaaacatggatcaggtcgcccatgtactctttgaatttgatggtatgcataggacggtgataaatgtagaatttcatagcaatctcctctaatacgagaagcataattgaagctgtgcagggagtcaagtacaaaaactaaaaaacccgccgaagcgggtttaccatgtaatatacaatcgtgctctaatgccttgcatggagggttcaacttctacgacatcaacctcgaaacctccatcacgaagatcagcaataatatgaggcaaataatcaagcaggtgatccggcaggtctatcaccatccccatccccaaaagtcccttcttggcacattggtgaatcccctccaccatgttgtcgtacaactggttcatctcgggcgggattgctgcgtttgcgatttctgcgatcccccgcatcttgcttgcggcactcatcatctctcaagttctccttgtgcaattctttacgcatagaaatagcttttgattttgcatcctcaaatttatcaaaccacccaccatgataatcaaccccctcaagggtaaccttgaccttccatttcttgcgtaacttattgaaacttacaccacgcacaccagaggtgtttctagttgaagtttttgagttctgcgcattttttgaatggtcgctttcccttaagttgcttggatggttgtcaagtttgttaccgttcttatggtccagtatactttcgggccatcttccgtgatgcaggaaaaagaccacaacatgctctctgtaatgaagaccttgcaactggattatcctatacccagtcttcctgtttaatgctccagccaccttaccagaaaacaaagtgttgtgacggcgctctgttctggttagatccccttccaactttctccaataaacagttgcaccctctaatctgaggtatcttttaatggcttccatctggctgtgcccagtagatcggcttttcaagttctaacctcccatgtttgtcccatataaaataaccatacccagaaccatctgtttttccatcgtcggtaaaagagggcctcttggacagaataataaggtgatctaaagggttttgtttccaaaactcccatctcgccatactctcaaggaaccctaacctcaaaagcataatcacgacatcggcatcgtcaagtgcttttgtcacaaactcttgggccaatgaatatggcgggttggtgatgatgcaatcaacatgatttggataatcggtattgagatagtcgacaccttcacgaatttcaccccaagcagaaccgagaggcatgtgattatagaacctcccagacgctctacaaggttccaggtatgtccatgaggggttaatagggataacatccaaaagggcctgtacggcccattcaggagtctcatatacgtccataggcttgcgttcagatttctttttcaaagggaccatcatttcctcaacgtcttatgtgtcaaattaccctctgccagatcttgcaaaatgtttttgcagatagtctttatagctgctcccaccctttcatcttgataaggtgacaacagatactttttccttgccagcatcagtatttcaacttttcttttttgccaagaacgatgcgcctcgtaggcattatcgaaatatcccaagaattctctttcgccacggtttgaaatctgggccttgtatttaccaatcgccttattaaagtatacaccaagtggaaggtgtgaatccccctgcctatcgttcaacaaactatttaaccatgatggtataaatacgcattcctcagggccgtaggttttcccatctcccaaaaagtccttgtccaactctagggtcttgtcaagaaatcccatcttatttgggttttcctgcacccaggatttaaaattttcgaaagtgtgccatacctcctccacaacacaacctctgtagctgggatttttcaagagatatacttctgagtaacaacgtcttaagatagatgtccagagaacgtaataagggcatttccagagcataactttgttttcgaaagcatacacctttgttgaaggggccttgtggcccactccaaacaccctacgttccccctttttcttcaggggagcactcattactcggcattcccaaaggtgtcgatgataacttcacctgcggtcaggagagcttcgattagtgcttggcgatcacgagaggtaatctccagagccttttcttctccttgtgcaatagccccaacctgtgacagaatgctttgcagctcatcgatgttgaagatatcgaaatcagaagccttcaggtttctcacatctaacgagaaagtctcaccatcgacatgtaccttcaggacaacacttcggtcagggtctccagtaacggtgtcctctttctgggtatctttcacaccaacaggggttatgatcggatttttacctgatttcatcctttcgatatttttatcatccaagatcactgcgcgggttcgtttagtgatctcaacttcatccagccacacctgcccgccacctttgattgtgttgatctccccgtcggtcaatacacctttgtagaaataatcgattaagcgatcgaagtgttgtttatagaacagcacctgggtataaatattggccccatcaccaaatgccccgccctgatagttatggaacataaattccgtcattggggccacagtgcgctctttacaagccagccataagattgtcccagcagaacacacctgtccctctgcatgagtcactacggttgcttgactctcacgcatcgcgctaacataggccattgcgatatcgacacgtccaccgtaagtgttgatgataacacgcaccatatcgtctgggttggcttggcgtatttgttgcaatttattaaaatgatcttccatataatccaaatcatgaatatagatcacatgctcatgagagggcattggatagcagaaagaaccttccccaccaaaaccaccgccaaaaccaaagtaattctttttgtcgttattctgcatcttgtgtctccccattcgcgtctacaatcagttgtcgtaatgtatatgcattccgtaacaaccagtctatattgaaccctgaatcatcatccacaaggacttggtcgctgtacttaaagcacaggagtaccctcttggcgcgttctgaggctactgccgcttgatgcaacagcgtaaagtggttaagctcttctttggtcaaactcacgtactgagattttccatctaggtaaatcaaatgttccaacaggtcacgacgatccgggaacatccaagaggcatcccgctcggcagcggaacgactataaatcatccgggtaaagaacccgtcattcattctataaagtgattcagccacaacctttagatagagattgtaatactttgtcacctcggactcgaaaaattcaggctcgacgactccacaattcttcagttccatcagtctccgatgggaaagaatcccatgaatactaactgtcatactcctcctatcgagctataaggtacttaatacttccgtctttctcacggtgaccgatatctaccacatagtacggtccgaacttgtcaacgttcaccttgtcaccaacgaataactctctcttactttggtactcaatggattccaggaagtatctgaataaatcagtatcgtctgtgttacagatgtttttcatcccgccatccttgtaagtaatgaaaatcactttgttaccgattttaccaactgaccagccctgcccatcaactttaacgagacaataagaattattaagcttatcgcgaaatctggatgccacgtttttcctccaaggatcttaagaacctctccaacaaggctagtttatcaggtgtgttcaggttaagaacccgaactccgtactttctggctaaattaactgcggttgcagtacctcccttaggatttccgttcctatcttctttggcatagtacaaacaaaatgcagagggacgtgtatcgaggatattggcccccaagacttgatgcacattacgagaatggagcgcaaaagctcctctttttcttttaagagcttcaaaattaggatgaatctcctcaaccagtgcctcacgtacaaccttttggtcgggaatcagataatcaagataatctaaaggataatcccagaaatcccagagattgtcattgtcagatgcaaatccatcccaggggatatagatctccgccaaatgtgtacgatactcttcttgcttcccattgtcaagagattcgtaatatttttgcattccgacctggaatgcttcatctgctccacctgcttttccacttctcaaggtgaatccgcaccttgcaaggcggaaaccagcatcttccatgatgctgataacctcaggaggggtctccctcgaccccacgcctgtataataagccataatcctccgttacgaagccagtggagtatagcgtccttctgcacggtcggcgattaacgccttggcaatgtcacgaaccataccaccacggacgatgtcatcatctgggttgtcgaagtttacaatacccacacccgcgatcccgttccggctcaggaaatcttccacccactccagaccggagattccgtggatatctttctgagaggcatcccccatgaccacgagtgtacagttgtcagagatacgtgtgatgatactcaacatttcctctggggtactctgctgggcttcgtcgatcaggagatagcttctttcatcgaatgaacgaccacggatgctttccaactcctgaacttcaatacgcccattcagaccatctttaagcgcattgtaataggcaccgtcgcccatacgtttacggatggtgtctaacatgttacgaacatacgggaagagtttttccaacgatgttcccggtttgaagccggaggttttacccgtctgcacataagggcgagcgacaatgatcttgtcgagttcattcttacggagcagatcagcagcgtaggccgatgccaggtaagttttacctgtaccgaagataccttttgcgataacaatattgcaagtttgcaacttgtgaaggtaatcttgctgcttgtcattcagaggagtcagcggtggagcgctattcctttcctcatcgaatttagggtggtgcttggcttgtctctcagcacgttgttgctggcgaacgctgagtttggttgcacgagcctctttgcttcttcccatgtggttctccttaagaggttagaacagattttgcctttttgtagtatgcggttctttctgcgaggtggttagtcccgccatttaccagcttggtgattttggtgatatcatcagcatcgcaagcggcgttgatgtttctcatgttccagtaccaaccagcgctgtcaactgcatatttcggctgttcaagtaattcagggtgattgacgagatccaaccctaaggctttaccacaagctttgtagtttgcaagcccggtgacttggatcagaccacgtcccttgtacttagctccgtcaccatccttttctggtgtattgccaagtcgctttgcaattggtccggtatcatacttattaaagtaggcattgtttccaagctctctggtatacaggaactctgcggactccacaccgatttgggaaaggaatccggcaatgcggttgacagtattaataccacccttctcaaacaaatcattcaaaggaccaataaacttggcatttctgccagccttcgcgccattcggaaagattttgttgagttgttccagcgtaagtttcaaaagacctcctttttcaggttaggcctctcccaccgcctcttcaaaagccgcttcgagctgggaggctaccccatgaatcttgatcgtaatcttctcttggaagatcgcgtatctcagctcttcttctgtcaaagcctctgccaactggcagaccaatttatcaaacactttctgttgaacccctgtagagagagttttacgaaggcgttcttttttctcctttatttccttggcaaaatatacgtctttctctcccttcaccatgttctggagactttcaacctgcacctgcaatccagtagcaaaatccccgatcagtctgtcccacaccagagaaacaaactcctttgccagagaaggtcgtaagtcagtggttacaactgcggccttttttgacattagtaacccccgcgagcggcagcgtctgctgcaagttgctgaagttcttcatcagaagagcgtttattcttcggctttttgccacgcagttccagagccagttccttggtatatgccttacgcagtgctttcttactcattcgaattctcctctaaatttcctgccggacagatttctcggcaggattacataaatcatacagacagaaggttgctatgtcaacaggatttcatatgtttttgcacaaaagcaatgaagtcatccgcgccaccaatgtactccgttgaggagtccgtctcacggaaaatctgcgggacggtgcgagggataaccggggagcattgctctaccagctcttccttggtgtaattctttccgagtgtcagatagatatactcgatcccatttgcaatggcaaactccttcgcacggacgcagtgtgagcagttatccttaccataaatggtgaaggttgaattcttcagattcattgtttctccgattcaagaaggaatgtgaatactgggatttctgatgtgtagtcaacatcataccctttaactaccaagtccccaacgaaacgcatggattctgatatactgccaaaaacgggatacgctgcctcaacccttgcaggatggcctagcgcctgtttaagctttaatacccaagggctggtagcctgtaaatagattttagccttagctactccgtgcaatcgacgggaaatggaaattttcatatcacttgagaagcctaccacacgctcgcctccaaaagtaactaccagcttggacggatcgtatactacagattcaaaattggcactatccattattactccttaaaaatcccagacttcatcttcagcgtcattgactgtcgcattaagacgataatcagtgtttgtttgttcctgattcgcattctgttgcttggaagggttcatccaaacatccatgaacgggagaggatcacgttttggtgctacgaaatctttttcaatgccgtagtaatcgtagatcggagcacagttccagtcagtccaatctttcagcaatggggcgttcaacccgatgatcgcgcggccttcactgaagagataatcgccccaaccatattcattggtacgaacttcatccagaattgctttcagctcgtgtttgattgcgataaaactggccttccataccgggtctttcagaaggatatcgataactccgaaatccatcttggtatgcagcatctcatccaacataattttctgtactagctgccccacctggacaaacacaccctgttctgcaagagcgaacgtacaggcaaagctagagataaattcaataccttccagccccaacagggagaacatcgctctcaggattcctcgacggatttcctctttgtcaacagagtccgggtcaatacggtatcgagcaccgaggatctctaattcacgcatgaatttgacaatgacgccagagcgttcaaggacggcctggttgttctgaatatcttcaatgatctggcgagaattaggcagacattgacgaacaatatcagaatacgtcagagcatgtaggacttcaatctctgattgcttcatcatcatggcgaacagttcactattcgtgatgaacggtgcaaacagacagatgatagactgtgctgcaacactatcagcttcccattgccacatcagggtctgcaccatgacgtcgtaagtcgatttgctgcaagtagcaaagtcagtgatagactggctcagttcaacttcatcttctgaccagtcctgttctttctgctttttatacaggtcaaacagttgcggatactttttattgatggagtcatacatccccatctgttgaccaaggaacagtgggtagtccccggtcttatgtgcggtgttttctacgttaaaaactgccattttctctcctcaaaaacggggccgaagcccctacaacttataaagaacaactttcgcaataaggatcttcagtatccccggcgataagtggtgcaacagcccttgtctcttcctcagcttttgctttagcatgaagttcctcagtgagggagtctcccgccccaaccttggagttcaggtaataccatgtcttcatccccatcttcgtggcgcggatcagatatcccagttgttgtttcatggaaatcttaccatcaggcaactgggtatagtcgatgtaaagatccgcactaattgcctggcctgcgaacttctgaatgattgcatagatatcaatcaagtcattcgtatcgatatcccaagccgacgtgtaatattccttcagctcttcatactcgggcacgataaacagcacagagccttgaggagatttcttgaagatcacatggtcacgtaccggatacaggccatttgttgtgttggtagctaatgatgaactttcgttcggcatataagcttccaagacactgttacggataccaccattttcgatgatttcctggcgcaaagtttcccagtcctgcttcaggctcggattcttcacgacactatcaaccgccttattataggtatcgataggcaaccaaccctgcggatacttagtcttattcatccacggagcaacaccacgctctttagccagtcgcagacttgccttatgcagactgaagctatgcagttctgccagatcgtgaaccaactgcttgctctcaggagaaccatacgcgactttgtgtttcgcgatgtagtgtgcaaggttggtcaggccaacaccaatcgaacgacgagattcggctgtgtacttcatgttctcatacggataatccatgatatccataacgttgtcgatcatcaggacggtgtagtaagcaacatcctcgtattcttcttcggaaacacgaccagcaaccagagaggcgataaagcacaatgcaacttcaccatcatcgatggtcgggttgaaaatattgcgcatatcagtatacccttttgttggcagacagatttcttgacacaagttagatgagtaaattgtctcaaggaatggcgtatgacggttcatttcgtcaggccagtaaacataaagacgaccagtttcagcacgttgagtgatcagttccattgccagatcacgagccttcacccaagtctttggaatcttagtatctgctgctacacgggcaacctcagcatcaaactcctgcattgtcattcggaacataccctcatgtaactgaggagcatccttatatgacaccaacatccagtccagattcttagctacgcgattcatgaacgagtggttgacaccaattgaatagtccatcgtgttgatacgctttgaggtaaccgtcatcggattacgcaggcgcatcagttcttcaacttgcgggtctaacgcaaggaaagacaccgttgcagaaccaccacgggattgttgacgattttccttaacaccaacatcaattccacggtaatacgggagtttacccatgtgtttgatcgtattgtcacgaacaccatcgccgatagagcgggaggacaggtaataaccgatccctgcctgtgctactgtcatagtgtacgccacttcacgggcaacaccaatacttttagctgtatcgtctgctttgataatgcaacaggatgcatatccagttttaccagtacgcaacccattcaggtacggcgttggtgcattgaccttaagatcagagagatacgtatacagtctgatgacgtcattcttcctacgggataatggcatattcttcataacagccatagcaatacccatgaacatcatctgtggggattcgaacaggatatcattgatgttatctttgataccatacttatcccggaactgtttcagaaccgcatacccataactcaggtccttactgtggtcaatgacttgatcaaagcttaacagctcaggtccagtataacccatttcttcccagtacccgcgcatcaccatgtcctggtaaaactcggtaaggcttgggattttcttaaatccgccaaaagcttccttgtagatttgtccaatcaggacgcgcccagccatccttgaatgggcttcgtctttacgactcacacaggcgtcgatcaatgcctggttaacttcacgagtggtgcagccgtcatacagtcgcttatatgcatccattgagatatacgaccagttaccattaccgtcatcaccaaagatagcggccttgtttagacgttctggttcaaatggaaccacactgccatcactcttcacaactgtattgatcaaactttccccttattcttcttcaaattgagacaaaaacttatctgcctcgtcaacatcctgatcgtctttctcgttttgatctggcgcaacgatgttaactattttaccagaaaactcatcatagtaaacatcgtcgtacattttactgtcatcggttaaatcgttgaagtagagccacccggcataatgatgcttatcatcgaagccacggtctttccatttcgttttttctttactcattcgtcctccaggccaaatacatcgcccagacgagcttcgtcttcaatatcgaaagtgatttcaaatgtctctggtcgatcccctcgcttggtatacttgcgggtgttaactttttcagttacagggatgtcgtaaggaagatctaaaacaaattccatatcactgcctgaataaacccctacatcaaggatttcaacaccgttgtatatcttcgcgtatttataatcaggtcgcatttctccgacaaaaatcattgtcttacgatacgtcgatggcatgttggcacatcttacatttttgttttggaacacagttacgtgtttaggattcccatctttatcggtaacctgaaaaccgagtgcgtataaggcagcgcggaggtcattatctttctgaacatcaaatcctgggaccgttctcaggaagtcaatggtgaccgaaatatgttgtggtggcttgcgtttctctttactcatgtaatctccattctgcctgacaaggggcaaaatcgcccctaattaatatgcttctaagatacgaattaacgatatctttgtcaacctgaaattgcattgtcaggcactaactggcgatgttgtcgccaaccacgaaggttgccggaccaaagttgcccttgacgatctgagtgtgtgataccttcttcccaagagcttggatcacggggaaagttaatatgcccgatagttaaataatcagagttctcaatttccctgtattctgtcatgggtgtggcctgatgttcgaatggtgaggcatgaaccttgttaccactcaccaacttctcgtagatatccagagccttttctttactcgtattcagaacacgataagacacctgagcacaacaagatgcggaaatagccaaagcctcttccagggtcagcattacaggcttgttctcttcgtcaagaacgcaatagccttcaaatactgcacactctttgtcgtcgatatcttcaaagccataaacgtggtcaacgtatggtgtatgccactgtcccggttcaagagggtctgggatagagttatcgctagcctctttcattgccttagccagttcatagatcgtaggatcagcatccgggtcaacacgcaaccagaagaagttattccagtctgtagcggtgacaactgtcttcattctttggtatggttccagaaggcggtttgcaatctgcttgtgataacccgcatctgcaaattctgctgcaaaccgggatgcactaagtcctgcgagtttccaccactcttctgccgagtacccatcaccaagctttgctgagtgctccccggcatcctgcattccaggttggttcttaccaaacttcacaggcattgcaggattttgctgaacctgctcgatcattttcttaatcggaatagcacgactgctcattgcatttcgacttaacagtcggtgagtcatcagctcactatggattattcgtgggtattcaagttcgaaggttatgattcgaatgcctgaaggagaaatgctgtcagctacaatttttacggaaatcaaattactcactcattgctcctaatttctcaataatcttgtcttggttttcagccatacgggcggcgacggcagtttcaactaacaggtcaagttcagcaagacggtctttgtatttgatctggggggtaataatctcttccagctcgcggagagagaataagttcagatagacgtcatcaaaaagacctttattaaaatccgcatcaatccccatgatatccgcagtcagtcctgtacctgggaacataccttcaataacacgattcacacgagccgttgcttgtgtacggatgtgttccgccatttcatcctttgtcattttccaaccctcttaattttgtagttaacatttggatcaaggtctgccttgaacaccaagtagcggttaagcacattcttacacatgtcgcttgtcgctttgaatgagtacacgaaattatccttctcatcgaatacttcgtaccacttaccctgacggacgatgaaatcaccgccctcgcatctattccttttcatcaggagaggtccagaataaagtcctgaatatgactccagtcggatgtctcaaggtcaatcgagactttcaactcctcagattggtcatacggagtccagaacttaatcttaagtacgtcatctccgaactgattcaggaattcattgcggtcatcaataatgacgtcaagcttaagacctgctttgttcttcgtcgcataaaaaccatgaccagaaccaggctcaaggctgaagaactcttctgtctcacgtttcaagaagcgtaccttagacgaaaagtgtccctttttgcagtatgatacaaattggttgaagtgaccagcttcagcaaatgcggccactgcttcaacagcgccagggcgtggtttcagcctatcgtacaaataaggatcttcccagaactcatacggaggtaattgattcaccttcgcgggtggaaaatatttagaaagattatagtaagtcttcccctgtgggttcgggggtggcaaactacagtctgcattaacgccatacatcagttccaaccaatgaagccaaggagtaccagaatctacaaaagttagatcgacatcaatacctatattcattggtttacgcatcatcttctccatagctaattgatctagcccactcaaggatctcttctgcacaatcgatcatagcgccctctttgttatcaaagtcacgttcatgacctcggataccatcaaggtataaccagttacgactgtcatttccccaatcataaccttttcggtggatacgtgcaaggaagaattcaccaccagtcgagtatgcataatcggacaattctttgatttcttcagcaaaaccaccatcagagaatacaatcacctcgtcgttggcataggtctgcttcagcttttccacagcagctttaccgaatgctgactttccgaacaacggcttgattaccttctcagagcaatggatcatccattcgcggggagaaacaaagaaaccgtctatcatcaggtaaggtgttggtttctctttgtagcggcgcgtatacagagagtcccatagctcgcgagagatacctgcacttcgaacagcgacctcaaaaaggagttccttcacctcttcgtggttgatgtttgggttacctttacaaaggtacgcagaaatctcatctttaccgctctgtggtggagcattcagaacaataatatccattagtaccccgtatactgttggagtgcatcaatgatctccagacattccccagcttggtctgcggggtcaatatccatatcttcagaaacatttataatttcttccacacggctacgaagatctctaagttggtctctcaaccaatcatcatctgcaaattcaggaatcttaatatccaaaatctctccttaaaaagggccgaagcccttaaagttaaaccaaaatattagacagtagttgcgctcgtttctctttcgagagaaggtttgttctcccacggcgctgttgcccagtaaccttgtggcggtagcgttgatatttaccaaggtttgtgtaatggaaaccatcctcgatccactcgctcatatccagaacaccatcaacataaagatcgaagttaggcagacgagaatcccacggcatgaagatttcgtacaactcctggttcgataaaacgtcgaacttgttatactcttccatctcatcccaagcctcggggttacctttcaggcactcatcccacagtaggtgtcctgggaacttagtgtgcttagacttcttgtatttcgtacacaggcgatcggtcagatattccagcttgttggaggtgaatccaaacagggctttggcgataagcatggtatcgataatacggaaggttgatggcttatccattccattcaataggaaacgagcattgaccttcttaatgtcgaacttacggacattatgcccaacaacaaaatccgcttcatcaagcaagtcccacaggtcttgaaggatagatgcatcactttccttatcgtagttatcacggatatcgcgataaatgacctcgtcctggtcagcccatttggctacgaaagatagcatgtaccagtcagaaaccagctggttcaatccaatcccgttctgccaaagactccagagatgtcccttcagcggcgcggtttcgatgtctaagaacaggattttagctttcttataatcagatactaaggactttgtcaaaggagtagactctgcgctatgacgcttaagaaccaaacggatgtatgactctctcgactcttttccaaggaatgtgcgagcaatttcacggttactcattccgctttcatgaagttctataatctttttatctacaggtagcattacacctctcggacgaattcaatgatatcattcacagcgaaatctctaaagtcttgtttatcgagatcataacctctaataaaccattgagagttcttgtgatactgggtagacccataccacatgacgggttcttctacagtacgatatccgcacttacctcgccaatttctgtaaaagaatttaagtggtttctttggcatgtttttcctccgtctgcttgacgaactctgtaaggtatagcaagaggctgtcttgtttctgagtaccttcggggataattatgccaaggtccgccttagctctttcaattatcttctcgttggtgcatcttctcaaaaacttcaacatatcgttcttaaacccgccgtgaagcggatagccactgaagtcttgctctaagtaatctgccaaatttctaagagcggtggataacgacgtctgagtattctctgaaacgtacttcatccaagccttcaggacatatccctcaaaagtattcacgcactgactaaggacacctctgcatttaccttcgaaatggtcatgatccaagcacggcttgcgaagtggctcgccgagtataggatctaacccttgctgctccagaatcaatttgtttctgaaagcagcaatctgctttgcatctttcacccaaagttccggtgttaatggcacaactactggcttcttccttgcttttggtttggatgctcgactctttattcttttcctacggatatatcctccaagaacttcttccctatcaaatatgcatctgcgtagtcagcctttccggcggcaagagtcattccgtcaagccaacctggaaaatcacaatctactgctctcaccatgtgcgatttttccattttaacctgacctgtggagtatacctttttcccggtctttttgtcaaccttttctttaacaactgtgcgttctgattcaggcaaaagtgctctggcataagccttcacagaggtaggggctacagtatggatcgcttgataccccaaaattgctgactgatacaacccgtacacaatacagtagaacagaccagccaaatccctagtggcgctgccgatagaactaaggctaagggcctccataacatatttgtcaatccgatgttcttcagccaaagtaaggattctgccaacaatgaacctaatctgttcatgaacattgtcaaaataaataacatccttgtttttcttgctcttgctattgtttgagcctgttctgatcatttcccggtaaacaggcactccatcatcgaatatgacaacagcacaatggctaagactctgatcaaccgacatcagcttcatcggttacctccgagtcattttggtccttgaagacaacaagcgagaattcttgagtgtctagcaaaacgcttgttaacatcaacagcttctcaccttctaccagctcgcaatcatccagaagcaatacggtgaatgcaacattcggatcagtatagtcatcagtgaaaatcacatagcaatcatcaccagactcaaccatgcgccacaatcctgtggcgactaagaatttacccttgacgctgggaacagccagcgcctcagcatccctcataactgcctgcatgattaagttatcaatcatataacccccacacggcgtaactcgcttgaaagggttgtcttatcatttgcagaacgtttcatgtagaccatctggaagatgatagatgcccactggcctgcactcattttccgttgtgtgccatcccacgaagtaaactcaacaccgttcgggaaccaggttttatactggttaatgatcgcttgccacatggatttctcatcctgaaggtgtccgatcagattgaatgccgccgtatcaccgaatcgtccagcgatatcgaaacactggtaaggcttgatgttatctgaactgtcaccgcaaagcatctggtaaccgaagaacttacgcccccatcccttgaccttgctaccttccatccagatctcacccatcgaatcgtcgatcaacatagggatcgggtgcttccatgtcttctcttctgaatcgcgcatagtatcgaagataagtccaggatttcctttctggtctttatcaaatgatgccacgatgtagttgaacttcccggtcttctggtaattctcccaccccatgtaggcaagaacagacaaataatcatctgcttcaacaccattgatcaccttagcgttatacttccgggtaacataatcccttgtttcctgaagaaggagtgggcgtaatgtatcctcacgattacccttgtaacgctctggagctgggagcataaggcggaagttaccctcaccaccaagtacacccatccctgtattgctttccatctcaaggtgttcaaagatagcattgatttttgtcttcaggatatgaaggcagttttctacaggttccggttcctgaatgtctttaatcgtgaagtcatccctaccccacggtacaaacactcggccttcggcctttgccttcgcctccatgttcatgttttggtctttgatccatccaccgacaactttctttgtcgatccccaaaactcagtcctgtttttgaaaatctttgttcttccagactcaatgtgagtgacctcaattgtacgcttttcagcaccagcggctgatacaaagcatgtctggtcgagatccaaagctaatacgcagtcttttgtgactttatttttccaatctttatcatacggatatcccactagccctctcaatctttactcaaatactcgtccaaataccggacatccaattcccacttttcgcgcttgcttcgttcatgatacaaatcaaacgcttccttaacatatttctctgccacagggcgactaacttcattcactctcataaagtgacgaagggcaatttcaccacgcccacggatccctgccaaaccaatatgcttgacttcatgacaggaaggacatagcgcgattagacctatcagagttatcttaccgtctccgaaattccacttctcatggcattcaacagggtgttttgttcctttgcccccgcagatttcacatcgataattggccttcgcataacacttctttctgacaacatcccactgggctttggggagacgagatcggagattagtaaaccacgcggtctttggaactagttcaatctctaatttcaaatcacctccacgttgcagcaacaacaatatcaatagctcgttcccagcactcaccgagaagattcaaaccacgccagttggttggatcatcgatacgtgtatcatattcgtttaatttaacaccccagatggcatcataaggagaggcttccacaaacttacgccctgcatctcgatgcccaagcgccgcttcgaggacagatctgttggccttcattttcaatacaaggcctgaagtcacaatatccatcctattctcttcccagacgttgttgtcgaaaccttttacctgacgaccaagagctttggcctcattcgggttatcaaccgtagcgatgcgggaagcaatttctttgtcatcgaagagcattgccttctggaacatcatgtaatgttctacagtgaaaaactcataaccaccacaacgaataggaataacttggcggtagtgattactgaacatatcccggtaagtgaagaagaagacgtatttatcagttactcgcatagctgactccgttttctctcagaatcctacgaagggagttaaaacggtcataatcctcagacattacttcggatggggtatgtccagcctttcccatctcatcagcagttgatcgtagtccgctgttaatatacggcacgagttctgcgataatggaggcaggtacttgaatcatcttttcagacatcatatgctccttagtggaaagtctttttagacgggcatgagccagcaccttctttcacaacactctctgtacgattaccgtcgctgtagatgcagactttggagcttccatcagtgtattcatccaccaaagaaagtgtgttgactgtggcgaatgcctggggagagatcagcgctactactaaaagaatttttgtgcggatcattttgtatctcctttcttaagttgagacccgatgatagtctatcaccgggccttttgtcaactcttacttacctgctggtaaggtaacgaatggggtctgagaaccactggtcatgtagactggggtcacaccgttccacttattgatcgcttccagttgcataatttctgggttttttcggagagaatcaccacgcagttggatagattctgcttcgccttttgccagtgctactttagcatctgcttcaccctgagcttgcagtcgcttagattcagcttcaccgcgagcggcttcgatctgtttctgagcttcagccttggtctgctggatttcgttttcacgcagcagcgctttctgagtcgcttcgatcttagcgttgatggacgcagttacctgaggaggataaccaaggtcatcagtgtaagacagtttcacaataacgatacctaccgggtcaagtttctgcttcagggtcttggtcactcggtctagaagctgagatttgccatcaccagccagtgtaccaatgtccattgtacccgcttccttgatcaacgcatcagagatattctgacgaatgttgacatcggtaatctcttggacgcctttacggtaggtctggaagatcttggtaaccttagagcggtcaacgtaatactcaacaccgatcttcgcagtaaccgtcatagaatctttggtctggaagttaaacggttgttcgtagttgttcaactggttgaacgtcgggaactgatagatctcttcgttccaggttaaccaatacttaccaacgcccacttcttgctgctgaacgcctttctcatcaccatacaggtcaaccttaacacccacataacccgccggaacagttgcacgttcacaaccagtcagaccaattgcacccagggcgatcaggccagcaaatactacgcgtttgatattcttaagcattagtttgtttctcctctttgattttatactcagtctttacgttatcatcaacgtggtcatctacgatttttgcaacataagatgccgcagacttacctttggactttgccaagtgctgcaacttttcccaagttgccgccttcagatttagcaacattatcgatctccttcagcgcttgtcttcggaatgaagaccttacgcaaccagtaccacacgacaaccggggcagtgaagactaaggcaaacccgccaataacactgattgtatctttggcagaaaccagagttggaacaccaaacccgaatacgacgcagatgaagacaaataggccaacaccattaaggtagtatttcattattcagtgtcctcagcaccatcatcggcttcagtctgtgcaacatttggtgttccacgaccaaacagaatgtctgcctcagtgaagacttctttttcagcctctaatgcagcagttttcttttcggcttcgaagcgaacatcatactcgcgcttcaccagactattgaagaattttggagagatattatgcgtttctttctcaacagagcgaatatctttgatctggtctttcagatcagcgatctgacgctggagatcaaccacttcagttacgctatctttcaggcgtttacgctgaactgggtcagacggaagagaggtgatcagttcgattttgatttttggcatacgtggcatatattgctcctttgtttagtttagtgtggtcagtataaccgttcagttttatttgtcaaaccttaattgtcgattccaacaatttttccgcccattctctcgatctggtttacatgcgcgaccagagtgccgagtgtgcattcataagcgtatttctttactccgccccagcgacgcttcatggtgaagcggataacaggacgggaagatgctccgcgattcacgattgtcattttaaggcgtttagccaaggcattaatttcagagtaatcaatattttcttccacttagttctccttttgtcttgatggggtcattatacagaccccgatgcgattgtcaaacaataatgtttggttttttgaaagttcctggcttcatgattttaccgcccttgtcgaagaatacgacacgaggttcttccttcatattcccatcaacaatggagaaatgaacaccttcataacgtccaccgttacgctgttcgatacaagtgcattctgcctcaagggcttttaacaagtcaaggtctttatgcaaagactgaacttcactaagtgttgggtatttagagtcgttagactcaagaacgctactcatgttcttatccaactgcatatcaagaccaaacaataaagccgtgctcaatttaagcatctcctcgtaatcttcattcgcaaaagcatccaaagctttacccggagaaaacttaagatcaggagtgtaagttaaggacagtgaatagttattactcaaccaataagcatatgacgccacgacaaataagtcacatgccccatcaatgacttccttgcggtcattttcgctcaatgccttaatagtttcttctaactcctctccaacaaactcccactgcttttccaatggtgtaaattcgccctttgcagaggctgcgacagaattccaatctacaacatgttttgcatacttaacaagtgaggttggacgcagcattgagttgagagtttcgtaagcttctttcattaaatctcctaaataattctaatgggagggatctccatcaccttgtggttgatcgcgactgatacctaaaggtaaccatgcccctgtcttactcttgtacaggcaggttgatttgtaccatgaatagctggtctccgtgttcgcagctatgccatcaaactgacaggtcatagtattccacaacggtttggtaagggccagcgttaccaggcacaataccacagcccaaattacaagcagacgtttaacctttccagacacccagtcaaagaagtcatcaagcttatcttttcggaatctgtaagcggcataaatgccgcctcctgttacaaatgatgcgcctagtagcgctagccaataccagatcatattactgtgcctttgttacgataatttgagtatcaggacgcacagggatttgggaaccatcgcctagagtcaggataacatcctctcccatcgccccagtattagttacggtataaaccttaccgcaatacatgatctcgtcacccttacggactgcctttgctgggtagttgccaggttcccgatcagtttcttctagcggttcatatattgcatggaaaatttctgatttgcaaggatagaattccccagctacacccttgatcacataatcaccgggaagaacagtcatcaccccttcaagggtttctatctccaagttcctaatgtcgcgagtatggatctctgaatccttccagacaccggtttccatccatttgcggatctgacctgcgcttgtagtcgacccttcaaacttatgtgcttcaacctctacaggttttttacgataaaatcccattagtatacaggctcccatgttaatgtatcgagttcacgaacgctttggcccacagggaactgaggaacaccatcatcagttctagcctggaacgtgaagttaataaacttacccaccagcaggagcattcgttcctgagatcgctctgcgtgggttcccttcattttacagttaaaacgtgtaccatctttctcttcgcagagtaatacaccctcaccgttcttatcttccacagaatcaaggactttagcctcaccgtcttggaaaagtttccatttctggagatcagaagatcgctgaccaaattcatagacacctttgaaatttcggatgatagcaccctcaaagccttgctgcataaaatgtccgattgattgcttaacctcatcctcagtgtcaaagacattcccttggaccacatttattttatctgctttaataacagaggtgaagtggtcagtgtccataaggtctttgtatcgacactccttatctgtatagtctgaaatcccatcgttaatcatccagggtttatttgaacacggaatgtcaaagatatggtactctaggtcaaggcttgaatagccgccataacgatcaacatctttaactggttcgatcgcgacagagtaaacatcaccatcgaaatctttccaactgtcttccccattgtcaatagctttctgatggcgcttcaggtcagactgataatccttttcaatctcttcttcaatctgctctggtgtacgccacttcttagcaagagcgacaatcttttgcagactcagaccatgaatgtacagctccccatcgaatttgtcaaaccctgaatgctcagaaagggatttaacctgtttagacaactcagaatcaagcggtacaggatacagtttgttaccacggctattgaattgtgggaagccatctgcatcaagagtaaccagagcacgtacaccatctagcttaggttgcacgtatgcaggataaactattgattttgaacgtttagttgcatcatgggccagcattggggagaagttctcttcctgctcaagcttacttgtatcatcacgataacctaggcgaacctgtttctcccatttggaaacagcctcagccaatgcctgctcttctgcggtggtttcgttagatcgtccaacgttcttcggttcgcaggtggtgaccttttgttgcttcttgccaccaactttaccaaactctacaactacctgattacccacaataaacaccttccaacactggaaagaaccatctttattaagggcgtacagtgtactgtttacttgttgcattatttctccttgctttgcaatggtgtcttaccttcaaggtgattctcaactatcttgataaggccgggattattaaaggcatcaacagctccggtacgatatacaagaacacccgcattctcatacatcatttgttcatcatacctaatagcaggattaacaacaacaactttggtcccccgcataaccgcagggaacaactcccagttgaagttaataactgtatttgaacagcctacaacaattacaagatcctgatttgtcaatgactccaaggtatcattcatagggccataggccggagcattctcaccaaagaaaactacgtttggtttacaccaatgaaattggtcggggtctacctcatcgtaaccgatgtcaaccaactgctcttcagaatcttcatggagcttgtatcgaatttctttcagatacccgtggatgtaaagagtatcttctttagggacacccgcacgttccagaaggtcatcaacgttagttgtcatgttaacaacctgccccggataacgtctgtaccactcagccacgcgaagatgcgccgcattcggatgtaccgttggtaactctgcacgacgcttgttataaaacatgtgcgttttatggtagaagttaccacggaaggcgtgtatgttacaaacctcctcaaggtcgtattcatcccacagggctttaccagattcagtatctgtgcggaatgtacgtacaccactctccgcagagaagccagcaccacttataacgataagacgtctcatggattttcccctataacattatttatctcattcatagcctcattataaccattgcaccgctcggtaatacctttcatataacgaattttattaagaactcgtaaatttgaaaacttccaggcttcccatgcagcagattttgcttctggtgttgaccaaggatcgctaagagagtcccaccaattttcgaacgattcccgtaggttatttcctttatacatatctttccttactgtaatttcaatgagttacgcagacgaagctcttgagcatcacgagtttcctgcggaacattgtgaatagaatcattaccatgcctattctcgaccaccaagctaataacttggtatccgtgctcatcagcaagggcaatgtagggttttagttccttctctgttgtcgaagtgttggatacgataatttttgcaatacggcacaccatagcctcacgtacctgttcttgacaccacttatgagcaacagccatgttttcaggcttccagtcgtaaaccccgtcccgataatggtatttatcggcctcaaacacaggccatgctttacccgcgattgtttcagcaactgtagacttaccagcaccagacacgccgcgtaagataatcagagtcttttccatctcttctcctcagtaattgtttcttaagatcgtaatacgatacttcgagaagctctcttttgcaagcatgaacttttgtgccgcataagggttagacgtatggacatagagtttagcatcatgcacaggaagttttccatacacaagcttctcttccaaggccaacaggcagtcatagccctccatttctgacccttccccaaggtcattgtcgaaatgccactctgtgacataacgatagaactttgacctgttgtccagaaagtccataaatttctgagaggtcttgaaccacaaggcatcaggatacccgtagtcttttggatctctcaggtcatcaagccagataatcattttggaaccccaacataaaaacgactaccacgatcaaacatgtcttcgatagcgaagtaatcttcaacaacctgacgtcgtttttgagaatccatcgcggaccaaacatctttagagtaatactcacgaatatggtctagcaactcgtaatactcttcgtcaatacgcttcttggcctctttcgggttatcccagatcatatcccacttgttatcacctccacgcatcaggaatttcttcgccaggtaatgtggggacttgattttcaaaagtagttcgctattttcgtcatctgtcccgatatttcggacaacaaaaccttcgtggctaacagcatgactggctgcaacgacatcgccaaatgcacggacatcccattgaggacgttttgcaccgatcacttcagctatgcgatcaagacgatattcttcaagcattttcccatttaaagctaagtcgcgcataccgatcaagtatgcaccttctttctcctcaacaatgtgagggtcgctactgtcacaaatttcaaagatgaaagtatagtcctctggaaatgcaacaagatctaatttcatcttttcaagatattttcgcgccagatcagagaactcagagtcaagcgtccctgttgttgaaacaagaagcttacctttatgaatagctgctgtcgccataaaaccgtttactttacggatacacacaacctcctgatcggggggtaagtcagttccattctcgaagcggttgaaaatcttagtgaaaggccagataatcacgttgtcttctgaatcaacaaccatgccacggcactcaagcaggcgtgggtcagtatgccacaggttatcccagaacacattgttattatacttcagcacagacagacccgcgaacgggccatcagtgtaagtcttcttggtaaccagctttttagcgaccagatcgtctacgttaaagcgcatgtttcttctccctttaggatgtcatattcaatttttgcaataatgtcttgcagcttttgttttattctaacatcatgttctgagattgcaagagattttgcatgatttatcttttcaatttgccaagctttatgagcatcggtttctgttctgaaactaccaacataccttcctttgtagtggcagtaaaatgtgtccgcaaggcgggtttctttggaaacccctatcatatacttaccatttttcttaacagatgaaaagaattgattacattcttgtgttacgaatgcacaagactctggtgagtatatttttccgtcaccgaggatgtccttatccaagtagaggccagtaacatctgtatcaccaacccacgaaatgaaattggaaaggtaataccattcatcgcatactgatacactttcataatattggtgtttcttgtgctttacaagacatcttcgcaacatattgcgccacttaagatatacaggatggaaaatcctttttccatcaacaaccctctgtgtaattatatcagagtcattgataccaagaggggagctaagatcttttttcataaccttccgcctgataatatgttgtattataaggggtttcgatactgaagcttatctggcacatctcctgagcaagatattttccaagttcgacagccattgataatatctcatgctcatgacgctggaaacgtggatactgcatcaaccgcacagtcataccatcttcgacaccacctgtgtaaacataggtgcatggagcaatctgcacacaagcaccttgcataacccaatggcgacacaaattcttggcctgagcataatccccggcaatgtgaatagtagcgaagaaagacttcgccgtgttacgtgctatgaaatttcgttctttgttatgcatcttattctccgtggtcagcagtgtagattggttttttgaggcacatcaggacggcctcacgcatcgtcagaggacgaccatgaacatcccaacctacatcgagaatacgtccaccgggggctgtatatgagccgtggctatgcccgtgcaacataactgacccgtggtgtgctttgttccacgatgcgaacggatagtgagacatacacacatgcaccttctcttttccagtgctgaagttaatctctttataatcaacaacttcatgaccgaattcacggaagatacgtttcgtatctcggttgtcatggttaccaccaacaagaatgatctttccgttgatcttttccagaatatcacgagtgcgtggctcaacgtagcgaccgtaagcgatcacgaagtcaccaaggtgtgctacgacatcatctggtttgacgtgcttattccagatttcaatcatacctgcattcatggcatacagactttcacggtcttctttttgaccgtacagattcttacggaatttatcacacgatgggaaaccaaggatgttggtatgccaccaatgcgtgtctgacgtgacgtggtcgatcatgtatcctcctgatatctttttacaagttcctcttgaatatgaagggtaacatcacgaacttcaccttcaaggtcgtggagcacaggacgaagaatatcacggatcaactgtctctgcgaaggtgttatcagatttgccttcatagcctctcggcatacttggaaagtagccgtgatgtttttctgcttttctttcaacattttctttcttctgtttagttttgcaagtctggtcattttttcttcctcttcgtagttttcttatacagacccagtgcagcattttcctgagcacatgtcaatacacgtgttaatccgcgacgatcaacctccggcatgttaagctcccaccaacccatccaatagatctgatcctttgtcagtggttccgcttcaggatctgcctcctgttcattcagtctctgtagagcatctttaatcacacccacatcggttgtgaacacaaatgcagaggtatcaaacttttccttgacaggtttcctgatatctttcttcatttcatatcctcagccgggtaggcgaacagaagtccatccctgattttctggtaatgttgccacacaataagtttcatgcacaccaggttaacgatatgcctatcaccatgaatgtaaactgaagcatccatccatgtctttccccagtctacccggctatctaagtacagtttcacaccatactttttctccatagacttcatgatgtctctcagagctagataagcacctttatagatggagtcatcacgggtaatgctcttcatatccaaaataatcctccacaatacctctcagagcctctgggaggccctatatttaatttaatatgggttggtaacccaagtgtactaccacgccattaaaacgccttagaagacgttctagagcgttacatggatttcacttagatccaccacaacattgttgttctcgatgtgttccacagtcaagccctttgcatatgttacacacacattacgtcgagctagtctcgactttattgaagcatagaagttatcgaataccttgtcaactggtataccatctggtaataccacgcacacattgtggtcttcaccacattcatgatacacttcacgtatcatcatcaacttggtcttctcttcatcggtctgctccggtttccgtcgtggtttaccacagaccatttcaccgataatttttgtttctttacttgaaaacataacaatctcctttaacattccctagattctacacgttaaaaagttcatgtcaacacttgacatcatcttttcttcatacgataatccaactcatcgagtcaccgactctatgatatagagtatttatactctgtagtaaaagatcttgttttagatcttatgttttattgtttttaaagatcataagttagtttaaatgataagttagtattgtattccttttcgggaataattagatattcctaatcgggaataattagagttgacagtattgatttagtggtgtagtctctaattatacctatcgcggaataaataggagatggtggtggagataaagattggtgacaacactgtgaatatcagagatggggcatatgtcaccattccgacgcagtggctttttgatgatcgtctctcaccccaagatttgcaaagattaatcaagctttggtggaggtatgattacttcaagagtctaaacccagatggtggcgatgaagttttttacccatctcaaaaatctttgtgtcatctgtttgggttgagcgaaaagtcacaaccgaaagtatcagagttcttgacaaagatggagtctcttggatacattcgaaggatacgttctggttttcaggattcaaatggtaatgcaaaacctagacattacataattgttaatagaggatatatgaaatgagtttagaacttcgtctgaacaacctagtagtgcctgttgaccactctaccttcaagggtggtgaggaaaacgtgaaaattgatctccgacatgcgccgaagggcagcattggttttgtggaaataactgcaaaaattaaaaattcttcagatgttatggccttgtgcatgttagttgatgcatgttctcgacttgagaatcttcatacaaatgctaaattcacactgaaccttccatacatcccatatgcacgtcaagaccgcatcatgcaacctggcgaagcattgtcaatcaaagtattcgcaagaattgtgaattcactcggttttgatgaagttattgttgatgacccacatagcgatgtttctgctgctttgcttgataatgtaaaaattcgtggacaagacatattagttgctgaattccatgaccaactggctggaaaagatgtcaccattgttgctcccgacgctggcgctcgtaaaaaagcacagaaggtggcagaccgtatgcgactacctttagttgaagcaggcaaggtccgtaatgttgtcacaggacagatcactggcacaacattcttcggtgatgtgaaagaccgagagtgtgttatcgtggatgatatctgtgatggtgggcgcaccttcatcgctcttgcacaatccttgaaagaaaatggtgcaaaacgtgttattctttacgtaactcacggcatcttttccttcggtaaagaagttatctacgaaggcggcgttgatgaaatctacgcgtaccacgactggaccgaaaacttttaattgacaaatgaataagcgggcgtacaatcgccctattaaacaaacaaaggagaaacaaaacatgcttaatcaagaaagtcctatcctgttcgctgacttttacaaaccttcacacatctccatgtatgataaacgttctgaaattgttcaggataacatgacccctcgtaatgcgaagcacttcatccacttcgctgataacgaccagcgtgtcatgtttgctggtcttcagggatttattaagtggtttcttatcgacatgttcaacaataacttcttcaatcttccgaaagaagaagcagttgctgattaccgtgaggtttgcgactccagcatcggcattggcatggtagaaacctggggctttgaggctcttcatgatctcggttatcttcctctggaaatccgtgctcttccagaaggaacgctttctccggttcaggtcccaatgtttacaatccagaatacgcacccggatttttactggttgcctaacttcctggaaagtgtgatctccgcagaaacctggaaaactatcacaactgcaacgacgttctggcagtatcgcaagctgtctgaaaaatgggctgctgagacctgtgataacaacgaccatgttgcattccagaaccactgcttcgcatatcgcggtgaagctggtactcacgatgctgcacagagcgagttcggtcaactgatcaactcaatgggtacagacactatcccagcgattctgtatgctcgccgttattacaacatgaaaggtaagttcgttgctggttctattcctgcatctgaacactctgttgcaaccacgaacatcggtttcattgttggtcgtttacaaggtgaaaacccggacctgactctggacgaagcacgtttcttggctgaagttgaattcatgaaacgctacattacggaaattttccctaaaggttttgtttcctacgtggcagacagttatgacttctgggcgattatcaccaaagcagcagcgatcctgaaacaggacatcatggcgcgtgatggtcgtgttgttttccgtcctgactccggcattcctgaacatatcattgcaggctatcgtagcctcggtgagtttgatgactggtctgatgcacactcagcactacaggaagattcaaattcagaagttgccaagattgaaggtaaatactaccggattcttgttgacgatgaagataatgcctacttcgacttccaaccttcaggtcttgaagagcatgaagttaagggtgcaattcagtgtctgtgggaaatctttggtggtgaagttaactccaagggttacaaagttctggacagtcatgtaggtctgatctatggtgattccatcactgttgctcgtgcaaaagacatctttgaacgtctgaaagataaaggctttgcatccagcaatatcgtgtacggtgttggttcctttaccacccagtacacaacccgtgattcactgggtatggctgtgaaagcaactggcgctgtgattgatggtcagcagatcatggttgtcaaagagcctaagactgacctcggtaagaaatctgcgaaaggtttcctcaaagttgttcgcaacatgttcggtcagttagaactgattgacaattgtcagcttgaagatgtacagtctgacgataacgaactgcgtcgtgtgttctacaacggtaaacttattgtcgatgaagatctgacaacgattcgtgaacgcgcagccgctcaactgtaatcaataagccccttcgggggcttttctgataggtacactatggaaaatccatgcaagtggcatgaagtcccggtacatgattgcctgacatgtaataatacaccgacaaacccgtattatattaaggagcctaaaatgtttggacccgtaatgatggaatgtaaagtctgtaaacaggagtttgaagccgatcttgaggctcatggaccaggtgtttgcatcatttcctttggttgtggacatacaatgcacgcaacaaagaccgaaacccgctgggtaaacacgaaaacgggaaatgtagatctcgttgaaaccgcaaaacagattaaggggtctgatttcagtgcgtaatttagtctcgaaacatgattttaacagggcatctgttcatgaagaccaaaagaagtcttgggttcctgagattgaagatggtcttgatgaatattacgatgatgactgtgaatgggaaactgatgatgagttcatagaacgtatcagagcactttccatagcagaataccgtcgtggtgtcaacgactcaggtatcatggattgacaaaaaaggtgtccgctggtaagattgagttatcaaaataacttgactcttaacaacttacacggtaggacactatgtttaaactaaaactcgtttacaaaactgataacggagagtatattgaacacgaatcgaatcatagggaactggatgaagccactgatgaagcggatgagatcgctttttctacaactggttttggaattgaagcctggaaatacgttgcctccttcggtgaagaaggtggattatactatttctaccccaatgatgaagatctcacaatcaaatacgctctccgaatcttccgaacaatttaagaatcgaaaacaacgccgtgctgaagcggcaatcaaccgttcaaaacgaaaaggagcaaaacgatgaaacatgaatttgacggctttattggttacggcgaaggaattcgtcaggctgaagacgtagatgttttcgttggtttcggagaggggatttcttctgatgaacgacctgacctctaatcactgtatcgcattctcggaaagagactggcctagtgaaagtctgcgtggtatgtattatcattcagcctgtactaactgcgggaaggagtacataggtcctaaaagagaaattttctgttttatttgcagtaatagtaaaaaagacgttgacaatgaaacaggtgatctataatatctaccacatcaagcgttcagtagctcagttggtagagcaggttcttcatacggacaaggtcagtggttcaattccactctgaacgataaggccctcaagctcattaggtatgagcaatcgactcataatcgagaggtaggcaggttcgaatcctccgggggccaccaattaaaaatgttgacgaggatatctgattgagttagtatcctcatgaacataaacgggacaaattcccaaataaaatgcaaaggagaaaattatgactaagaaaaatactgctaagaaagtatccgccatcgacgctatcaaacagcctttccagtttgagtcgaagtctactcagactcattctgctccgcacgatgtacgtctcggtggtgtagagaaaaccgtatcagttttcgatcgccgtaaaggcgagtataaatccgaaacccggattgaaggtggtcagattatctctgcttcttaccgcatccgcacaggcaaaaccaagcgtgaacgtgctggtaaggtaaaggaaactaaggttgttgaaaccgtagccacgaagagtaaaaagaaaaaataatttctccggcatggagaatgacgattccgtgaaacgtctttaaaaacacgggtatgttttcggggtattaacacagcggttagtgtagcggcctcttaagccgaaggtcgaaggttcgaatccttcatgccccaccaagtttgaaatgagggagatacgggttcgactcccgttcttgctggcccggctcgcgtagtggcacagggcgatagcttaaatggacgaaagtgctctcgtttcaaatctaaaccaaaaggagaacgaaatgttcggatccctgttacgtatggctggcgatattgttggtactgctgttgttgtcacggcaactgttgcagaaccttttgtagatgtagccgcagaagttcttgacgccgctgatgagatgatcgtatctcctaccgcagacgtcgttggtgaagtttgtgagtctattaaggacgttgtacgatgagcggtgggataatttttatcatcatgtcagtgatctctttcctgcttgttctttggtattattggtcatggtttgaaaacaatcctaccaccgaagaaataatcaaagattcgcttgacaaacacaatctgtaagtgtagtatttaaacctaatttaacgcaaaggagaacttaatgactgattctaaaactgtaatttccgtaactgaacgtgccactaaagcagtaaccactgccgctactggtctgactaaagtagtcgctgaactgcaatctctggcagaagggtctgaaaagatcagtcaggaaattcagtttaagcagcaggaactgggacaaattgaagttcagttcaacgaaaaactggctgaagaaaaatccaagcttaagatcaaagttctggaaaacgaagattccgttctgaactctatcctgaaagctcgcggccttgtagctgtagaaccgggtgttgttgaagaccttcgtgcagagctggcgatctctcagcagaacaatgctgaagctgtagaaagcgcagttgccgacgttaaacgtagcgctgcaatcgaactgaatgcggttaaggcaaatctggaatctgctcacaaggttgcaattgcagaacttactgcgaatagtaaggctaaggatgaccgtattgcaatgctgacagaacagcttgaagcagcgcgtggtgatctgaaggctgaacgcgaaacccgtctggaaatcgcaaaagctgatgctaaccgccagggcgttgttgtcaacactggcaaaaactaatgcgtagtgccgacacggatgtcggcaaatatttgaagtaactcaaattttaaatttcatgagaggagaattctatgtctactaagatgtctgtaacccgcgctctggctaccctgaccaaggttgaggaaaagattcagaagcgtatcgaagcgctgaacacgattcacatcgcgaaaggcactgacgcaaaccgtcagatcccaggctctatccagagcgttgaggacttcgagaaatctgctcaggcagacttccagggtgttcaggatcttctggctgttcgcgacgacctgaaggcgaaagttgttcagtcaaacgctgtaacaaaagttgagatcgctggcgagtctatgaccgtagctcaggcgattgaacgtaaacgcaccatcgttttcaaagagcttctgcttggcaagctgaagtctcagtataatcatgctcaggttcgcctgaaccgtgatacacaggaattcgaggcgaagcttgaagctgctcgtgctccatatgtccaacgtgataaagcgccagacgctgcacagttggctgtagtagaagcgccagttcgtagcatgggaactccttccattgttgacccactgggtctggcagaccgcattcgttctctggaagcagagattgaagactttaagtctaacgttgactttgttctttccgagtcaaatgcacggactgaagtggagattgaaggatcaatctaaaatatttgcaggaattcttgattaacatcttgtaattcctgcggatagctggtaaagtttttaaatgctgtttttggttagcgaagtcagaaacatcttgcctctaccggggccggaggttaaactgctccgaacataatcgtacaggatgatacttaaacgtatgtttccgtcagtccgcacaatgatgcggtttgatcgaaattgtcgaatcgcgaattcgaaagacttcaacattcaacattcaaagattatcgttcaaagcttaatgtttaaacttgaaacttctaaaccataaagctaaaatttctttgattacttaaatcctgggtataggatcttagctcacaagatatggctaactgactcctccaggctgttaatcggaaacagcatttcttgctcgtatagctcagttggtagagcaactcccttgtaaggagaaggtcgtgggttcaagtcctactgcgagcaccaaacaatttctcgatagcttactttggttagagcggtcccacgatagggacggtacaggttcgattcctgttcgagaagccaatgcagggtaggcggtttgtcaaccgcgaggtccatccagacctgaaaaatatgccagaactaacagtacggctaaatacataggtggttagattccaccaccctgctccaaatctattctgcgaggttctgaaacacttaaaatctcctgcatctagcggggtgtgatctctgtgtcggctttgatatcaagttgatgaaagggatggcgtaggctcttcttcgcaagtagaggcgcttcggagagacaacggcggttgtcaggacatcgggacttcacaaaatagatttctgcgggattggtggtattggcagtacacacgaggcttaagacttcgtaggcctctaggccttgagggttcgaatccctcatcccgcaccagtttaagagggcgtatctcaacgggcttctaacccgtcgttaatcgagtaattggagtgagtatgaaagtctgttctcactgtaggaaaagtaaaccacttgaactgttcggtaagaatagctctaagagagacggcctacagaattgttgtagggaatgcaaaagaattatagactcttcccactataaatccagccccataagaaaaggggctataaggaagagaaatgcagaaatagcttcgcataacagaaagttggtcagaagatacaaaaccttaaaggggtgtgcttattgcagtgagaaatgctatgcatgtttagactttcatcatccagacagcgataaagagtttaatatatcgagaggctattctaattcaacagagacactcaaagctgagatacgcaaatgtgtggttgtttgttcaaactgtcatagaaaaatacatagtggtatttttagttcccttagttaaatggatataataagagccttctaagctcctgttcgtggttcgattccacgagggaacaccattttctaaggcttcaggttcgaatcctgccgccttcgccaaattcacaggacagccgggacgggtttactccgagctgtggaagcgtctaaagactataggacacgtcttgacccgaacgtgtgggagcgaattgaaataatcgggtcccccaaaagcacggttgctggagtggcaacagcttcggctgcaaaccgaatgtcaggtgttcgattcacctaccgtgctccaagttgttgaatatttttataaaaaatgataaaatggcccttgacagataaatttaaatctgataacattaataagtggggttattatggcagtaaaacaacaacttacaaagcgtcgtagaggaaaaggtagaccccttaaagaagagtctaatgctattcagcttgagaagaatatccttgaccttaagaccaatatgattgctatgattcctgatgctcataaggtattgaaagatcttatgacaagtgccacaacaaaggacaatatcagggaaaatattgctcgatttgtaattgagaaaggtgaacaaatgctttctgattacttcgatgaagagaatgaagaagctgaaacaactaatgttgatgataagaaatctactcctatgagtaaaccattcacaacagatattgttcagttcaaacaaggttaattggctcgttggcagaatggctattgcagcggattgtaaatccgtgcccttcggggttcctggttcgagtccagggtgggccaccaattaatgggagtatagttcagcggtagaacgctcgaccgataatcgagaggtcgctggttcaagcccagctactcccaccaagatttaagcgttattagtgcagcggtctagcatcccgtccttccaagtcggtgacatcggttcaaatccgatataacgctccaaatacgcccctaaactgatgaacgtctgcgcggctggaaacacccactcaatagttcagatactcaggggcaacaaacaaatgctcctatcggctaaatggacaggccgtcagactttcaatctggaaatccgagttcgatcctcggtgggagtgccaaacaatgcggtaacgtgccatcacgaagatggggctgcaaacataccggttaatgttgcggctgacattttatagaggttgatcacctttcatgtccgagcaggctcattacctgtgttgccgcaccaaataagggggcgataggctaatggtaaacaggccactcgtcagtggtagttccctgttcgattcagggtcgccccgttacgttatagtgacttagcacaactggctagtgcagcggattccaaatccgcaggttctgggttcgaatcccagggtccctgccatatccggtgggagagtggaggcatccacgaagtcgtcttttgattaccgtatttgtcactagcctctatttgcaacagagatatacaaattaccaaggatcacgaggcgcgtataggagattagccaagcggttacggcactggtctttgatatcagcatcggtggttcgaatccaccatctcctgccatttttgagtgctttacagcttccgtacttcgtacagcggcatcaaagagagcactgaaatgtggccttaattcagttggtagaattcccggttgtgatccgggcagtcatgggttcaagtcccataggtcaccccaatttgcagatacgtgattatctctatcttcccacgtcatgtgttctagtcgagattttcgttgtacgatatctgccgcgaatttggtggaatggtcgagaggtttaagacagcaccttggaaaggtgtaggcccccaaaaggggtccgtaggttcgaatcctacttccactgccactttatggaggatttatgcagaaacttttgcgttgcaagaaagtgtttggacgctgtaggctccacggtagtaactgtggtgttgcagaagaaattcaatcagtccctattactcgtgcgaaagaaaaagcagatcttcgtaaagaaattaaagaacaattggaagattaaccctaatcaggtaagggatctctttgctaaagagacagtagctccgaaaggggtgtgtcagttcgagtctgacatcttcctccaaattgtctaaagatgttcaatacatcagggtcgcgtaggtatctatcatccccatgagagttggggaacggttctgggaggaatgccgctacacgctacgggcctaaccctgtcttggtgaaaatccaagtagacaataatcttggagagcaggctgcaaggtgcagactccggtttgaacccggtcccaccgtagcgatacggtgacagttcgattctgttgctctcctccaattagtagctgtattgttgtctatgtgctcttgggtgctcactgtctgccgagaagtcgacaacattacagtcaggacagttatgggtcgctagctaaactggataaggcatctcgcttttaacgagaggactgaaggttcgaatccttcgcggcccaccaaacaacgggacgatagtttaatgaggctggaaatgcgacggcaaccagcggagcagaatgacgggcatccaggaccgtaggtgaggtgcaaaccctcagatcccgccaaattgaaatgggttgaaatatcccttgcaaaaggttgttttgactgataaagtatttaaatggattggtagctcagaggcagagcgctcgcctgttaagcgaggggtcgggatttcgaaactccccctttccgccaaattatggggttatagtttagttgggcaaaataccggcctgtcacgctggagccgagagttcgattctctctaacctcgtatatttgatatgttgatgtaaattgccggaaggcactcaaaatgagttcgacgtatcaaaccaattgtaccctaacggggcatgatattagctagccagcgataccagttttgtagagacctgggataattaaaatctacaccttcagtgcgtagcgcagtctggtagcgtgggagccttggatgctctgggtcgtgggttcaaatcctaccgcactgaccaattctataattagacatctaaggatagtcgatgaaagacaagaaagcgttgcagttaggaatgaatgcaagcacagcgagtggtagattggtaaaagatctcttatgggactttattgtaaagactgactccaattactgccatcactgtggcgctcctatggagcgagataatttttccatagaacataaaaccccctggctcgacagtgcagatcctaaggggttgttctttgatattaataatatctcatacagtcatctcaggtgcaatatctctgctgcaagaaaaccccatcagaaattctttaccaaagaagagttcaaggaaaaggatagggtcagaaagaaacttgcttgggattctcttacgaaagaagaacaacaagcacgtcgccgtgaaaaataccggagacatggtaaataatacgagcatagcttaactgaatagagcttcgtcatacgaaggcgaaaggtcggggtttgaatccctgtgcttgcaccaatatagcggaagcctgactcggtgtacaacgatacggcaaagtcttcggctgttgataggttcgcaatgcgtcctcggacggtaacgattatcagaacggagcaaggattgatgagtatattgcctataaatgctcatcatggtaactgtccgagggtggcattctcccgaaggatcgataagggcaagtggcggaattggtagacgcaccagatttaggttctggcgtcctatgacgtgagagttcgagtctctccttgcccaccacatattgggtcggtagctcagtctggtagagcacctgattgaagatcagggtgtcggtggttcgaatccaccccgtcccgccaaaaaattctctgtgatgcaggttcaagtcctgtcaggacggaaaaaccttctggtgaagaggtcgtgtgtgtgaagtggttaacagcagagaaccaaaaccctccctagtcggattagacgactttaactggcaatagcactctgaggcttcttccagggggacttataattgcgcggtagtgaaacggatatatagatcacgttggcctcataagccgaaaattgcctgttcgactcaggctcgcgcatccaaattctaataataataaattcttatatctcctctcctttgcctcgccccgctcttgcggggcttttctttttctggtacactctaaaagtagcttactaaaggagaccagaatgatccacacttacgagaagagtgaacatcttcgagaataccatttactaaaaagttttttctctgaggatatttaccatatccttcgtagcctcgatgttataatcgcaggtggcgctatcacggctctctttaccaaccgggaagttaatgatctcgacctgtacttccgttcatgggatgacttggagatcttcattacttacatgatggatatagacctacgaaaaggtgaacatgacctgtcacctaaaacgatgggatacaatgaagagaaacgtgtttatcgtgatttcttcattttagacaatgggaaagaggtatgggaatcccgtgcgccaagattcaaggttctttctcagaaagtgtctaagcaagagatcgtggagatggaagataagtttgccagtgactgcccttttgatctgtctgatatctctgaatcgacttgggatggtattgaaaaactgctcgaaagtagaaagaagaaagtctcatatgttcgtaatatcggcatgacagacaaaagcattatgttttcagatggttctaatccggtgatgcaatgcattgcattctcggtatttgagaacgctgggcagatctttgataagtttgactacaccatcaacatgggtgccttctcatttagcgatgaaacatgggtgtttgacagtcgtttccttaaacatgctgcacagaaagtgttggttcttaatccagcgacagactacccgatcatcagtatgctccgagcgtcaaagtacgaggcccgtgggtatacaatctcccgtcgagaaacaatgaagttgggtgttgccgtcgcaagtctcaaaatggaaagctgggaagatgccaaaaagcatcttagcggtatgtatgggacaaacgttgaagaactcttcgatacaaaagagccgttttcatttgagggattatttgataaactggataatgcaggtgatattgctatcagcacgattgccactatcaccgacaagcgtaaaggccaacggcgttttaatctcgaagctaaagatatcttcaatgttttccaacgcctgcgtaaaaacaccgatcgcctgtatttcaaggaattctgggctgtatctagtgctgtgcatttttacatgatgcaggcgcataccgaaaaacacgtattcggccttaatagcaatagcatcgacaatccagagatgctagataagatcaggatttattttgatcttgatgctgcacaagagaggtacaagctcttatgcaagaatggggttcaggggagttggcacgtaggggagatagaacctggtgcttgtctgtttaaggttatcgtggaagatccgcttatccttgagtacgaaggagatgggcgagtgtctgtaaaccgagaagataaggctcctcggaataaggtgactattgttgaattattagattgtgatggggatatctcatgataaattttatcagtgtggtttggacctttataaagggacacaccaaactggttatcattgctgtcctttctctggcgctcctgtggggcgcttttgaagttaagtggtggtatgatgaccaaatacagcaggcctatagccgtggggttaatgatacggataacaaatgggttctgcaaatgagaaacaacaaagatgcaaatcaagatttcaaaaatgggcagcaagacttctctgatgaactgagtcgccagcttgcagaagagaaggctaagaatgatttacttagatcccgactcgatgaaaaacaacaggcatataacaaatctgaagcgggtaaaaagtttgggctggataacgactttgttgatatctataatgaaagcttgggggttaaatgagaaagagtttgcttgccatattcctctctgtaatcatgcttgttggatgcgagtctccacagaaggtagttccagtggttgagaagtttaatccctctgaggtgctttctaagccgcctgctcacgcgatgattcccccttctgacccaacaccacttccctatggtgctgataacgctaaaaacagtgctattgttaagaaaaataatcttgaagcagcagatacacgtagcaaattgcttatccttcaggcatacattcgtaacatatttacacctcaaaagtgattgacaaggctcttatttcgtgataagggctttatttttatgatctttcgtggtaaaatcctcctatagcatataataatggaggtcctttgagtaccacttttggacccgccagccccaagcagaaaatgatcctggaaaacaaggcgcaaatcctgatcattgggggcgctgcgggatcaggtaaatcttacctgttgcaacttatgcccttagccttaatagatgaccctcgatcaaactgtatcatgttccgaagacttacaccgcagattgtcggtgcgggtggtttgtatgaaacagctcgtggtatctatagtgaattgtcgcctgagtggaagccgcgattccgagaaaaagacctgaaggctatctttccttctggtgcaaaagttaaatggtcgcacatggaatatgagaaagacaagctttctcatcaaggtcttcagtatacttttgtagggtttgacgaaggtacacagtttgaatggacgcagattgagtatctgatgtctcgtttacgttctgaatcgaaataccccagtcgtatggtcatttcttgtaacccggacccagatcataagattaaagagttgatcgattggtatctcgatgaggatggttatcctattccagaacgtgacggggttatccgttggttcatccgccgtgatggtgatttcgtttggggtgacagtgcagaagaattgattgaacgatactgggatggtgaagatattcacaagaagcctaaaccgctctccttctcattcatcagtgcaacaattttcgataatccgccaatgctggaaaacaaccctgattatcttgcattccttgaaggtcttcctgaagttgaaaaagcacagctgttgtatggtaactggaaggttcgtccagaaggtgcaaactatttccaaaggtctttcttgaaagaagtcgcgacgctacctttaggctgtacttctgtaagaccatacgacaaggcgggaactgaacgctcaacaggcaacaagttccctgactttactgcatcggtcaaggtaagtaaagataccgagggattctattatctttctggtgactatcacccagattttgttgatgatggtccttattctaccgggacgcagggccgcttctgtaagaaagctggcgaacgtgatgcaattatcaaaaaacaagcagaacatgatggcgatgatgtaacgattattttctcagttgacccaggccaagccggtataagcgaattcctcaccagctcaagagcattgctcgcggatggttatgtggttgagaaagaccctacgccaggcaacaagtcgaaacttactcgttttgcaccatttgcccagcttgcacagcaaggctttgtccgtattgtacgtagtagttttgatgcaaagacatatgaagccctcatgaatgaacttgagaaatttaatggcgagcgaagcaccgtgtcccgtaaggacgattgggttgacgccatctcttcaggtattaacttcctggagaaaacggagatcatcagacctgtcgtaatcccaaggattgttgctccgactatgtatacacgattataatagaggggatgactcgtgtcaaatcgcagaaacagaaaaagaaagaatgcggtggcaaaagcagggaatgaaaaccttgctgtgagtcgtgtccgtactggagaacttggtagtggagcattgtctcagattcgtgctgaatctgagattatgaaggttgaagaactccgctggcctatgttcctcgcaacagtggattccatgaagcaagaccatactgttgccacagcgctggatacgaaatatgtttttgtcaccaaggctttcaatgattttaaaattcttttcaaccgagatagtgaagagtctaaaaaagcggcagatttcgtcgagtatgctctgaagaatcttgctaaccaacagacgcttcgcgatgtggcgagaagtgctgcgacatttaacgagtatggtttctctgtattcgaaaaggtctacagaacagaatccgcgccatctaagtacgcaggctatatgacgatcgacaaaattgctttccgtcctcagtcaagcctctctcgtacaaaaccttttgtcttcagcgatgatggaaggacaatcacgggtgtttatcaaagcgcactggcttttgctaattttcagaatgggatgaaccagattgctggggcgatgagtctcgtcacaaatctgtcaggaagtgctgatgagaaattcattcctgtgaataagttgatgataatgtctcttggtgggacagaatcaaatcctacaggtgtatcacctcttgttggctgttaccgtgcgttccgtgaaaaaatcctgatcgaaaaccttgaagttataggggcatctaaggatctcggtggtatcattgaattaaagatcccttcttcaattctgaataaggcgtctatggacccgagatcacctgaagcagatatggttcgtggtctgatggctgacgccgcaaacgcacattcaggtgaacaatcttacttcatcttaccttcagatatgaatgataagggaggtgagcagtataagatgacccttaagggaatcgatggggttggtaaacagtacagtaccaaggacctaatacaagagcgtaagaaggcgatcttggacagatttggtgcgggattcatcaacttagggaatgatggtcaagggtcttacaacctgtcggaatcaaaacaaacaatccacggacattttgttcaacgagatatcgatattatttgtgaatcattcaacaagaacttgattcctcaactactcgctcttaataatatccgtttgtctgatgaagacatgccaagacttaagcctggagctatccaggaagttgatatggaaagcttctccaaatttgttcagagaattggtgctgttggttatctgccgaagacacctacagttatcaacaagatccttgaggttggtgggtttgatgaagagattcctgaaaacacatctcaagaggaactactaaagatccttggggaagataccagtcgctccggtgatggaatgaagcaaggtacttctggtaatgggacgtctaaagtaagagataattctgtctctaacttggataactaagcaactcactgaaataacttgcaaaagaaaataaacggtgttaaaataactatcaacggggaaaatgatgaaatactcaagtattgctgaccttcctgcatcagtatcgaatctgtctctcattcagaagagcaaggtgctggttctcgcaaatggcctgattgattcaggcctatctcctgaagccgctattgagaaagcatctaaagatgtactccatgtagggctgaagaagacagcaattcaaaagaatgccaagcctgtatctgttgtcaaagatgctggagaacaaatgatttcttacgaagtcatttatgaaccaaacactagggatgcccacggtgaatggatgtctccagagacaatcgtcaaaggtaaggaaagtttcgatgctgcgcgagcggctggtcttgttaaagagaacctgttccacattgtcgagactgatgcctttaccatcgagaagacttggattcaagaagagtttgatgtcgtggttatcggtagcgagcaaatcattaaagctggcacctgggtagctaaggttaaatacaatgatcctgaactgtggctcttgaaaaaggccaacgctgtcggtggactgagcattcaatgctctggctacacagacaaggagactggtgaaatcaccggactcgatttcgggattgagattgccgaggaaaacgaatgagcgcactcgtagtcaaggccaaaactattaaggataagggtatcgcactctgccacgagagtcaaggttattctgcaaatatgcgtccggttagtcttctgatgaagtctgaccttgcacctgaacagattaccaaagacgtggttaaggcacttcgccaagttactgtcgatatgagctttgaagaattccttcgtcgcttcttcgatatgtggagtagtgatgctgaactccttgccaaacttttgggcttcgaaacagaactggaaaacgctgctgctgaaaatcctgatgatgaatggctgcaacgttggaatgatgataaccaagaatggttagaatcgaagatggagtccatctctatcgccaaagctgcaaatgcaggtgaagagctggaccttgtgaagcaatatgaactaatcaaactccaacagatgtttgagaagggtgttgcagagcacggtgtcatttttgatgccaaagacactcaggagactgaggtcatcaaggacgctgctaaaccagacgtacctgttcaaaatacaattgaaaacaaggagacctctgtgtccgatactgttgatgtaaccaaatcccaggagtacctggacctggttaaaaagcttgaagaagctaatgcaaaaaatgcccaagcagaactgattatcaaggctgctgttgaagcagaaaagaaaaatgctcttacaaaagccaaaggttttacttttgccgctgaagaagaccatgaatctcttgctgacttcatcattgaaaaagctaacgccccagtggtagctcttctggaaaaagcccaagctcgtattagcgaactggaaacagaagttgaaactgtgaagaaagagttcggtactcaggaaaatggtatcaaccaagaggttgttactgaagacctagctaagtccgccgaagatgttcttaaagctaacgtgcagaaagctctagaagctgctcgcgctcgcaaaactgcctaatatcgaggagataatataaatggctaatccgattcaagggttctactctgacatcgtcctgggtaaagttgattcttctgatcagggctacagcttcctggaaatggaaatcacttattccgcagggctgaaggctgggatgatcgtcaagtctgatggtactctggctgcaactgccgacgctgcaagcgcatttggtgtaatcaccgaccgcgacctggtgacttcttcttacaccatgccacgacctttcgtagttggtcaaaaatacaatttcgtggttgctgttcgtggtctgaccctgaacaaatccaaactgttctttgctgacggtactactgctatcaacgctgctgctatcgctgctcttgaggccaaaggtctgaagatcactgataaatattacgacggctccgttgagatcccagtaacgtctatctaatctacaccaaggagaaaataatggcagtagtacgcactaatgatttccagatcgttgacctaggcgcaactctggaaattgtacctcgtcagtaccgtatgatcaccaacatgaaccttttcgaggcttatcacggtgtctctactatcgcccagatcgagcgtgttgacgaagttgtaaccgacttcccagctcgtcgtcgtcagggtgaacgtaactacgttggtactgaaaaggcccaactgaaaaacttcaacatcccgttcttcccgctggatcgtcagatcactccggcagacgtacagaacttccgtaaatatttcactgcggacgctcctaaatctgtacaggatgtagttgaacgtgttgttcgtcgtatccgtgtttctcatgaacagcttaaagaaaaagcaatgcttcaggcaatcatgggtaaatcttgggcaccgcaggacccgaccgctcagtataactacttcaccgaatggggtgttacccaggaagttgttaacgtagatttcactgacgttgcagttgacccgtctgacctgctcgaaaacgatggtcgtgcattcatcatcgacaacgctggtgacaacggaaacaactacgacatcgtagtcctggcttctcgtaaatggttctctgctttcgtaggtcacccgctggtcatgaacgcataccaatactacagttccactcaagaaccgctgcgccgtcgtcttggtgacggacaagagaacgctaacaaccgttccttcgttcacaagaatgttctgtacatcgaagatatctccggctacatcccagacggtgaagcttacatgctgccacgcggtatcgacaacatgttccagatccactacgcgccagcagacgatgttcgtgaagcgaacactccggcacaagaactgtacctgtggtacaaatcttctgcttacctgcgtgaagagaaggttgaatctgaaacctccttcctgacagttaactgccgcccagagctggttgttaaactgactggtactttcgcgtaatacagcttaaagctacctctaagagggggaggtgttaatcacctctcccttttttcattttaagattagcatggtgatcttatatgtcaagaggtttatgaggaccaaaggagattctatggcaaatcaaaattatcgcattttcccgaacaaggtagagcttttcaagttctttggggcatacacccccgaattgaacattagcgcttcaagccgcttacccctaaatggcttcgtccttggtaagcaaatgaaggcttttcgttctttcatggagtttttccaggaacttgcagacctgtccggtcttcctgtagacgccaagacctctactctgagaatgggcaacttcatcgtgttctttaacggggacattacacctccgtctgaagttaaacctgttacggttagaccaaaagcggaagaaaccgttgttgaacaggttgtagaagctaatacagaaatcattgagacagactctgtggacgtaaaggcacttcttgctgaagcatctgcactgcttgatgaagccgacaaaaaaggtagtaaagacaaacttgctgaattcgcagcaaacaagggtgttaccctgtcgaagagcaagacatttgaaaatatgttagctgacttcgaatccgcactgaagtaataatcttaggagatttaaaatggcaacatctggtgtagctggactggtctacggtacaaaactgattgacattgcaactggcggagttatttccttcgctgatgttattgctgccgctggcagtggcggatctgtggcatgggccgatattactggtaagcctaccacttttgctcccgtagctgcaaccacttctgtggttggcggtgttaaaatggcggcaacacaggccaatacggttgcgactgacgtagctggactggttaccgactttaatgcccttctttccaagctgaaggctgctggcattatggcgtaatataaaggccctccggggccttatttttttagtagcggtctcgcctctggtttcaaagatacctgaagataaggttgtcggccatccttataatatttacagatgtaagttcctgttgcaagaacagtaccgttcactatccccatatttctcattacttggaaactatcttcttgttcttccatctcatctaacatacctgtctgcgtcgtcagagtgccgggaatgaatgcctttctgaattctgtatcgcatttcatcccagcaatccgatgaatggcctctgttttttcttcagccgacaaccagcttgaagaaacatcgtcgaatttgttcatattggggttggttttcataaagtagataagtccacccgagacaacgagggctgtgataacacctgctattactgttttcatgggattctcctcaataattttctttgagaatagcactctgttccatgatgtcaagtgtttttgatgacaaaatcgacgttatatgataagatattgataaatagaagagcttgaaggagcgaaaatgacagaccaagaaattgttgcttatattcgcctgctccttgggtccatttccccggaagtcttacccgacgagattatccttgcctttttggcaatagagaaatcaaaggctaattaccccggtgatgataacacgccatgcactgtttactacgttatttacaatactcttgttgacgtggtacgttggttgattcttcaggaagtgaacacaggagaggcatcaatcacggatcgccttgaaaagattggtgatgaaactatccagatcaaaggtgggtctccttaccaaaattggaaagacttcctcgactggctgcttgaaaaccctgactatgtcaatgattgcttaagtgcggtcagaggccttgttatcgttgggggcgttcgtgaagacgagttcaaccgtgttaaatacgacagaaactcccgtggacctttcgatgttggtggtataattccacagactggtgttccaggaattcctcgtcgataccctcgccgttggccttgctaactatccaaacctttatcgttgattttgctaagataatgtggtaaaatacctaaacggatgcagtcatgagaccaaaattcacaagtacgcaagatcttagccagcttatgaacttctttaatgcggttaagaagcttgattatcgtcaggtaagttacggctttttcgacgatcctcactattccggcctgaatactgcaacccttgcagcgattcatcaagagggttggaataatctcccggctcgtactttcatgactagcgcgggtgttcttttccagaaagaacttaaaaaatttcagatcgacctcttcggtcaattggctgctggagcgcaagacccgactccagtcctgaagcagatcggtcaagcaggtgcagacaagattcgatatgtcatcgatggcgggcttttccctaataacctcgtatctgatgcatgggctgatgtcaaaggatttaaagaggccatgttccactacggcgacctgaagtcatctgcaacctataagatttccactgggaaggggactaaatgacaccaggctacagactaataggcaggaataagctgattccgagaaagactttcatcgggagacatcgtactttttcccagccagacccagacaatccattcgaaaaccaagagatcgctattcagtatgaagagtttgatgtcttggaatgcgttgttcagcctctgacaggcaaggcagcaagagactacacttctcagttgaccgaggctggcggcagacagtatgattcattcactgtatattcgtcaactcttcttaaaggtcctgtcgaaggttctttcctgctagcagaccaaatccagctcatgaattcccgtggggaaatggaatggtttactgttatcaagtctgatccgtatcagacaacaggggttagccgttacagagcgtatgtgatctctacgcctgcggggacagaaggaggcctatgatggcagacttcgtaacaaactccgatgatatttttgacgccctcgcagttacgctcgccagattttgcaaagaagtcacggggagaaaaataattgacggggacggagacgtcatatccaaggtagagggtgagttcatcatgctcaaccaagttaccgctgaccagatggactgggctgcgaacgagtgggtagatgagagcggtaacgctgtaataactcacaactacgaggtggtttacaacctgacagcatttcgaggaaaagcatcaaatgcattaactcggattctacaggccttgagcctcccctacatctgcgacaagtattttccaaccaattccccatttgcatattcttcttcctcaacggtatcgcgccagagagttccgttgaacatgcaaaccttcgaaaaccgtgcaactgtacttatcacttttaacgtctgcgttggagtgacagatacaggagctttcgaggatatcgagagggtgaatgcagagatggtttattactatccggctccagatgatcaacaataactttatgaaagaaatagaagaagaggaaatcaatggcttataatgataaggttgttgacgtaacggttgttctcgggacacaaccaatcgacaccgtagggtttgaaacccctctatttatcgcaattcacaacgttttcccagaacgagtacgtacatatacagatctggatgaactcgctgctgatggtttcgctgtaggttcccctgcgtatacttttgcgacaaaagcctttgctgggactttccgcccccaagcgcttatgatcggaagacaagcatgggaatcaacagttatcgatttcacagggcagacaaacgtagatcctaataacccagtaagttttaacgttgcggcgggagcgtatactaaaagcatcgttattcctgttactgctgcatctacgccagacagcattgcaacggccctagcatctgcaatcaactctgataccactcttaatgtaattgtcggtgcagtagctacaactggtgttgtaacaatcaccccgaaaggtgatggctccctgctagctactaacaatgacgaggtggttacaaccgaatctgaccaaggcatcatggcaacatcttctgatgttatcggcgagccattcagcatcggtattgactcaggtgattgcacactgactaacaactcaactgagactgtaagcggtgttctaccacaggtagaaactgcaaacagcaactggtacttcctgagcacagaacaacacgtttcttctgcaattctgggagctgccgcttatgctgctgctaactataagctacacgtctattcaacatccgatccgctgtcaaaagttgtcgacggagattctattgctaatcaactgaaagcacttcagtatgatactagcattggtatgtatgacccgcttgctgatagtgcattccctgaaggtggtatcatcggtgcaatggcatctaatgacccatcctatggtgactcaatccacctgaagacaatgccgggtgttgttgctccgaccctgagttcttctgatcgtccagctatctggggacagaacctgaacttctatcgcatgatcaacagtgttggagcattctgggaaggtaagtgtgcctccggtcagtatgtcgatgttgtccgttttggtcactggctgaagttcagaagtgaagaaagtatcttcgcatatatgtctcgccgttctaatcttggtctttccatgaagatgagtgatgaggatatgccgaacctgaaatcagtcctgatgaacagtcctctgaacgtcggtatcactaatggttctattttgaccggatatgattccgtcaacaaggtgttctacgacccggttgtaacaattccgcttcgtgcaaacatcccatctaacgaccttgcatctcgtacccttaacaatgttaaggtagagctagtctacaacagttcattgcatttcgtcaagatccgcatctctgttctgttagacaaaactgggtctacttcttccagcggacaagtaacagcaggagtgtaataaatggatactagaattttaaccccgtatgcttacgacccacagaaagcgcgtctctatatgatgactcagcgagtaaccgggttcgcagcggataccaagatcgtcgttgctcgcaacgaagataacatcatcccccatatgggggttgatggtgagctgtcagcagcactgtctcgtaaccaatctggtgtcctgactgtctctctacagaacacttcggtatggaacgggtacttagctaactggcagaaacaagcatccattactgggctggtcttcttccctgtccttcttgaaggctctcagggcatgggtctgagcacagttggttggattcagaaacagcctgatctgacctacggcactgaagtgggccagatggattgggagatcggaatcctggacgcatggttaagcccggataccctgtcctctacaggcttcggtctggctggacttgcaggtatcgtctaatatcgtttcgtgtgccacaaggatgtggccttttcaaacacgcatggatataacaaccttaaaagacgcaggagcgtacacatgatgaattttagacctaccacagaaattgatctggctggtaagaactttgtaatcacacactggtctccgtccaaggttatgaaaaaccttccgaagattggtcgttatatcgcagttccaatggctaccattagtggcgcattatttaccggaggcgctaacctctctgaagcactacctactgcaattctatacctgtttgagcagatggagcaagatgatatcgaaaaattattcgaactcattcttgaggatgtatctgtgaacggcatggctggcaagattgatattgatacaattttccaggacaagatgttggatctgatcaaattggtagcggaggttctgaggattaactacggctgttttttcacgaaagacggtttcgcagaccttcagggacttctgggcaacttcgggatggttcaccaagtagcgacggtggatcaggaaccgacggaagtggcagcggagtaacaccgtccaaaatttctaaagtcgtccaaagagctattgactatgcaagaaaaaatagttccctgacgtggttcgactatctctggtgccgtgctctgaagaactttaagggggaatcttatatctcccttgagtctgccgatatggaatatttgcttaagctaaatgagtatctcgatatcgaagatttcatcaacgatgttaatgagaaagaagagaaatcgagagcagacgccgaagcagctaaaccccgaagcaaaggcagaagaggttaatctcaagccaggttccttttcaggagcctggcttttttattgaggaaattatggcaaatattatagtgacttctacagttaacaaggtaacatgggacgttgacaaaacgtcctttggacgtgccttgaaagctgtaaagcaaattcgctccgaatgggaaaagaccgggaaggctttttcttctgctaaagccgaccccgctgctgccctgaaacgttccgccatgcaggcgagaatggttaataaacgactcaatcaaactgaacgtgcagaggcggctaagaccacagctcacaatatcgcaatggcaaagaaagaagctcgtgctcgtgaagccattgataagattgaaaaggcacgacgtaaggctgctgtctccagactaactgctggccgatctccagaatcgcaggcaaactataatgccctgaaggcacagctccgtcaacaagaaaaactagctgctaagaacgggagttatggaactaacccttccatttctgctgcacgtatggcagcatatgaagcaagtctgaaaaataagggggctggcagcggaggctctccgatactgaatgctaatgctaaggcttatgacccgaaagttgttgaacagcaacgcaaggcaatggagcgtgaccatgcgagaatacgccgagaacaagtaaaacaggacaaggctgacaataaagccagagagaaaatggcccgcgacgcagagcgggaagctgggagaagagcaagagcacgtgaggcgaagattagtacaatctctaacgccaatgttcgtcttcgtgccaagtatggtgataaatatgcaaggaaactacctggttatgattccttagttaaccgctacatgaagagcggtaacatgaaggcatcaaatttccgtgcagaacttgcctctatggaaactggacttcgtaaggccagcgctaatacgctttccctgaatgatggtctgagaaatttacgtagcacattgatcagcgttacagcagcatacggggcgtttaatgccgctgcaagtgttctgaaaactggtcagttcttccagggtatggaagcaacaatgctgatggtatccgatgactcagcagaggctggtaagcgtatcgaatttgtgagaaaccaagcgtatcgtttaggtctcgaccttaaggtagctgcgcagggttatacccagatgtccatcgcagcaaacggtgtacttactaaatcgcaaaacgatcagctcttcaagtcattctctgagtatgcaactgccctccaggttgaccctgtaaaataccaacgcggtattacagctattcaacagatgatgggtaaaggccagatcatggctgaagaacttaagcaacagcttgctgaaggcatccccggatcattacaggtgttcataaaggcatcgcaagaagcattcaacgactccaccatcgacgttaccaaattgatggatatgatgaagaacggggagctgaaggctgctaaagtgcttccgtttgttgctaaatactacgcagaagctgctaacaagggtggcgcactccagaaagctttacaaggtaaccgagttgctatgcaacgccttacccagacttggatgaacttccagaacaagatcttcgaatctggtttcggcgataagatgacagagacatttaacactcttgccaaaatcttggattctaatggtccactcgctgctgccgtgggtcagtttgtcgcaggattcatagacggatttatgaagataccctatgctttgtataacgcctttataatggtcaatgctatcttagagagatatgttcccgtgttcaggaagaatggcgaagaaatttctaagacatggaactgggtgggttggggtataggtgctatattctttgctacatccctggtccgggtgttcaacatcctagctaagatcgctggcctagctggggcgatcaagactattggtgctgtttttggtaaaggcgatggggccacacctaaaggtggagagggtggtggagctggtcctgctaagggcggtagattctctcgtgtaggtaagttctttaaaggagcgggttccttaggtggactgctgtccctgttcactttaggatctgaacttaacgacagatataatccgtacagcgacttcaacgaagagcgtggtaaagttttctccaatgtgcatgatagcattgtcagtggaaaaacaggaagctggttctctaacctctgggggcctgataaggcaaccctagattatctgaacaaccagatgcctgggacgaatggtaagtcttctgctaccccgcctatggttattccgacagagcctgtctctggtcaaataactatcaaactggatgctggagagctgaaggatatgattaaccaagaaatagaagcatcgaatatgggcaacatcaatttgatccttggtgtcccagattaacacaaggggcttcggcccctttttcgttgttttatttgaagatttatgataaaatcataacaagcttattgaggaggttttatggcagttgtagcaagcaaccagtccaaaccgcaacaaggtaaggctacagcaaacgttgagcaaaaggtctctacggctcagaatgccagtagtgaagttcaatatactttatttgcaagcggccttaacaatggcggaaggaatgtagaattaaaaaataaaaactatacggacaatattgcgattttatttgatgtcgttgaagaccatacgtatacaagaactgttgacaaaacctcctacgcagtagagaataaggtcaaatacagtgatcatggtgtgatagaggatggtaaattctctttcagtgcgagaatcaatagctcgccactctacatgattgagaacaactacatcgacaaagacaccgatcctaacaacccggtagaatcccgacgcccagaaaaggccttggaggttttggaaaggctcatcactgatcgccaaatcgttacgcttgtaacggaagaccgcatcattgaaaactatatcttgacttctttggaagcaagccgcagcaattcagatggggcagcgctggtttttcaacttgagtttactgagttccgtacttttactcttgggaagacagccttggctacggtgtatacagaccctaaaaagtcaggcggaaaaacaaaacagaaaggcgctgttcagtcttccgccactgacgatgaagtagaagtcaccgcaaggagaaccaagtttgccggacctaaccaagatggttggcaaaaggttgcaaacgatatgggaattggggattataccaagcaagaccaagtggttggaacactgacgccggacggtaaactcaaggatctgaatggaaataccctcgactataataaagtggtaggtaactaatggcagcgatcacattttcttgggacatagacggttttgctgatcagacgatgcgtgtggttctggacagccaaacttatgaaatgcgttttcaatggaacgagagagacgagtcttggctcgtctatttcggggatgttggttctgatcctacaatatctttcaaattgactacaatttttgatatatttgcacctttcaaatatcttgacaatatccccgatggtcagttgagagtattttcttttactcaatccactaaacgtgtagggagatacaatattggatttttgtcagacttgcaactactttactcgtctcctgatgatgaggtaacaaccgatgaggagtaaacaatgcctgcttacagaacaagaacctataagctgacgataggtaaaccagtgtatgttggtgaaaagcctaccaatatatcggactataccaaccagaatgctaaagatgcgtattatatcagtaatgaaactggtgccgcaaacatcgagtttgaggtcaagaaggacaattcgaaggagcctaataagggttatgttaccatctacaacctctccgatgagacggtgagctacctcgatgctaaccaacgagagtccattgctatcgttcttgaggccgggtttgatggtgagaatcagactatcttttctgggaccgtagagtttgttcaggataagtgggacggcaatacccgtcagacaaagatgatcctcggggatgcaacagtaaatattaaaacggcaaagacctctcgctcttataagaaaggtacgccaatagacacggtaattagtgatctcgcttctgatatgaagctccctgttggtaaaatcgtcaagtttggagaccagacgcttcagcactctatgtcctttacgggtctcgccgcaaataacctagagagattagccaagaatacagggtctactttcagtgttcaagatggggctgtatactggacaacgcaagggaaaagatttcaaagggcagtttttgagatcagtgctgaatctggtatgcatgattcaccaacgccacagaaccctgagcctgcaaagaggagaaaggaaaaaagggccaagtctaagaaaaaatcatctaagcctcatgtacctacttccgcagaaataaaagaggacgcggggttggtggtggtaacagaaatgaatggtgcaatcataccagaatcaactgtatttttaaagagccagaaatacacaggtttttacaaggttgtatacttaactcacaaaggccagctcgaaggtggggattggatcacagagttaggacttgcagaaacccgtggtggaattgtggaggcctaatggcagcaataacccgtatggatgcagcacttaatcagtggtttgcaaaacaggccagagatattcacacagggctaagggcaacggtagttgatgtggactatagcatcccgtctgcaacagttcagccccttgcgagtacaaacttcccagatgggactgtggatgcctatggctctgtttttgatgttcccctatcaatgccttcaggtaatggaggaaaagcccgcctaacgattcctgtgaaacctggtgatattgtgggtctgagcttctcagaaaggaatgagaatgataataatgaccagacaacacacaatatgtttcctgggtgggcgataattggtgttcacagcgatgggaatgccatgacgatcgatccagacaatgttgaactttggaacgacaaggtgcatttctcaatgacgcctgcgggtgatttcacgctggagacgccagtaggaaaattagtggttgaccaatctgggaatttcaagttcgataatggtgcggcaaacctgacagcagaatctggtggtacgattaagatgaatggtgctcaagttacccctgatggcaatattattactgcgcggggtgtaaacatgaatgatttttatgattattttattcgccatacacatcactatacttggacagatgatggtggtcagaacaataccgatgctccaaatgcatgaggggaatagatggcaactctttattctgacttcttgatggaccctgttactggagatcttgatgtttctacaggtcttcagttgatagaatccaatcaagtaagtctacgacagcgcttatggctaaggtttaatgtgtgggcaggggattggtattttgatgagacctttggatttccctatagaacctacataagcaaaaaggttatgaagacggtccttgataataagataaaggaaataacccgtcttgaaccagatgttttagaaattgcagatttccagtctgtaatggaccataccacaagaagctattctgccttttttgaagtcttaacaaaagagcaggagattgtaagaatagccttcgtgggtgctgatgattactactacccgacgccaaaccctgaaacaacaacactttgcggagatgagggttggataccttggggaaataagttatactaccttatcaactttagattacctaagacaggtgatgcaacttggtggaatacttgggctggtgatatggaaaaccctgtaccaccagggacacttctgaccagaaaaagtgatccagtagtgaccccaggcgataaggctataaacactataaaataaaaattatcacaattcaagatttctttcaggtctgtgctcccctaagacaggccattgttcttttaaatctttgaactttgtggtaaaatgtactaatgttaagaagaggggtatatataagatgctacaaagtgttaaaatttcagagttgccaagtgcgtccactctaacagaagatgacctgatcgtggttgatcaaccagacaatactaaaaaagccactttatttcaagttttaaatcatctcgaagattccgtagagcagtcagtactggcgtcagtactggcggagctggcgcagcctacaggtgccagtaaatcaggattgttgcttggcggcacggttcaggatgcgttaaatggtattattactgtagtgggtgcagatccttcgggtgtgctggattctactgccgtaattcaatcatttattgataaagcccgcgataatggaataggtaaggttcgcttaccccctggcacttataaggctcaggaatacacccatgctatcgagttacctcacgatgatggcaccgtgtaccctggatgggtcacggcagggacggatgtaaacctaccacctgaacctacttattacatgtacgctgccttgaagttgtatcccggcattaaacttgttggggattcaatgcatacgaccattattgatggtggttggaatatcgcatccgggaatattggcaaggatagtggtgttggcgtcctgtactataccaatagcatacagacagacaacgcaggcgggggtcttgtagatattactcttcaaaacttttttgtgtctcgctatggcaccggatgcacggtagataccgaagaagacaatttacggatgaaagatgtcggtatatccgggattttccagaataaagagcgatgcaaacagggttttgtgtttgttgaagaggcttatgctggtgatgtaattggtggtcaatggttgtatcgtagtaatgccagctcagtagcttatatgcctccatacccagcaccacagatttaccgtgctggctggatggatgcttgcgtaactgagcagtatttatatgtgcaacacctcacaacctggggtagcaggcatgaagctattgacgccttcttcgacacctacttctttaaatcagcgaacaaccgaaccactgctaacggtggtcgcctgtcgaataccgtaggtaatggcgcagtgaatgagtggaaggggatagcgggacgagcattatctataccagcccgttacggacagcagccaaacgctaacttaatacttagcttaaaaacatatggtactcacagaacacctgtatggactggggagaatgccgcggcgtcaggctcggctaactttattcagtcagcttatatcgaacgcgtaggcctggtggatgcactaggagcaattggccctggaaactatttcggcatagaccacgttgaccctcttaatcccactcgcgtcggcattggttattccgtggtggatggcttctttggtatggggaaagttcttcgtagcactggtcagccttccgcttatggcagcttccggtcgtataacttggagtcagctgctacacgcaagacattgtttgtggactctgcaaccgattcaaatcttgttgagtatgttgagcagtatgataaaaatggtatggcttcgataccctatcgtagatattcagataagtgctatatgccgccagtcatgtttaatgatggatcgcggcagttcagttttgttcataatagcttctccgcatctctattgagcactagtgatgtaatagctaatggaacagggtattactgtcgtaaagggaatgaaattaccctcaaagtggcattttctatcccagcagcaaccctagctagcttacatggttatatccgcgtctccggtttaccatatactatgagcgttatagggtatgcgcatggtgccgcgcgctggccagcattggcttctgggactagattaagtccacagattgatgctgggtctaagataattaagttgtttgtagatagcgcagaaaatgaagcggttggtgatattgtagttaataagagttacccttcttccagcatcctttccataagtataacgtacaggactgatgatatatgattgagttaaacaaagacttctcaggaacaatttctggaatgccatttgaacatgtgaggattttacttgaggggatttccgaaaaaccggaggggaaagagttcctcttcgctgtggaaccgttatgggtaaatctattaagtggtggtcacgcatccagattctctcattatttagataatagtatatcaaatgaagtctatggcgatatgggcgatatagatattgccaatgaattaataaaaatactgtctagctaactataactgataaaaccgttggggctgtattattaacgtaaaaattagaagtttagaaatcagaggccgaattaatggcatacgcaactattcataccagttacggcctgcaacggttagtgaagaaaaatctgtcgtggcgcatgtaatagtcccaccttcgccatgcaaagctttaacaattatatgacaatcaccataggactgtctcagacgaatttcttggaggataaaagatggccttagaaacaattaaaattgcggagttaccctccgcaacccaagtggtcggagacgactaccttgttgtagaacaacccgataaaactaaaaaggccactgtctctcaggttatctctgacttggacttggctaacaaaggagacctgtctgcgccaggcggtgcctctcttatagggacctctgatggaacagatgttcaacaaagtcttgacactgcccgtgcaaatgagagagaattatggagaagagcacttcatgatcttgggctaactttggtagaaggttctttcgaggatggtgcaacattaacctatgcaaccgatgctatttggcatattgcaggggcgcaatgttacacatgggcaggtacattccccaagatagtccccgcaaaatccacacctgatagctcaggaggaattccaccaacaacatggcaaacagttggcggattaagcatcatagacgagatggttagtcttaaggatgagaccatagaggcaagagatgaggcacaagcttatgcattgcaagcttctgaatttggaaacctgtacccaaatgtcagtgatggcctgtctgcgactgtttctggacaatattttcaagtaccgcaaggaagtggaagttctgtagctttcagggcttataaaaacaataatggagcagccgaggaagttgctgctgtcccagggatagctgccgtcgcatcaaccataagagaatattcaactatttctgacgcccaagcagaagttgcttctggaaatatcgcgaatggtaaaacttgttgggtaattaataccgctgataatacgctctcagatgagtatatgaatcagtctggaaccttgataaaaacaggaagaaaaaatgcctctcgtgtggatgttgatctctctctgtctctaggtattaagtcaacagcattaatgacccattccggcgagctattcaatggatcggttggctggaatggatcagaagttgttactggtacacgatatggtgggtggaaagcaccagcagggcagacaggatttaacacctacgtgtttgcgcaacttatactgagtgcctccgagctgacctttctgaatggcaagacagtgaattttgtcattgacataactcattctgcgaacctgtcaggaaagctgtcggatgcgtcgctttttattccgatgctacgcattaatggtgtggatattacaaatatcccacttaacatagttagtatatcagatacaaatactattgttgtatttgaacggcagatcacatcaagtgattcatctgtaatgctggcaatgcgttacagaaacactactgctctcagcagtgatgtgacatttcataaccggtcggcatattatcgcctacaagacccgaatgggtttaaatctgagttaactaatttcaaccggagacagtatatcccgcctgtaaataatttagcttatttatcgcctaagtctgccgaggcgcttggcggggctaccctggactcaaccactgcaactataaccattccatctgggcaaaatggttacaactcatacatcggggcatttcagagggttcataacaacaggaccagagccggggaaactattcggttggtgtcgaagtatagttgctcatcaggatttttgcggacactgacagctacacaaattggtatgcttgcgcagcggaatggggttcagtcttcaggtgttcaggttgcaggatcagaaaagctgatctcaattgacgaaacgtcatttatgataatggcggattatgttgtcgtgggaaccgcatcagagctggttagcgtttattttcagattaaagacaacacctttacagggtctgcgagaagtttccagttaacagcgactgagtttttctttatctctgatggagaaactgaaggtgataaatcacgcgcaattaaaaatggcgtaacaacatctggctcgcttatgagtcgattttcatcggtcagcggtgaaggtttaaatggcgccgtgcttgacgtagccaatagaaccataaataccccaacaggtttttcaagctataatgcgtatctgcttttctttctttcatacccagggttgactaaatttgttgggtcaacggtacggtttaccatgttgtttgaaacatcggacgatgttactaccgaaacaacacctacggtaaacctgcgagttatcacgccatctggtacgactaactatgcggctgcatttaataccgtaacaaaacttacatcaaatttaatgcgtggtgaggttacatacgttcttacgggtaatgaaaccaccttcgccccgtttatccagttgaaatccaccacggtgcgaaccagtgctggctactttaagctggtagacatgcgatccgatcttttggacgtcgtgacgctgggagatacgctgggcgaccagatgtccagcttacgcgaatctgtgctgaaatcggatattatctctgcattatcaggatctgccagctattcggcgatttacacgattaagccggatggtactggcgattacacgtcattgaaaacagcaattgctgctcatggtggaggggcaactgataaatcacgcattttatatgctgtatatgaaggaatttatacagacttaaacactgtcatacctaagtatgtggatattatcggttttggtcagagggataatatctggtttaaaggagagctgccagatactgtggacccggcgcaaatccctctaacccaaacattctggatgaatgatacgtctcgcatccgtaacctgagaataactgcaaagaatatgcgctatcctgtacacagcgattctcttgcttatcctgacgcctcaatcaaaaacgcggtacttgatgttgaggagtgtgatgttgagcattatggcaatgctggggcgcaggcttatcaggattctatcggaagcggcgtgacggtttggtctgcttatcatgcgtggggttgcggactgcattcaggtgaacagattaacgctgttaataccaattttatcagccagacgtctccattttattttcataccaataaggactttgatttgccgtgcaaaattaaagttactgggggtaagtttgaaaataaaaatggtggttcggctcttgctgtacagaatatgggaagtggtcaggtaaatacctgcattattgatggcgtcacgttgcaaggcattaccagcattgacagcaacacgcagaaggcggaaaaactggttaatgattgggggaatcgtaactctgaattccagattcatatcagaaactgtacacctattgctgttaaatcgactaatgactctcgtgttttacagctaatcagcatcgacagctctaccagttccgttgcagttagcggttcggctgtcccggcgctgtttggctataatccggtcattattgcaggcggttctgggttcccggctcgcgtgtatagctcgcattctgttaaggggacgattcctggtggactcattggccagcggcttggagactgtacgacggttaacaaaacgctgacgatcgtgtttgatggaggaactccggttacgctaactttagcggccaactacacagcaatgaccaacgatgctgttgtgtcggcgctgaatgcgctgcttaacgatgcctcaggccgctctttcagcgttatcacgccttacaataatgctgctccggtgtttcaggaagaccgggaaatactactgacgaataccagtagtgccgtcattctgaaaggtactgcggtagcattcaatggttcaaagttgaacggtcgccgggcaacaaatagtgactcaagggcgctgattgcagggatagcactggagaatatcgcgccaggtgtgcagggtagggtgcaattttccgggtatctgcacacaacctatatcgcattcacgggaacaccaccaacagccttcttggcttcatgttcagtgaatgcggatgccactctgtcttctggtagcacaactccactcctgcaacgtgtggctcccgatgtttacgagattatataaaatctattcctgcgtgagaattttcactattaagaagtggaaattctctatatattaaactatatcattaggagttacagagatgcccaccactgatctttctgtaataaagataaaaaatctttctgacagacccttggtgttggagacagatgagttaatcatccagtcctctatcgacactgaaaaaactacgataagtaaattaattacggatattggtattcttaagagaagtgaaataacaggctcctcaggggcctctgttgtagggacacactcaggatcctctgttcaacaatcccttgacagtctttcgaatagcttacaaaatatatccggtaattattatttctcttcttcagggaatgagattggggctaatgtaagcacgttttccctaagtccctctcagagaacttatggagtccagatatctacccctttagccgcattctctccaaaaacagacaatctgatatctaatggtactactaacctgaggtggagtcaagtttatgcagtaaacagcgtaatctctacctccaataagaaaaagaaaactaatcttcgccagatctctctcgcagagactaaggctttctatgagattggtaaattagactctgtctggcaatggctggcgaaatactcatctgaaaaaggtgccgcaagacttcattctggtcctacggttcaagatgcaatgagagtaatgcgaaagcatggtctcgattggaccaaatattcagcattctgctacgataagtgggaagcagatggtgataggccagcaggcgaggagtacgcttttagaaaagaggaattgctgttctggatattgcgggcaactattgcaatgcaggaggacttggacaagcgcctttcaatcttggaatcttctttgtccggtaactaaccaccctccggggtggttttttcatttatggcttccctccgtttatttgcaaaacactgccacgtatggtaaaatatacaaaagaatcatggtcctgaaaggaggacgaattggcaactcaatatggattgagcgattacggtttcactatcccctctcttgatgaccttatcgcagacacaaaacagacccttatcagaacttttggtgaaaatttcaacacacaagctaacacaattgctgacaagttgacaacaatttttaacgaaagggaataccagattatccttctggcagcttccgtctattctgctcagacccttgcgggggctgagggtatttatcttgatgagcttctttcccgaagaggtgtttatcgtcgaggaaagacgaaaagttcaggatctgttgagatgacagttaacaacactgtcccttacaacatggtatatgcccaaaacacatatacacttgatagtggtacatttgtattaaatgacgacaccacccttgctggtaacatactggcacaaaaaattctcaataaagactgggttgtaggaacttatagtttccagatcaataatcaaaacaccggaacaacaagtcaaacaactctccaattgaccaataaaacccctaatagctctcagcttaacactttcatggcctctgtcaagagctttattgtcaacaatacctccgagcttaataatgataggatcatcattgattctcaaaacggggcattgtacattgggtatgatactaatcttgaaatgatcggacttaacagtcgtgttgatttcagaacatcgccgattgttggtgagcgtacaatcacaatggatgttgttgctgttgaggcaggtgaactgtcgcgagagaaaaatacagtaacctcgatctccccaacaccaggtgggtttatcagtcttaacaatatgaatgccttcacagaggggacagatgttgagacggacaccgaatataaggtcagggcttctaacacaacagcatcgagtgctgctgcgaccagacctgcggtggtgagtgctgtccttggggtgagtggtgtaagtaaggttaaaatcttctcaaataacacagggactaccgaccagaatggaataccaccgtacaagtttgagaccgtggtgtatggtgggtctactgaagatattagcaaggcactttataattcaatcgctttgtctaacgctacctatggtaatgttttttatgatgtccctactgaggataatcagacagaacgaatttatcacagcaaggcgcaggcaagggatttggctatccgtgtccgttataaaggaaaggttctctcaacaactgaacaggatactataaagtccgctctcaaaggggttattgacccgcttaacattgctgacactttatacaacatccagcttgtatctgctgtaggttcttctatctctgcgggtagatttacacaactttatgtggatgtcaagaacgtcggagatcctgatacttcttatacaacctctgatgttgttgcagggatggatgaggtattctctatcgatactgataatataacattcctacagataatctaagagggattatggcagatacagtaaaagatgtcaaccacatccatccattggataatttcgtttcagacggtattgattacctgcctggagactttttacgggagaaggaaaatcttgtaaaatttttatccgtgtatttggagcgaatgaaggccgtagatgagatgatggtcaatcttgcagaagggcgtctcctccagaatgctgggggagtcaacttggatgagattggtgctcaagtagggattgacagaaatggcttgagtgatatgaattatcgtgccattatcacaattcttctctcaagcacagctaaacacgggaccagacctgaggtaattgggacgctgaaacaactcttcggagccgaaaattttaccacttacaaaggtgataattatcgttttgatatcaatatctttaatagctgtttcgagatagaaaccgctatacaagaaataaaagatatgctccctatgcctacgtaccttcgactggtaaaatcagaagggctaccttttgggtttaaaaacgattcctatgcaatcggttttgggtctgtaagcacatcgcgaacagggcctggtggcctatccagtcttatctatacctccgaagaagagaacacactattataagggagaatcatggcaattcctactattcctcttcagatatgggctgaaagtgacgtcgtgttacctaatgctcatactgcaaataaaatctcccctatcgctgatctttgggataagggttgggatttgggtgagaagcccgcttgtgaagaacttaactatgttcttaacatgatgacctggtggatgacgtacatctcagaagagcagatccccggactctctaatgattatctgagaaaagatcaaaaccttagcgatgtatctgatatcccaacggcaagaagcaatctggatgtttacagcaagggggaaagtgattcccggtatgtaaatgcttctggtgatacaatgactggggcgctgacagtacccagaataacattcccctctgattctagcgataccgcttatattaccaccacaacaggtgaggatgaagtctatttagacttcgttattggtgataatgcaggagcagcggggtctccacttgtagattccatgaggttccgctttgttcctgtaaacaactctgctacagtttcaccattcaacatgatggaacttaatgcaactggtacaaacactgcgctgttaagggtccagggtaatattacagccacaggtacgatgacgacaggaaccttagcatcgacaaccattaataatggtggtaatattcagacaaccagccttggtgttagtggtacagctacgttacaaaacctcgtagtaaactccaacaacgcaactgttggtggtcgccaaattgtcaggtcagttaatggtcaagttgctaatgccaatggggacctgtcagtatatatccccccagagggtgtcaccagcattcgtcttggacctgtccagagcttccaggaaaggggtggcaatgaaaggctcccaggcggggttatgacatcttggtcggacagaggatcatctaactactgggtatatctaagacccctccaatatcttattggtggtacttgggtgaccgttagttatacctaaggtgggaattatgcatatagtaaaaggattgacggtgtcttcttaccaagagattgaactcttggggggaatgaagataaaagttccagttttcaaagacgcagggggtgaagattggtcagacatttgcaaaagatttaatgacacttcttggaaaatacttgttgactctgtaggtagggtcagaggctatactaaacaggcggattccttcagcctttatgaagacgatattaacacagttgttgaacttagcgacagggatatcccagatggtttttttgatcctagcaagagaggttcttggtgttggaccgaagattgcggtgtagtagcaagggttttatctacagaagaatcttttgctttaaatgttgcaaagaaaaaagaactccttgaaaatctcttactcctgatagcacctcttcaagcatctgaaaaatatggtatgcaaacaccaaaggaaaaagagaggctaatggaattagaactccttcttgttgatgttggtagaatagacccattacaagagaatatctcttggccccaccttgaataaggaactgttatgtctattgacctgtttgctatcctgaaggcggtctggggggttattacctttgtcctaatcggagtcctaagaataacgtactcggattacaaaaagactcaagagcgccttgatgagcttgacaaagatatcatccgtataagggccgaaatggtcactaaagaaaagttggatgatatcttggataaaaagttaaaagcgattagggatgatgtttcagatcttagaagagatatcaagggagatgttggtgatttaagaacagatctcaccaaacagttccagatgttaatggagagatccgcaaaatgataagctcagtattctattttctgtgctttattattttgttgtttcattctgacaaaggtataaggatcatgtctgtttttggcatggtccatatctttcttgagaataccctcctatggtggttttcttcaaacatccagtttttcgatctatctctttaccttaatctttgttggttcctggatatctcttttatctttggtgctgcgtgtatattatcgggatggaagaaaaagctaacactctctgtagcagtgccaattctcttctgtcagataatatccatgcagtttccgttaataatccccggactctttgattttgtaataaactcttcctaccaaacttggatggaaattatcatactttgtgcaaattttaaagacacgacgataaaggaatggataaaaactgcaactgtcataagcttgttggtgcttgtcagggcattatcattcttcacttattgacccccgaggtaaaatgccaactcgaataatgaagttcctaaaggacttagtcaggtcccctatagaccctgataaggcctcacataccaagttttggagcaatataggactggcatccatgacggctgttttcctgtactggggatttaaaggaacccttacagaatggtacatgtgggtatatgcgcctaccgtagcagctccacaacttataagcaagctaatctcacttcgctggggtttagctataaaggcagcggaagatgaagataagcaagaaatcaaataaggagaccttaaatggctgatataacacaatttgaacaggctgtggatcaggttgtcgaggattctgagcgtctccataaggtggtcaacggatcggcgattgatactgttattgtagaagatggtagcacgattccaacaatacgtaaagcgcttcttgacaatatgtattttaaaacaccaccacaaccttgggctgcggggacacagacaacagtttttaaccaactgtattcctttaccaattcagcagggacgttctggtggtatgctcctggtgcgtcaccatctacacctgtcaccttacctgctgatccgtctacaagtaccgcttggaaagtttacaatgattctgttgtagtttctgaaaaatttgcgcctcttaacacccccgcatttgtcggttctccgacagctcctacccctgctcagggaagtaatagtggtgcaatagcgacaactgcatttgtcaacttggctgtcgcagcagcgatcaattctcttgctgggtcttctccaagttatgctgctcttacggtggttggtgcttcaacccttaacacattggttgtttctgggacatcccaatttggtgggacgcttgatgcctctggtgtgcttggtaaattccagaaaatttcgttatctggacaaactgccactctttcttttgactacaccgctgcctctaactatctgaagactatcatatctccgaactctgttcaaaccaataatctgacttccgcagttattatgaatgggacagctagtgcagataacaccacaatgtcattaactggtgtcggtaataacaccttcgactatgtgtatatccgaggtaactcttccaaggcctctacggaaccaaggcttaaggtaaccggaacgacagaacttgaaaacgtaagagtaacgggttcgttgtccggtgtcaatgtcggtgttgatggtctggatatttctccgaactctgtgactgtgaccactacagtggatgttgggtctgatctgacagttagtggtgttgcaaatttggggaatgtttctattcaggacttggaagttctaaatacgctggaggttactggaaacagtaatctcgtgggagggtttactgctagggctgcaagctcggttacaggaaatcttgatgtttcaggtacacttgcggtgactggtgctgcaacagtaagcacaaatctgacagttgcaggaaatgcaaatctgaatgatgggggttcagggaccacaacggttaataacttggttgtgcaaggttctacaacgggtatctctttcagtgtagacggtttggatatcatcccaaaaacagttactgccactaatggaataatttcagaatccacacttgaggtcgttggtgaatcaactttgcaaaatgtttctgcaacgactgtgacttctagcagaggaactgttggctatattggcttcatccccggttctgttaccacaccttctgcagggacaacttggataccaggagggacaggctctgatctgacgaagatgaataacatctataacgtagatgtgacaaatactttaactattgggccttgggcaaatcttggcagtgcttttactgctacgatttatctgttccaggatgcaactggtggacatgcggtcaccctcgatgcatcttatgaaatcataaatggtggtacgatcagcactgctgcaaattcagttacaattctacaagtaacctattgtggaagagggactgtatatgatgtagctgtctatcaaagaccgtaataaaaaaggctcccttttgggagccttttctttttaaaatcacatcttagatgcagtggatgaagttacgaccatacggcagtccgattggagcaaaggggatatcatcatcgaagtccatcggaggttcatcaaaatccatagccggagcctcttgagcaggaggggtcgttaaacgctcctgaatgggctgtgacggcttctgcgactcttcctgtgccgttgcactggcatagctgtagaacgtcgctgcaagcgcatacgcttcgcgtgtggccttctcaagctcgtctgcatcgatggtctttcctttgacagcaatgttcgtcaccgcatatttgacagcgttacccactgtctgaccaacatctttaccttcagcttctgaaagttccttgatcagtttggttgtaacatcatgcactatcttgcctgccgattctacatcacccttaaagcctgacagcttcaggtttaccagagcattcatggcatgaccagcagaaacaccgacagggtcgtaattgctacgtttgcctttggcaccagaaccaccgctgttctgacctgcggggccataagctttgaatccgttcaggatgttaccgttagatatatccacaaaggcagtcattcgtccaccgacagatacctgggccagttgttcatcggagagaactacaccaccggggccgttcttctcgtcattaacagtcgccagattacctacgatttcggtaatctcaccgaaaatcttaacaccaccgcccgactgtgctgcctgggcagaagactgctgttgacgaggggcagcttggcccgctttgctttcatccagaatgttgaatgtcttaccgcttaaagtgccgttgatataggttttatccccattcttagagactttcagcgggaaagatacaaccatgccagccagaatatctttataaccggaatcaaacttgacctgaactttgtcagtgtggctggcgtggagtttcttctcgcccatgcctacccattcaccttggccctgaggatcgataacattgttgttctcatcaaccgcctgcatcaggaagctaatgctgtgggttgcttcgattaccttcgcaggctgaccgttacgtgcagggatatgggtacgcttaacaccgtcctgatcggcattcttcacaggtttgatgctgatgaatttgatactgccttttgcgaagtggtttactttgccagacatcgggtctttgtattcgtttactacgctcatcttctctcctttattactcagatttttcttcaacgacttgtgtaactggtacagcaagaagttgatcaaccaacatatcttcaacttgcgccaaaaggttttgcgcgaaggttgaagctccactcagttgcatcacagcattacgctgaccacgaatccaggctaacgccgtttcgatagtttcgtgtttgccttcactgattaaacgttccatttcttttctgacgggttcagaattgatatggtcagccatctgaacgctggcacttgagaggaaaatcacagttccgaactgattggggtctagccccaggaatcgtgcttcgttggtaggggttacttcttcagtcatcaatcctccatttattagtgaaggggtatcttacccctttacacttgttatgtcaattactttcttttcttttttgaatttgacatcatttcagccacacggcctacacttgccagtcccagccacccgataatcgccatcaggaagaagaaaagaagaacggcaacaccgaagtagagcggtagtaaaacaagccaccacgaccaggcgatcacgccgcacagtttaagcgtgataaataccaacgccaaaagacctaagaaaccaattttcattttatctccttaatcacaactacctgaaaatgatgaactcgaatcacaggaggaatacgagtcatgactacttgacgagtgacttggcgtatgatgagtatacgtatcactaatcgtggttgtattgatgatcgccgcatcatcatttctccggcgataaccgccatcctccacgaccacacgccttttaggaggtgaaggtggcgttggtggggacattttcaatctccgctcattgttttgtcttgcttgacgaagggcctcgttgagcgtctcattaagctcttcagaagatattgtggtcaccttggttgtttggctaacaaaagtgctgtttcccttccctatagatacgaccgttggtgtacttaataaccccaataaccatttgaaaaatttttggattttattcattccgatctacctcttcaagaatttctctcagtggaggaacaataaccccattctccaacaagaggttagcaagcttctggtaaacatatcgagtttcttttcccgataggtgccacagttttatcgcccgaacatgttcggtctcttcagagtacatatactcataaccgattaccttcgcttgctgtcgtgttacaccaagcagctctgcgaaaacagaatgaggatcagcttgtggcttaccataggcctctgcccaagcatccgggacaaggccactaacaccaagttcatcaattagcataaaattcctccaaaactttccagattgtatttaattcaccgccagacatcagtgaccaaatcaccatgtcttgataacctttacggcagatgtcaacctgccggaatgctttgtggaaacttgttggatcagaccagtccacgggcagatcatctacatttttcttgaaatatgagagaactaactgttcttccagattaggattgtcccctaagcttgcctcatacatctcgacaaacttggcacctgtgcgttcttcacgagttaaagccattctccagtctccatttgtttcggtgtcagagtctttacctgattatcatcaacaggtgcaaatccaacaacaggtttataacagcgctctttctttgcaccaaacacatagaatgatgccacagcctctggctttgcgcaagtagtataatggcgctggtacattccatagccacctaagtaagtcactgcccagaacattaccccaaacattacggctgaaaacacataggaggccacttttcccctccaaggaagtcccccagacaatgaccatcctatgaaggaaaacatagcaagcgggatcaggctagatacccagttgtgattcattgtaaaccattcccagaatccaatcatatattaccccctccaaaactggttgtttcacgtaaatttaaaatgtcttccagtataccgtctacaacttctgtaaagcgttgaatcactcgcccatccttgtagggttgtttctcataaccagtcagcaagcgaaatatgttcctgcacttttctttttgccatgccagatgggccaattgcggattctcatagtagccaagacttttatatttattctcgaccattatgtaggctctgtatttcattcttgatgaaacccagctaactcccagtggtagctctttaatattctctttttggtgagatagtacagaattcaatgttgatggaaccagaatgcaagtgacaggcgagtacagtttaccatcccccagtatgtccttgtcaagttgaaactttacttcacgttctttaatgggtaagtccagctcttttagccatatatcgtgttgtttttgactctgcacccaaagtttaaaagccatgaatgagtgccaactagtatccacaatacaacccgaataggatggatcacttttaccataacaacgtttcaacatactcttccacagaacaaagtaagggcattttttagcgtgtactgtcctgcctgccactcttttacccggttcggtaacatagggggcgtcattaacgcccaccccgtacactagttttctagccattctttctccatttataccaaccataaagagagttgagccagaatgtgacccacatagccaaaattgcagaaccagctccttgatgatgaatcgtagcttgtacccacataacaattgcaacagtgttcaccagtagccaaatcagccattgttctgcataacgaaccatcatcaggtaggttgccagaaccgacaggattgctgtagcagaatcgagacccggcatactccctttcagcaggctaacgaactcggcgtataatccgatcgtcaccaatgccccgataccaacaatccagcgctgttttgtggttagatacttcttgatgacatccgcacgttcaccatcttcagagacggttaacttccgcgcccaaattatcccaccaatgacctgcatcggggtgaacaatagggtgtacataatcgtctcgccgtacaacttgtacgtgaaagagatatatgcatacagcaccgttgccacaaagccccagtaataactggagagcttaccttttgccaccaggatagccccgatgatcccggtgacagaagagatgaactctattaacccaccacccatagtcagggagacaatagcgatcgatgccgagcagatgaggagccaaaggtattcaagttttgaccagccataaaagtcggtccacgctgtcttaatgtacagatttgtgttcatggttattctcctgttaatcgtttaagaagcgcttcgattttaggattcgctgcgccgttaccgtataacttatacttcagatccagaactgcgtcaagcagttctggtgctgctgcgataagatttgcatcttcaatactattaatctctgaacacacgtctctgtaagttctccacccggaacctacctcaagagaacctgagacaatgacctttatttcatcgtcatcctgaaatacttcccatgtatctttagccatttttgcgcccctttttctttttatttttcatttctgaccgaactttagtttgccaagccattgcttcgtcaacagcattcggtccgtcaaaaacttggttcttctcatctgacttgaacacaaaattagtacctttgttatccattgcctggaaaacccagcctgtcagtgtctcctcgatgatcttaccgccgatcagcagaccattactttttgcatgaattgccatttgtcttcctctgttttgcccattcgattgccgcaagtatcacatcacaatgacatgccacctctttgttcggctgtttacagaagcatacaaggtctttaccatctaagtcaagcagatcttgaatagtaattttcccagaacggatctgttgccacaaccacgcgcgatagcgctcaatcgttgccccgcgaggctcatccttcgacaacttatatgggttagcgaatttagattgcttcaggcccaagtggggcattgctcgccccatgtactcagcattttcagggatcactttaccgatgtggtaaaagttgagaactttagccattagacagtcacacggctgtgcagctcgcgagacatagccaccaaccattgtgtgatgccataaccctcgtactcatcagtaagactggagtctgtcagcaaccaaatgatggcgttccgcaagtggtcatctgacatatgggtcagcctgacaaccttcccggattctgttttccacaccatgatacgttttggtgggcgaatatcctcaagacccgcaggggtgatcatcataccggaacacccgcagccgcaatccataactttaccattcccgataagagaagctagggcctctgtagtggcaggctcgccaaatttatcagctacctctttgtggtacgtccatccctgcttttcctccaaagacttctctaagaagtggagaatttccagcttagtttgatccatcgttatcacccttcaagtatgcaataatccagtcagccacctcttcgtactcctcatagccgaagaatttacggcgattgaaataggtatcatcagttgggatgttagtttggaaattgaagtcacgagtcccgccccagtacacagtgatctgatcactgttacgacattctgagaatgacacttggcgacaattatcttctccaccggagtagtccaacttcatgatggagaacccttgctcacgacagttggcataagcctgaagaccttccaccaattcaggtgccttttccaaaataatcttcagaacaccaaaagcctgcttcatgcttgaattagttacgttcatcttgttctcctttttgtgcggatatttttaccatgagtctagcccatgcctctgaatcgctcttacgaacgatgctaacactgtacggcatactgtcggtgtcccgaatgaaacgctcactttgagatttcaaaattgcatcaggatggtataccatcaacatcaggcttcctgttgccccacggtattgacaaatctctacagattcctcaccgttccactggcgaaccaatactaaatcgccaacctcaagtttaggaaaccccattctgttctcctttgatattcagcaatttacggacagcttcttcggctttctgagtacgttctttgtaatcacttcctgagataactaccaccttgcttgtatcgtaagatgtcctgatcattgtgtcaagcaaagaatgtgtttctttacgcttttctggcgtatcctgcaagcgaagaggatcagcaacccacggaacctctggtgtgaggaacaggaataggtcgtagaagttgtagctctcttcacggctcagtgtgcggaacagaagatcggagtagtcgatcttttctgcacaaatgccagagaagtgagtgatcaggtttgtggtgtcagagaacataaccccacaaccaccccaaccagctaactccatttccttcaggcgatgctccattgcgatacgaagatagtctccacgagacattgctaactcactggagtggtattcacgctcacagataagcctcccgatctcaggaatccaaccagcaccgaaggtatgcgccagatgttttgtcagggttgtcttgcccgtactctcaacaccaatgatggcaaccttcttcatgaagcgcttacgtgcaggccacgctaggttgtagaagttgttgtacggatcattacggattatcgtggctgagataggaacagctttacgttctgcgtcgataactacatgcttcgcttcagggaagaactcactgaagtaagactcatactccggctcagaagagaaagcaaaatcgtacttaacgaacggttgcttttcacggatcagttttgcataggcagcactgccttcagggtatcctgggatattcgactcatcaacgtagtctaccttcacgttgtcaagtccctcgtcggcaatgacatccagcaggtcacgataacgatcagcaagtcccagcttaggacgaatccactctggttgtgcgtcaacgaatttctggtcataggacaggaacagatacagagcactaacctgagaagccgcctggcgaatgaattcaatatgtccgttggtcagcggtgcaaactttccgaagataaggccgcgagtaatcgtcatttgtttttctccattgattcaagggcaatgctgtatagaacttgagtcttcttcattttggcaagttccacttcaagctctgcgattttaattttcaattcaagggtgtcgcgtttcagtagggactttgccagttcactatcaacggactcgttaatatcattcgggtttgcttcaggataaaactctgttgcttgtgcagagcaagaaagcgcgagcagggcggctaggataatctttttcatttgaatctcctcttgagattatttagtcagaatttagtagcgagaccacttcactcgaccaccgtcgcagatcagtttgttctcaacgataacaccatcaaccgagttagcaaggcgttgctcaccgttaggcttgcaattatgggtcacgttatctgcgatgtcaagcgatatgtaggcgacaactgcaacaacaatcacaataaccaacggacgcacccaaggcatgaatccacgcatttatttctccttaccagccggaagtatcgacaatcacaccgcccaaaagaagcaggaagaattcaagcataaacataccgaaacctgctcccaaaatttcttttgtttgttgctcatggtctgctgtaaatgaaagccccaacgttgtcagcatggtcagggccataaggcctaacactgcataaataaaatgtgaaagcttcatagggcgatactccagagatgcaccgtaaaagcagcgttgatgactgcacaacctacgtacaccgtgcggtgtgtttcatcttttgaaaagacagcgccgaaggcacaagaaacacaggccactgctgccagaactaaaaagaaataattgattgcctctaacatacaccctccaggttatttagcttccataacaataaagcccctcaaccatgaagtcaagaggcttttgaattatttttgcagctccttaatgtagtcccgcaaaccgcaaatcatattatattttgccgtttcttcttcggtgagcggtctgacttcttcatccacaccaacattgttgtggtagtcccaccaggcgtctacatggacaagtacaagaaacggttcatatcctcttttacgtgtttcccacacggcccgctcaccagtaaaatctgctggtaatctatagaggaagtccctcagcagttttttggtgaggacatctgcgaggtagtctggtgtttgtgccttgacaatattcatgatctcttcatcagagatatctacttccacattctgtacaatagtttgtttgccagttactttcatttatcctccaacacaaaaaggccccgaagggccttggcgggcagattacagagattccagctctttcaggatctcttcacgagacatcgctgcatctttctcgttatccttctctgccagcaggtccagaagtttacgcttacgctcaaccttctctttcgctgcctggcgatccgcgatctccgctttacgcaccgagatgatgtacttcaggatatccagcttcaggtttgcttcgccatttacagcactggcctcgacaacgaaactttcttcagcagatgctttcacatcacggttagccagtttggaaaccgtatccaggctggtattaccagtcatcggcagatcccacagatcttctgtggtcagtagacctttcgggcttgcaaaacgcagttttttacggctagccagttcgaacagggtagcggcatttgcgatggtagtattgatgattgacatatttttgttctcctcttttagtttttcagtatgctgcgttcttcaagaatcgcagccaattgttgttcagttgcccggtacgtaaaggagtgcaacattttctttgcagttatgtacgcacacccgaactcattgcatatcctttggtaaggattttctggaggagcgaacccctccagacatgcaacgagtctatcagttaccggggttggttgcaaccccgttttcatcagaatttaatcttcagggtgcggttgaaagaaccagtaaccttcacaaccaactcattacgctgggtagacgagaagcccaggccgctcagttgatcagtggagtgttcagctttgagcttggaacccaacacttcgaacactttacgatgctcatgcagctcgtcacgcagatactcattgtagaagccacgagtatcgtcagggttaatgcaaccttccagcataaagaagtagtgtttgttacctttggtctgaccatcccagaagttaggagaattcagcaccagagaaactttctggaaggtctcggtagagacgccccatacttctttagattgcttagtatgcccgatgctgtctacaatttcaacacctttcgcacgagaatacttaaaggttacaacggtttggctcttgctattacccaaagcttgcgggtatgcaaagttgaacacttggcctttgtattccatctgtacttcgaagccaacgcgatcagtcatgcgcttattatagttgttaacaacaaccttgtaaacaccttccgtgatattacgctcattttcccacgtaacgttctcaaccggatggtgtgcgtctgacttgccataggcattcatatccacatccagcgtacccgttgagcgaccacgtttgttaccgaagtaaatttgaccaccaccaggctcgaatacgtgcaggtcgaggtcatcactgttgtaccaggacaacgaaacacgcaggtcaccagtcacgctaccgccagcggctttcacacgctccttgatggagtcagttacttcgccattatacgaccaggagaagccgttatcccatttgaacaggttaggagcacctgcgtttgccggggcaaccaggctcatcaggttcggtgtcagacgaccttcaaccagcgcttcgatagtgtccgctttcggcagaacgttgttgatgaaatcctcaatgctgatctcttctactttcgacagtgacttcggcgcgtttttggttgacgctgccagttgctcgaatacgttcatctgggcctttgcagaacggtcagcaaacaacacgttgttgatcgtcaggtcagaggtcaccgcaaagcgacgtgccagagattcagtcaagccgagggcttcaaccttctcttgtgctgccttgatcatacctggagttaccagagctgtagtacgcttgtagttggtccctgagactttgtcttcaaaggacttcactgcggcttcaagatcaataccttctgccagatcgctcatcagtgtaccgatgacatcattacggaagcggcccagtttacccagcgtttcactttgtttccagcagaagttcattcgctgatcttccggcgttttgtcgtatgcacgtttcgtcttaataaaggcagcaacaatgtgctttttctcatcaccacggtacagagagccttggttgatcaggtccattaccgtttcggcagagtccatatcgatatctttcagagaacgtgccagcacagttgcgttgtcacggtactcacccagggcagaagggatatcttcaccacgtttaaccagttcgcgaggcagggcctgatggaagtgggtccaggttttggttttcccattttccaggagaactatgttgctctcagtaccaacgcggccttcgaagtggaagaagcgatcgcggatctcggcgctttcaacacgcgctttcatcgcatcggcaacaacttggtagtaaccaccaactttaacgtcccaaatagagaccagcttgccgttgtgaatcgcgactactcggcccagagtacggatgtagctcttgcagcagttacagtcatattcacggcgctctttatacatcagattggtgccttccgggaaagagtcgaggtacagatcgtacagttcatctttcggtacatcgaccgtgtaaagcgcacccagcgcttgcatgacagcgaactgagctttcagagcttttacgaagtcagcgtaaggtacggtttcatattttgcggtcatttcgttctcctgtttgtgaagttattttgaagcgaggtctctcgtcttcatgtgatacactttaatgctattcgaaacggttgtcaacactatttttaaatttcttgcaaatattcaatcatggtctctaagcttttattcttatagcgtctagaagccaatgaccagccggggtactcattgtcggtatcggtagtgtacaccatccactcacctgcaactttcctgaaaaagctgacatagtacgcccaattaccgcccggagtaggatgtcctggatacataaaataatgggttgcttctttaggtttgttcggaaacatggtatctcctatgaaaaaaggggccgaagcccctatcgttatccatcaatgagttcttgaagtctcttgacaacctctggggattctgaggttaagaaataagatagattttttatcttttctttcatgtaaacttcatgagcctcctgttcagtggtatatctgccaagggtccttttcttaccgccggggccgggcatttttaaagaggctttccatttccctctgtcagcctcataatttgcccctgcaaggccacttccccttgctccagtccaatacttatttagttcaggactcacccacaagcatgtctctggggaataataattttcaccactgaggtccttatcaagacatttcccttcccaagcacaagtatccatccatgctgaaaaggtgctgaaccttaaccattccaagcacacatatgtgtccatataagaagggtcccgcttcaatgcctcaagatcgtaacaacgttgaatcatagaagcccaacgtatgtattgtggtgtatttgatttattggggcaatcattaaaccccattccataaacttttttcattaatggcaatcgctccaattacgaccagtcaggtatgcccctgtaatatgcacagggcttcccatgatacgagctgccttctctacacatcttacgaccatttcacctacagggcaatactggatgtgaattttaccatcctctccaaaaataccctcgtagactgtattgccttccgcatccttgactttatcaccattttcatctttgacggcctttctccactcatgcccgtcaaatacgcggccttttgcttcccattcttttacgaaagctgttgcctcttccagggtatcaaactcccacttcttcaagtatttcttaggaacctggagctggtattcatcgtggtagtaaatcaggcgacgaacgtcatcatcataccagccacgcttgatcagttcccagtgaagcaggataccaaccagatcgaatagagatgcaccaccgttttgctggaaagcattcagaagagagtgcttagaacgggtccaaatcttacgaccatcgagaccagggatataacgtttacccgttgcttcccagaagttttcaagccattccttacgacctttcaaaccaaagttactatcccagaaagcatcgattaccgcctgtgccttgtcaagggaaatgtgaagcattgctgcaatcttagctgcctgagcaccatacatgatgccgtaggttacccctttaccaccgttacgcgttaccagagtaccagaagctttggtgtatgcctcggcgtttcgtgcgtgggcatctccactttccatgatacggaggtattcaccaccatcgaactgatatgcaccccatgccgcgatcataccttcgaggttagaaccatcgataccgacttggtaatattcatcggtcacaccccagagaccacgcatctctttacccaataacaccttaggatctggcttaggcatgtttgcacaaatggtgtgcttacaacgcccggtgttagtgataccagagaaacgagctggaagttttccatcaatcgccaggcgaggatgattcaacagccctgtatcgtttttatcctcgtcaatagggtcgagaacagaacgacggttacgtaatgacagccacttaacaatctgtttagccaagtgaacatcgataacttcaaggttaggacacagcttgccaaagttatccttcaactgtggtgaagtcggcagttgacgagctttgcgtctgaacttcttgaagatctcctcgtaaacacgatcagaaccatgacgatggtcgaacttgttttccgagatattgaactttgcgtcactattatttaagtgctcaagaatcagagatttatactcggactctccaagttcttcgatgtacttacgcaccagaccatcaacctccgcatcatcgcgggtctttttgaactggtctttcgtcacatctttaacacgccagagcgttggtttccatcccgcatcgcggatcaggtacttcttgatgtcgtcctggttcgagatcttcatcggaaccatcaggtctggcatctttccagcacgaagatcggcaattgccttttccattaggtctggtggcaatgggacaagggtattctctttctttatctggcttctaatgaagtctggcatcgctgccgggtcttcaacaccattctggatacagtatctttcccctgctgcacttacatcaccgttacctttaaacgccgtcttcggtggacctttgaattccagcgcttcacgattaactggatatcccagcttgtattctaaccaattccacccgtgatgggaaattcttcctgcaccatcaaaaggattagcagggaattttggctgttgagacttcgtcatctctttgagcgggagttgaggttctacttcttcctcaatctctttcatcattacatcaatacggtctctcagcttttcagcttcatgcttattgaatggaacaccctgaatttcttgctcaatcatcaggtaatcagtcaacatacggcggcgtagcgcgttcttccagttgatctgccgcatcccttccggtttatctttgtacatgaactgcttgtcatcaggccagcgagcacctgtagattcatcgatcagggattgccatactaactcgttgattaaaacgtcttcccagacacgattaacgtattcccacaagggttggttacgccagtcatcgatctgaactttcttgtttgctacacggtagccccaggccaacaggccatgaggacctacacgatctcgcttcccggttaccgggttaagaacagagtcagggcaaccgttgggcaatggacggtcaggataaagcacacggctcatagagagagtgtcgtagagatttacctgtgtatccccaatcgtccccatgcacttcgggtctttgaacatatcatattcaatgcccgataacttcttccacagacgcaggtcataaccaaacaggttgtgacacgcaatggctctacaagtcttcaggaagctttccagctcatcgtatgaacgaattgtaaggttaacatccttcttgctcttggcaaaggctacagcgctttcatattctgggtgtgcggggtctaaaaacagattccagttgttgaccccaaattctttcagcaaagtacaatggtacttcgttacttcgtctaacaggccatcggcctcgttatccagtataaacagacctttaatgattcctcctattcaaggtgggctagactgtaccgtcgcccacctctcagttggtatttagactactttgaaagatatttctgattgcagcataagtgaccgttcggttttgttgatcactaaccacagatacccgattttaccttctgtgtttgcatacaaaatggtatccgcatgagagaagacaatctcctttgcatcaccaatctgatcatcaatagtcgccgccaaagccgatgctacccttgagatacaatggtcaagatggggaccaatggaattatccgataaaaaatctccaacgtctttgtttacccactctgggagataaacatctaagggataaaattcgtcaagagttatggcggtagtggtgatttttaccttagatagcttctcagaaaattcaaggatcttctctggcaagacaccggaaatctcatagaactctacttctggtcgctgaattaaatcagtaacgggaaggagatttctctcccctccgcgctcacgtttctgaatcatcatttctccttaaaaaggcgtatcatcgtcaggaccaagagtagggactggtgtcctatcaagatcgatggttggcttatactcaggtgccggaacatttacctttccaaccggagtttccagagagagttgatggatcaggctctgaggacgaagcataacttcaccattaagcttgaacatcccatcttcccattcccagccggaagcatcggagaactgcccgttgtcatccataaccattgtatcagcgatacccaattttttgtgtgggcggttcttcagcaccacgatacgtacacgtccacgggaacggtcaggaagctcttctggttcaacacccagaaccacccatgagagttgttcaagggccgcagaaccgcgcaggtcttctttacggaccggataccagaacggtaacagattcccatctttatctttcggaagctgaagttctttacgcttcatgtgactgattgataagatgaaaacatcgtacttcttacagaaagctgccagctcggtcatgatgttatcaaggtctcgacgttcgttgtcggacttaagaccagagattaccattgacaggtgatcgaggatgatccatttacaaccatcaaggaacaccatctgcttaagtttctgaataagctggtctgtcgggatagaaccgaagtgatcaaagatcttaatcttatcttcccgaatccagcgttggtgaatctcaaggtgttgctcttcggttaagaactgctccgggtcagcaacaaatgccttagggtccaccttcagctcttcagcatacaagctgtttacagactcttcttcatcctcttccagacggatgatggctactttctcactctcggtccagccatctaggcggggaattgacatatcacgaagatagtcaatgatcgcgtattcaatcttacgagagattgtagacttaccaccaccagacgggcctgtcaatgtccaaagctcaccagtacggggaccacgggtcaggttatataggccgggtagccctggtaatggaacaccatcttttttcttcttgcgaagattctcaatggtaatatccttaagaccgataagcttatcaggaacatagcgatcgtctgctttagtaaacattgcataaagctcgcgtaccttacccgcatcatacatgtcacgaatgtctttaaagccatccgggtcattacgctcgttaggatatcgcacaacgtaaatgttttctgacagcaggaagctagcgacatcgtcggttgcttctttacctttctttattttcttttctttttctaatgctgtggcttcgtcgttatcaaagcccaagactaccttctcataactgcgaatgaacttctcgttgtttgcgaaagtatcaacagcgtttgcagtaccacagtttaatccgacatagggtagtgtcggaagacctccaatgtcctcgtcgttctgaatatgacggataccttttaagatgctatccgcccagtctttaacgcctttactggcctttggactggtggacatagccttaaccatctcatacgctgcctgccatgcggcgcatacgtcaccttcaccttccacgatattgatctgcttacgaccaacacccatagaggcttcatgctgcccgaagaactgagatgatgccttcacagcaccaacagttgaaaagtgtcctgccttttccttctgtaacgtccaatcacgtttcttgaatcccgttagtttcccatacttatcataatagggcaagtatgttgctaccggggtgataccatccgccggggataccgcagaacggatcttaaaatactgtgctgcttcaagagagagactcatttcgggaacagccatgatgcgggtgccagacagcactgattccagggtctcttctactcgattgttactataactcaacttgcctccgcgattacttccaaaacctgctcttgggttttcattgccacctttgcgatacgccgcccaatccggtccatttcccattatccctctcatttatttttctggtaaaacgcctccgcaaaaccgcgaggtgtacaactacgaatatttttagtcttggtggatttgccaccacacttcttccagcctggattgtccttgtacaattccttcacaggaagcttgtcaggctgttttgcgccattgcccatccaaatgcacgtcttcttgttatacgcgtcctgaggagggtatacgtgcggatatagtgggtgtatatcagtggttgggagatacccgccgtaatccttaggatcaaacatgtaatcaggttttcgatacattgaagagagaacaccgacagggttttcaaaggcccacggaacattatataaatctccaaccttctctaccaataggcaaagttccattgcttccttctggaagttagggtttgctgctcttttcttagcccaatgacgtgaacctgcattggtcaggtgagtacattccgggaaaccaaagacgatgtgaacattgtcaccaaccatctctttgatctcttgagcttgttgaacggtcttgtcgtggaagaaccacatcccgactttaacaaggtcaccctcgcgggtgactcctggtgaatgttgaccatcaaaagtccaaacttcatagccagcctctaaccaaggacgggccatgaccgaagtgtaatcataaagaatgatcactttcttcttcaaacggcctcccttagtggaaactgaccccttggtgatcggcatttgttaccgtacccgtcatagaaattggaataattttaactagggtgtaggtcagatatctagcgctttcagattgtcctgcgatagtatatccttcatcaagatgttctgccaacactttagccacgtaatttggaccactgtggttattgaattcgaattcgacgactttaacttcgtgtttcattaaaactcctcctcttcctggaagcaacctacaatttcaagattgcgaatatactcgcgtaaatgatggtataggacatcatctggaatgtcaacgtagatctgtttgcctccagagaatacagcataatactccagatcctggaaaccgttgtagtctacatcactttcacgactgttacggtcgccttccatcacagaataaagtgcttcgacggtgacgacaccagcagtagggtggtcataactgaattcgatctctacaggaagtgcggctttactcattaagtcctctcgcttctaaattaattacgaacgcgccttctccacggcgaagctcggtatcatcacgccagtcacggaacattcccccggcgcgaccatgaaaatatatgcacttatcggttattcgggtaatctccccgaattcccacttttttgctccagcattgccttgagagaaggcgatcttgtcgccaactctcgcctcattcccaaaacaatctttgatcatttagactccagttcggcctttaattcaatattctggtcaatgagtgcctcgataaactgaattgcatggactgctgcactatgacaaccgtcatcaaacaacttccggcttacatcattacgtaaagcggctgcatcaccatgcaggcgagtttccatataagtgcttatggtattccacgcgttagcaccagaacttagatattccagaactgccagcacattctgagggcaggcagtcgcaatgtatgttgcatccatatcattgcgccaagccgaaagattacctgtgttctcatggcgcacaaccggacccatatttccgtctgtcacaaacactgtttccatgccagcatcttccgttgaaaatgcaaccatagcatgaccatgtgaatctatccaccacttacctggtgttgcttgacttgcgatgcgtttcaaatcatcaataagcttacaaatattttcacgatgtttcatcttctgcgccttcataacgagttagggtcaatttagtaacagtcaggctcacaccttctgaagtttctaccacaaaagtattgtggacaccatctaaaactacgacgatgaagtcaccaaccgcaggcggcagatccgcaagtttcagggcaaccactgcctctgcgtattcaccatcattgatgactcgtatagcgatatcatgtccaggaccttgttctgtgaagtcaaatacccgaacttcattttctgtggtttcatcctctttggcaaagagccagttaattagacgtttgaacattcttcgccctcttgacaatttcatgaattatatcttggagtctttcccacgcttccagttcagcttgctgcatctcatcgtgataatcttgagcgatatcacggagtttcattagcttttctgttgttaccttactcaggtcagtgaagtcttcaacctgcatttttgctctcctcatagaacttaatccacttcttagttgatttgataccaccttccaaagacttgtccctctgaaccgccacctgctcaacaatacggttctgtagagcaaaactcatgcgatcccccaacctacggaatggattccccttgtacccattgccattatggatgctaactgcatcctgtaacgagataaagaatgggcgacaaatctttttacatcgagggaatgcaagctggtagccaaagcgaccatctttaacttctgggaagttagaaagacgacgagggacatacccataagcagacatcatctcgtcaagagaggccatttggatgtgggtagtgtccatagctttttcagagcgaggaacctgccattgattccatacttcaagttctttgcggaacttttctaccagctccagacgagaatatgatgccattattttctcctaaaattttcctgggaatgtgtctttgtagaatttaacaattctttggtctacgataatatcacgttctttaaccggacgcaataatcttaaaccttttgtagaagtggccctgctaaaggcaacataggccatcccaggagcaaaagctccataaccaaagtctatattaacctctggcaaagtcaagccttgagctttgtgaatggtcactgcataaccaaggcgaatgggtaagtttgtgtatgttccaacaacaatcttttccaattcctcttcagtcttaccattcttgataacctttcttgggaagtattcaacattttcccagacattcttttcgatctctacaaccttgccgtcttccagttctacatctaccgaaaacttccttagggccttgataataccccgtgttccgtttacaaatttaggaccgtcttcatctggattctgatcattaacggtgatcatgacacgagtccctaccttgaggtgtagactctcagcaactggacgctgggcaaaatctcctgttttggaggctttgtaaataacctcttcacccggtatctgatcgtaatgctttttgttgatacgctccgctgcggcattagttgaagttagggtaatcgcattcagtgctgcaccttttgaatagcactgattgttgaggaatttaactatttcatcaatacgctcgcctttcctcatatgattcaacaacgatgaaaaatgcacactgttttgacgataaatcttgtcaagaagtacagggtatggatttatctctccccaagtgtctgagaaacacgataattctgtgctgtggagttcgaagtaagcgttttcttcagagtctgtcagaactggagggttctgaaagaaatcaccaaacattatgacctgaagaccgccgaaagctttcttaggctcccttctcgcaacacgtagtttctgatccatttcccacaatttgtcggctcgcaccatagatatttcatcaataatgatacgctcaagagatttgctttttaaaagttttttaggtttagtttttactgtcttaccatcatcttctgtggctatccccattgataacccgaaagctcgatgagttgtcattccatcaacattaagtgaagcgacccctgtcggggccactgttaatgttgaacttggatacagggattggattgttttgatcagatggctcttgccactaccaccaggccccgtaatgaaaacgtttttgccttcaatgatagcacctaaggcctcttccgttcccactccaaaatcagacatcaatcctccttagtttcttcttccagatagatttgctccaggatttcacctgctgcaccgattaccagaatatccggtgcgcccactggcttgtcaacccccgtaagcacttcatagcgacagcaacggcacttctgctggttgtagtcgtaagggacgctaaccacgtctgccgggttaacagcaacctcgatcaggctattaccaccaaacccacctgcgtattccagagaggcaatgtgcaggccctggctacaagagacacttggattatcttcaaccatgtttcgcggcatagaaataatctggcctttgtagtttggaaccttcttggttcgggtatcacgaggaccatcacctgtgttggtgatcttcttatacgccttaacgtcaccattttcaaggatctcaaggtcgttgtgctgaataaagtcatacagcatcttcacagaagcgtaggacgggttgtgcatcagcttttgcatgaacttaacgtatcgctcatcgaaagtgtcattttcgatatcattaaggatacgttttgcaagagttgtctcctgcttctgtccatgccagtacagaattccgtccagcagtttcaggtctggtccaaggtcaataaccttctctgccttgaactcttgacctgcacaaatcagttcgattgcaccttgaatatctccctcaatcagcagcagacccacgtctgggaagatctcgttgtcacggttgatcgtgtactgatgaccagtcggcatggagatacagacgttaccaggggtcatgatgaccacaggttcaccgatctctacaggctctttcttctcagcagcctcttcttcgaagtacgtctttggctcggactcttcaacaaccacagtcacaggaaccttgcgtggttcaggcagcagtgtgacagtggcttcgatatggaggtcggtaacctcaaaagtcacttcccaacgcttgccctgcttgccaaggtctttaacagcaccgtagtttaccccacgaggaccctgagcatgatcgatgatctttgcattctttttgccccttgcaaagtcacgggcttcaccacgactcgcaaagaacatagaagactgagcaggaacggcttcagaggtgaagctcatgtcaacctcagggggctttgaagccccttggctgtcttttggtacaaccatccaacgaccagttaccagtaccgccggggataccccgcgatccacaaccttcatgccattttctgctgcaaacttacgggcagagctgcgcgatacaaatagttggctcatttagtttctcctttgctatcaataagttgtcgatactcaatcatctctggtgtgttgaagtgtttaaggtcaacatacttgagtaaaggatatcgagattttttaatctccagaagctttctgccaatacgcatacgggcattgacaattcgtttcgccttccggtcaagctcgtaatacccttcaacgttagaaagggagtacgacatgttgacctttggcttgtattctggatcacttacaaccttaacaccaaaaattccaagctctttcaccaattggcgatacgttgaagagcagttggtgtactggttcagatgatattccatgaggtttgtttttgcaagctcatacaaatcatcgcgaccaatgatacgggtctcatccggtagccagcctgagcgattcaatggtacaatgtacagttttccagtgataccaagctctttcaggaaagtatcagactgagcacgtctacggattaacccgtcaacattaccaagcgcacactcacccttaacctgaccaccgctatagatcatagcagcatctatatcgtcaaaatcagcacgggaaatacggtcgctcttaatagacccatcttgatcgataatccacaccctatgaccaggctcatacagactatagccaccatactttctctcacccttaacaacaggtcgtttttcaagttcggaaagtttgaagaccatcccaacaaagaacggatcgttgaggatatctaaggcctcaggacattctgtgacgtagacgcgtttgaaacgcttctcagaaagccagttacatttggtgcggatgcacttatcgtcatcgttataaaccaacggagagccgttcatcagatctgaatagctatattctcgttttgtctcgcgacgagtgcctttttcaccataggacacgcagttttcaattttgaatgccccaaggtgatctttaaacttatccgcaatgaagcctgatccgtatcggttggcaaagtaaccaccaacacgcttcatgtactcctgaacttctttcagtgttgggagtttcttaagctcctcaacaacctcactgccgcgcttttcaatagcatcggtgacaaacttttccagacgatcacggaaaccacggtcattcttcccttcaattgtccactcacgacctgggttaacatcacagtcaccaataggaatggaaaccatcatcatcggccaggatttattgcttgacaggaagtttgacagataaggctgttgccccatcaccacaacgctgtctgagttcttggacacagaaccgtacatctccagcatccacccagtatctttatcttcataacggtactgcactgggtaagtgcggtcgttaatttctgaagtcacgaacggatcattgatctcatacgggaacttcgcataacgcaagcacttgacaatagcctgacggtactttgaagtctcagaaggatctacgttgaatttgatttcaacgccattttcctcttcagttttagactcgtgcagaggaacaacctccgggatgccttcgttcttatggacagaatacacggtcttaataccatctttaatagacgtgaccgtaaacatgtccgtcacagtaaacggagccttagatccgatacctttggcaccgatcagttcgttggactcacatttggtggaagaccccaacatcatgaatgtctgggtgaccatgttgaaatccatacccaacccactgtcacggactgagtaccaaggttccagatcggttggagagtggatgataatcgccttttcacggcatccagcctctgtgtgtgagtctacagcattgaacaggggttcacgcactgccgccagaactttatcgttataaataccgtcgataagaatgctgaatgtctcagcattaattgcgatccccgcttggtaacgttgtacgctaccagatacctggaccttttcttcggcacgttggattatcatctacttctcctactttttgcagttatttgtatgtagtctaaaggccgttgtagccatacctattgcgtatgctccacaaatttgttcccaatacatgggctgtgacagtgacaatatcacacacagaggggtaatgcaaacaaatattactaagaatttcttcatgagttcatgccccctgagaatcttctttctctttataatagatatggttatcgatcctgactgtgcgtagcatggcctttgtccagtagggttttacttttcgtgaatggtagtgggttgctccatgtgttatgtccagagcatcgtagacgatcctgttttgtttatgaatcttgatcagaacttttgcaaactcttgtgccttctcccagcgatccttttcatagactttaaacgttgttcctgaagatgtccaggagaattgtccgggctggtaaacgatcttctttactgttccaggatacttatcgttatccttacgattcaaagttacgaatgcgatcgacattaacccggaatcactctccccacgagcttctttgtacatgttgcaggctaagatgtttaccgctgtgtcatctttcttgcatagatgaatcaccttgggcttctttacactttctttggctaagacaggtgtggtagtcagagaaaggatacaggcggttgccaaaatagtatttttcaatttcaaatttacactccaaattaaaaagccccattgcggggctgtatctcaacggtggtgagagacatctcctgggactgctctcgcattatcttcaatggtttctgcatttattctcaccatacagcttaagtatgtactttttcgtatcttctacggaagggagtacaatactttcataactattgaaaatagtagtgtgaacataaccatctttaggtaggttgattctcatgatctttgtatcccatctatatacagaagttgtcccgtctggttcctctttgaaagtgatcacaaagcctccaggccggattctggatagaatagccaaccaatacgatcgatagaatatgcccattccgccttgttgtactcatccccttctgaaaagtacatggttgaaataggacctatcttgccgctccaagtatctttgactatctgccctactttaaacttcggttctggtctcaccattcttaatgaccctcgctttttggacatgatagacaaactgtttgttctctttaacaaactttttgccctgttcttcgtcttcgaaaatcaaggtatcacactcggtgaaagaatgtccaggtcttttttcaacagaccgcgttgtggctacaatgagggccattagccctcctcactcagacgagtcatgtaccatgcacgagctttgttgctgataaacttgccaacatctttcatggtcatggagctggcttccagaacatcaccctcttccttgttgatgtctcggttaatccacccaatgaattcaccgatcttagtctggtcaagaccgacttcgctgacaccctgctcaagacgtgcttccgtcacagcgtactcaacgaactcacgcatacttgcgaggcgttctgggtcgattgccgccagggtcttaactttggatacagagtgtttatcacccttgactttaaaccacaggccagagattttagaaagctcaggatcttttggagaccagacaattccttcaccgataccttctacgccaaagaacttacctgccgggcatttgttttccacttcacgagtcagttctgccaggtcattctggacaagctctggctcattgaatggaatattagccatccagtaaccaaagtcaaggatactgtagatacgagcatccggcaatccaattccaaactggaacgttggtggtagccagttgagggtatccgttgccccatcccgtcccacagccacacggaagatagcaaagaacggctctacttcagtgatggcaacacctttctgaatgccacgcccagcccattcgccagcaatttcaaccgggaactggaactcaacgtcattgacttcacacaggtatttaacctgggaaagcaactctgcggtgtcttttcgagacatgaaggccgcgaagccattgttatcgtcgcctacagtcacgacacgctctttggactggaagacaacttcatcctcagagtggaataccacactgccattagtgccgtgaagcttaaccgtaccgatgtacgggatcaggtacgcttccggtggcaacaccttccgcttgatattgccctcttcatcaataccgtcgaacgtcagtttatcatgcatggtgcggataacctgacggaactgtgcggtgcttgggtatttaattggttttgtcaattttattctcctcaaataatttgctaatgtgtccgccagaaagttcaagaactacatatctttgttggtcatcaaaatactgcttcccactccatgttgcgtggacaagattccacgcattcttggcagcgccagagctaatccatccaatcttggctttgtggttccagaggcatctgtcaacagtgtcatagatgacaaaaaccgatttactcatcaggaccctccagcttccagccacgactattcagccattcgtcaatctgaatacccgtgccgtcaccacttggtttctctaccccaagtagtagtatggcaaagctctgaccacgaggggcgttgtaggttaacaccgtattacccacataaaggtcgatctttttggtatgtgctaccataccgtctctcaatttaaccacgataatccagtcccccctgtggataatccacattttgtcatttcccgaatggcagcgatctgttctgatgtcagagggccgtcgtctggagggtagtaaccagggatttcccattctttcaagacataaactgtcacatcacaatcaaagaagattgatttgatcattgcctcgatgacgttccagtcaccgcctgcaaggccagcaccgattttagggaacccgattcgataggtgtccatagggccgtctgtatagctctgtaagagctttttcatctcaaccatcgaatcgtacagggcattgtaatcaaggtccctgaggccctgtttacggcgattatagccgtattgcgaatacagattaaatcctgcgagagatccatcattcaaaaaggccattgtacaggttcccagcttggtcttatcgcccttctcagttttcagatcggcagcgtacatcttagggaatgcttctttgatcaacggggcgattccgctccccattgtgcaatagcaattacagccatgtccaaagacattaatctcaccactttttgcagcatcgatcaggtcaccaactttgtatttgaagctcatcgcacttcctcacattcgtatggatagatatcgaggtcttggcctttccactcacaacggtaataatcaataaatgtcccattatacacttcctccagaacatccagaatatcacctttttggggggcgtgcccttgttcgctgtaacttgcggtcattttaactttcatttacaactcctctctttaaactctttcatggattcaatagcatccgaacgatttttcgcgcagacaacaaacacccgataacgtcgataggtgtatcctgccataacacagtcggcggtgtcaagccaccaacactcgtttagttcagaaactgggaatttgaattttgccattatttcctcttcttctttttcttctttagtttgttgtgaccacgccccttaacgatcttaaacttagcatagtcaacatcatcattatcaatcataatggtattgtttgcaggacgggcagatatcgcgtccaaagaaatggtttctgcatcccacaaagacgctagtgttgagtaccccacaggattaccacaaccaagaacaacaatctttctatcgccaaccatttctttgagggcttcacggaccttttccagttcttctttctggtcttctgttaactctggcccaatgttctgaagattcattcatcacccctgttgtacaaaaagatgagggtagacctcatagacctctttttcaagccctccgagagccttgcaacggcgaacacggtcctcattccaaccgaattccctcacttcatcagccaaacgttggacacgctcatatgcagggcggaaagtttcacggtccccatacaccatgcagtgtgtaaagaaacagatcatcgcctcgatatcgaaccagtgtggctgatatgcctgcactaggtcattagcacctccgacatttttgaaatgcgcttcagtaatcggtacagaagaagggatctcgtcagaattcgaaaagttttttaccataattcccccttcatgaggacaatccgattacgatgggcataatcacggaaggctccaagattatctttatcgtgtttagcgatcttatcaagaacttccattgcggttatgccagatgtccagcctgactgacagaagccattgtctgtacgaagataacactctttttcagcctgtccatatcgtgcctggttttcaatatcactgatgtcaaggtcactgatcctaacaaggcgctcttccccagtaaaatcgggaatgtaaatataaccaaaacctggtgaacgtctcatactttaacctccacgtaataaggtaatcgcttgatcaagtcctcaggggcaccgttttctgtccaagtgaggccttggtcaccagacacatagcctttaccgttaacaaacttgcgccagatgttacgaaactggtttttgtagatcacagaattagacactgtaatgacccttgtgtttgagtctagtagaaattttctgacctgccaagaatttaggattagtcagacgcgattcaaaagactggcgtactttgtgcgcgaagctagaacaataatcagcatccgctaacgcttcttggtttgccttaacgcggatacgcttcacgcttggaacgatggtcaggccaccaaaaccatccacataatagaactcaacttcatagccgtcagcagtcagctcgttgaaaatagggaatgtctgttggagagcttctttgtgtcccaaagacataagacgttgttgatcattcagagtttcagtaattttcatttgagtctatcctcgttttgtttgatacatgaagcataacagccccgagaggggctgtcaatattattttccttcaataagcttaatatcttcagcgtagttgacctggaagtctgccataattttcattatgataggctttgccttcaacaaacgtgcaggaagcttgtcacggttgctcgcagtggtcaacaaagctttaccaaacgcattttccttaatgaacgacaggaaaatagagcttacgaagtctcggttctggtccataaagtgatcgtaaagatactgaaggaagtttccagagaattcaataatctggtcatccgtgtaattggtatctgcaatagccttacgcaaccagatagcgccttctgaacccaaaatccacagactgtctgatggaaggtctccaggatcttgggcagtaccgttcataacgtcttcgatcggaaccatattacgaatcttagtgtggtatgcccacagttcagccattaaaggtgtgccaatgaagccctgaagggccactttagctaggttggcaggcagcaaattagcatcgtaatcgtacaatacatcactggcgtaagttaaagtacgcggtgtggcgaaagaaggacacccgatatccagcatttcttcatagttttcaatagcactgttcttacgagacagaaaaccaatgattgacgaatgaataccgttctgcatggcatagtcttcgatgaacaccgatgcgctataggtaagctctaccagcatcatacggttagccaaaggagcttccagtgcggtcacggcagtaccatccccagcacggttacccgcagcaaccagtacagccccttcagggaactggtaggtcccgattcgacggtccagcatgatttggaatgccagtttctgaaggtaaggctctgcgtggagaagctcatcaagaaacacaatacctttccagttaggatcacggggccagaaatccggcaaggcgtacactgtgcgagtaacaccattgtcatcggtgtatggaatctgcaccccggtgaggtcagtgttatctttatcagccaagcggaagtctaccaagttatcaccaggcccgaaaagagaatccgcaatttgcttcacagcttgacttttaccaatacctgccccaccgaagatcatcagtgaacgtttgtgacgctggcaaaattgcaccagtggtggaagatctcgcaaagtgatccagttaccagaaaagatgttgcgacttgacattatttgtctcctgtaaatgaaattcgggagcaggatacatttgatcctcccccattgcaatgattatttatccacccatacgcgattttcatcacaccaatcataaaaatctttcatgatgtcgttgaattcccgcaagggtgtataatggcgaataggatcagcatcatacccatcattttcacattctgcaatagaggttagccaatcttgatgtgtaggaacattacggaaatcgccgattaaatctaccaaaacattatcacattcataacgatgtactagccgagtagggaatttccgttcaagacgacgggctatctctttagcaagctcatgcaccgtcttatctgtccagtcttctctaccgcattcaccatttcttttagaccagatgtcgcgaagatccagagcagttttccagttagacattggttattttcctcaattcaaattcatcaccgtacccgatcatatgccctttagctgtgatcaccttttctccgaagacgctgcccgtgcatttaccaatgaaaacttccggcatatcttcttctgaaagaataatatccacagtaaatttaccatgatagtgccttgcgttgtaatgcggaccttcatcatctgttttataccagtatttaccgttccagcgatatttgttatgcttgtaccatacgtatgatacccagttgtcttgtgctatatggtccactttggtagtaataagtcggcccgtattgcgaagcaggtcgtcatattgcttttcgcacattttcgcacgatttttcatactgttataatagttctggtaacgatcagctctattgaccatagccttaagaatggtctcaataggcgtacctttctcaagatgttcttcataaagttgttggcttgtcttgcttcccatatcaaatctccttaatagattcgaggtcaagatagtcatcaccgcccacagctttcccgtcagtcttacgatacttcactatctttccggtctccgaatgctggtaagacatccagtaacgagatgtttcgcgaagtttctcagtccacgcccagccgagacgaggcttcttgactgttcctttgtgggtataaccttggtttctggacattctttgctcctgtatagagtcactttccatgatggaattcccagcaggaattccatctttttctgagtatacttgtttgtgcgaagcagtgtcaagatgttcatgacaaataccatttaaagccacagttcgggcaacaaggttccttaatccgaagctggtcgggagcctttacaggagcatctttaaggttataattagaaaaacatctcgcacatactacaaccttgtcaggaatttccatttcgaaccaaggaaggccatttaattttttcgtaatgatcataatgtagccaacatgttgatcgcttcgtggtgttctttcatctttgtcagacgaagatacatgtcatgatacttacgaacacgtaacaaatccttatctgtcagacctttcagacgacgaacatcggagttatggcgcaggtctgcaagcttcacacgtaccgcatcatagttttgggccaggcggttaaaatactcttccggtgtctgattaggggttttcgtcagaagaaccacagcatccttcacacggttcgagaagcctagcagaaccagatccgcagcggtaacatcggtgtcttcaaccacatcatgaagcgcggcgatagccataagctgaaaatcatcagtcttcagatagtgcattaccttcagcgggtgaaggatgtatgggttaccacccttatctttctgattcaggtgggcttctgctgcaattttgatcgccagcgccaattcctgggccggacttaaagcttgaatacaactcttgtctgttgataccatttgacagcttcctctaggttaaagggttttatgttcagtctatcgaaagattttacgttgtcaagccaaaattcatcttcataccctgcgatcgacatcatcatcagttcttcctctgtcggggagtccccctccatcatactctgtaacttggggtcatattccaagtggaacattgtttctttcggggaacaaacgaacattgccttacgtgccttattagcgatctttctgttcatgatgttgataacagaatgatttatttggctacaaatacgatctaatgcggaaggctcaagatagtcagagtaaagaaccaaatcaccactgatgaggcttacatttttaagggttaatctctccccattatgggccatccaagattggataggggcatttttttgataaccggtgtattcgacaaccaaacgaagagcaagagtatcccttgacatccccaccaaaagctgctttatacactcaagaaaatacttagtacggtagttaaaattgcagaacccaccaagaaatgcttcaccgcaaccgtgaccataaatatcgatggagattgtttctacaaagcgatgtgtccaagggtcgccacccgtaatatgtgattggtgggctatttccatacgtgaaacatttagcttctgactcatatcagaaccatactcccggacatcaccggaatgccattgccaataaaaagggccaccatgcgccgggagtttatggagacatgacaaaaatatgtccaatatggggttcgaatcctgtaccccttgaagataatctctaaagcgggtgataggattgtcaacatgtctgtccctctcaaaagttgaaagaaatctctcttgagcagcctgcttcccttgtaacaacttatctatgaaatcccgctcctcattccaagtatagtttggttttacattaatatctaccttgctcataatctcacttaccctcttatacaaataatgaacaaagatacaccgccactttttagaaatcaagggttgacaactcttttcagaatggtgataatcaccttactaagaacgggtaagacccaaggagttagaaatgtttgatattaaaaagaaatttaccaacagcgagattaaaagtctagaagaacggtatcataaaaaggtagaacgcacaaagaaacggggtttagaattctccttgacccttgatgactggttcatgatgggagaaaagcttttgggcatcggcccgtgcgactacaccaatatgaactttagcacgaggtcggtacatggcgaaaaagacccattgtatccgacagttgagcgcattgacgataagaaaggttatgttcgtggaaatgtatgcgttgtcttgcaaagagccaatgaattgaaagatcgtttggttgacaagaaaacagccatcactataattgatccgctagaccgtgagattgtgcaggctatgatactgaatatgtctaaagaccatctcgaaaaactgaaaactaaatatatcccacaacaggagacaaaaatggacatgaaagaacacatggcaaaagtagaaaagaatcacaataccgactacaaagagcttgctgaacacgaacacaaacaacagcctgcggcagaagaaaccactgctcttgtggaagtggaggctgaaccgaaagaggctatcagtgttgcactgccagaagatgtagctgttgcgcttgcttatgcaaattactgcaatacttttgcaaatgtcggtatgaaagtaagtgtgacatatgctcagttcaaggccaaatatattcgcagcacctgtgcaatgacaggggagaagcttactggtgagcctaaatccattctgattctggatcttaacattggctttgccaaagataacttcatcatcgtttccaagaaaatggaaacggctatgactcaactgatgatccagactggccttagcctgccaaaagttacagcaatgctgaacaaggtggtataaatggacaagatccttgagcgattcgcactggatcgccttggacatttcgactactccgaagttgtatactcaaaagagctatctaagaagaaaagagagttcaaaatacgatacaataaaggtgaaaagtatgtcgaagtaacctaccaaggcgataatacaggcggcattgaggttgttgaaataaaggagaacacctaatgtacgaagatatcttgggcaggccagcatccccgccagagcaaaaaatgctgaatgctggcttcaggccgggtcttagtttcggggatctggtagagactttcacagagaacgcgattcgaggaactattgatgggatcgtcttgtttgctgttcctcaccttccgggagcgcctggaccacaattagcgtggggtttcaggattgaagggatagatgaatttttaccccaaattgcattgcaaagggtgatgaattaacctataataaggccatagtaattgatggccttttttcttggagataagaatgtatactgatgaaaaagaaagcattatggaactagctgatgaagcactgaagaaagttcagtctgcccgcatcgctttacttactaatcgaccattctacgggacgctattaagtggtatgccgctgatagttgactgtgcatggcttccaaccgcagcaactgatcatcgcaacctatactttaacccagagttcattatgggtatgcctgttgatcgcaagaaaaaagtctttgctcgtattgacaagcatccgatgatgacacaacagcaaaaagatgaatataaagaatatgttgatgtcttctatcgtcaaaaaaccatgaaggaaattgtatttattctaatgcatgaggtccgccatgtcaccaacgaccacatgtctcgtgggaaaacatttgaccgtagacgtttcaatatcgcagccgatcactatatcaacactgatctggtcaaggagttgggcaagaaagccgagagtttgaaatggttcactcatagacaagtgtttgataagtcaaaagaatttggattccttgcttactgctattgtgactatcagtacgaggggaaaacggctgaagaaatttatgctcttttgcctggtgaagccggggatagtaaaggtaagccgctgggggcgcacatcggggattatgataaagacctagatattctggggtatacagacccacacccacagaagtctcctgatcaggaagatgaggatatgtcttggtctgaggacatgattgacgccgctatgaaagccgctggcggtgaaggaccgaaagaagccagagaattaatcgcacaaaaaggtaaaccgaagattaattacctgcaaataattaagcaacggatgatttctcgtgttaaatctgatcgtacttatcgggttttaggtcgtcggtccggcgggatgacaaaagttcttcgtgatcacggtgctttaactaagaaacagttcatggttatgccgggtagaaaacgaacagaaactgtagatatcgtaatcggttttgacgtttcaggttctatctctcgtcaaacaatgacacgtatctttaatgagatcatcgctttgagcaccctgtaccaatgtttccgtatcacattgttctgttggtcaacccaagttggcaacgtcaacgtgtacacacaggacaacataaaggaaattctggattacagagttacatcgactggtggaacgactgcggcatgtgcttttgagtacatcgatgagtttattcctaaggcaaaagaggttataatcttcacagatggttacatcgaggacctgagacatcgtggctcaagctggggacgtaagtacaacactctctgggttatctgcggtggtcgtaagggttggattccgccatttgggaaagctgtggatctagatgaacactttaaataagaaaatcctggatgaattacttacctactgcccggaaacgggcaatttgtactggaaaaaatcaaaaaagaatacagtcattaaggctggagatgtggctggaagaatcgataagaacggctatagaagactttgtatagactatgtacgtattgattgccacagggcaatatggataatggtacatggctccattccagaaggtatggtcatcgaccacatcgaccatgatcgatctaataatagattggataatctccgccttacgacagtaaaaggtaatggaagaaacctgaaaatgaatattaaaaataaatcaggggtgacgggggttcgttgggaagagagcagaaataaatgggtatcgtatataagggtagatggaaaaacgaaattcttagggagatttgatctcctagaggatgccattatggctagaaaaattgctaacgaaaaacataattttcatgaaaatcacggaattacgaggtgagtgtgcaaattgtccacaatttagattttgaggtttacttgatggggcttggttgttgtctcattgtgaactttgaagtacaaaatggtcatgatctgactggctataggtatgacatcttctgtaacaggaagattgtcgaggtatatggtgccggagaaagtggtgagagggagattatcatttccagggatttcacggatgatcccctccatatcacagaagaagagctaagtctggtcgaagttatgatgacacacttgtctccattcgagagaagtttgcacaaacttggatgtgatctggctgttcttcactacaatgatgcatctcaagagtatgcccaagaggttgttaaaaatcacttgaataattatctggaggtagaaacatgataatctctaagagtttcagtgttttatgctcttatgggatgatatccaatctgaagttatcttcaacggatatccgcatttacctgtacttgaaattcaggtggcagttctttcacagcaaaggctcagagttttgtgaatcaaccaccactatctctgaagaggttggtgtttctgaaaggactgttcgtcggtctatggagaaattagaagagttgggatacctggaagtagtcaaccgaccaggaaaaaccagcctgtatatcaccaaagatgaggtggctattaagtaaccaaccccggacactggtgaccggacaccccggacatggatgacctacgacataataaagaataaaacaataaagataataaaacctaaaacatagatctttataaaaagatcttgatctatggtttagttagtgtatagttagtttcaagaggaagtgatgaatcacttcagtcatccacaagtggattagccatgagctaaccagtttacgggtgttagatgtgtgtggaagtgcgaacttgttcgcttatgtgatggaggcatgggcgacagtgaatcttatgaacgacttaactgggggcggcgcgaggccgacaacaaatgaaaacaatccgtatccgtcaacaccgtggtggcctgttagaaagcaaacaaacagagaaagaaattcctgccaccaaagaagctgtgcttgaatacgttgtagattctggtatgattatgactatgcttcctctgggagttgatgatgttgtagttgtgccttactatgaagatggtaaggacaagatttatatggtgaaggtattttccatgcccttcggcttcatcgaaactgttggaaatttaacacttaactaaagttatcttaagaggagattacaaaatgggttcatggccttttctgatttatgtgattgatgttctgactacagacggtaattatggtggttgggttgctctgatgcttatctctgctctcgcatacgcagcctgctattgcggtcagaagatttatgaagaccttgagaagaatggtacagccttagggtatcagttcttcgaaggtgaaaatctggttcttaaccaagactggagtggatataaggccggggatacgattgagatcgttacggtatggaacagtgataatacacttcgagttcgcttgcctgatggaaagctctccagcaactatattaagcagtccacaatttataaagtaacccggaaggagagccaatcaacaacacctgttgtggtaaaggatgttaccaaaggtccacgtaagatcgcagtctttggcatggtgatctgcttcattggtatcctgtatgctaactttatgcctcagaaagaaactgcgtataaaatgctggcagcgtatgtaggtcagaatgtggttgagtcaccacgtacacaacaactggctgacagcaccatcaagtaccttgatgctcaaatcaagaaatatactgaagagttggatgcagccgccaaaacaaaagaagataaaaaggagtctaagtgaaacctttcgagaaaaagaaaatagcacttgacttcgatgatactttcacgttaaatcccaccatgtggcatcacattgttgatttgatgattatcgaaggtgactttgatgttcgtttcgttaccttccgatatccgactgataataactcggacattgagttctgggctaatgagctggatatcaaagtaatctactgtagtggtgtacaaaaggctcaagtgtgtgcagaaaacggctgggcaccagatgtctggatcgatgatatgccaatcctgattccaatgaaacaacaactccagggtatgatccttggtattgaaaagaacgagggtaagccatgaaattcgaagaatggttatcgcaacaagatggggttattgaagtagattgcggctgtgttaccgcagaagctttttatcactggatgcgcgtagcttatgaggctggcaactctccggtagtgccggatgatgtgtcgatattcgaagcggcaattgaagaatgtaaaacgtgcgactcaattgatgagcacgcatggaatcatggcgttttggtcgtgatggcgaagtatgaatcctgccgcgcctccatgctcgcagccgcccagcaggaggtgagatatggctaagttaggaaagcgtggataccccgcactatacctcaaaggcagtaatgcttggtataccgggtatgcccatgactggaagatggaagataaggtggatgtttccgatcgtcatgaaattcgtgagctgaaactccagtacactggattcagtcgtggtcgttctgctgctaatatcgaaatggtcgatcaaggtgggaacaagttcctgatgtcgatgtctggttttgatttgctgatgaagatagtcgatgcaccagaaaatgtccaaaaagcggaaaagcttcgcggatatgatatcctccgtagcacccatcatggtggttccggtgtctggtacgttggttcattttgtcaaacaaaacaaggtcagaactattttattgaacctgtggaggtgagatgatgagcttagaaaaacggtctaaatatttggtttttaagttctgggagatcatgtatgatgtctgctacctggtgtttggaaacctcccggtaactttcgatgtcaaacacaagatgaatatggcgtatatgcgctaccaaatgaaacgtgactgaaaaacagatgctatgatgccccgtatgatgcgtagaaacgccgtggcggggtttttagcacataaggtaggcaaacgtactgcctttgcataaaacgcctcaggattgattacaggacgatatacaatgaccactattttaaacactctcgaacttatcccccataacaaggttagttatgattttcctaacgtgcgcagcgaccttgaaaggctttaccttgatgcagtatatgcccttggtggtgtagaattctctactgacgagactgatgagatgactttcaatcaagccaaggccagcgtggaaagtgtgcttgatgaccttaagcaatacgctacaggttcagaggttgaagggcttctcgattatgccaaggacactgaacgtgcctttgttgaaagaggtgagtatgtactcaatgccatgcgccgcctgaacaagttcagcaaggatattttagatatcgacaacacctggaatagagaagacattgcaaatggtgttgcctggatcgcagaacaacttggcgagatgtttgatggaggctcccctatacggtatatgatgcagaatcgtggatggcgagacctgtatcttgattacctcgtgaaccttgtcggtaacccggtagtagaggtgcttgcacattattcttctgctcatgatttggtgtatggtgtcgatggtcgtatcaagattgctgataataccgttacacttatgactggccctacttccttggtactttctcctattcccggtgatatgcgtattgtttacacagtcccaggaaagacagaacggttcctgatttctgtattgagcacatttttcattgacatttgtaatccgactccagatgagattcaaatgtatgaaatatctacaggtacaacctatgatatacgtaaatggaaggagatatttggatggagatgatgaatttaaattctgagatggaatcaagactgtctacaaaacatcgaggtaagatctgtggtataggggttaacgatgcaccttttaccaccagtatgcgtaaagatggtaagatgtatcaccacacagcctataaagattggcataacatgataaacagatgttatagtggaaagtacccatcttatcagggggtttttgtatctgaagaatggcaccacttcatggatttttatctttggtggcagatgaattatcatgatggttttcaacttgataaggacctctttggtgataagttaaaatacagccctgcaacatgcagatacatacctttgtggatgaactgttctttacatggtggtggtaaacctggtgtacattaccacaaagcctctggcctttatcgctcaggaaaggatgggatatttggtacatttgaggatgagggttctgcttggaaagcttggcgtaataattttgtaaatacaacagattatgatatttggaacagcctggatatttcgatcagggagcgattttgtaaattgaaagatatttgtatgatattttaattttacatgatattttaaaattcgaaatggttttcaaaatcgtttttgaaatggatttcatcttccctgtaaattttaaatcaagagttttgggagtagattatctcaaacctttgtggaagctatgtcgaaaaatgatgcacaagtgtatgattgctataggtatcttggcatcaagattggacatttatctcaaataggcgaaaaagatatctcaaattttcaggtagaaaactctgggttctcgatcgacttttcgttttcaaaaacgtatttgctctcactatcaaaaaatttttctctatatcaaccgggttctcgatcggtttttcacaatcgagatcgtaattgttttttctctagaaaaaatttttcggcccggttctcgatcgagatctcaatttccagatcgtatttgttttcttacgcgaaaaaattttttaggggtatcgctcagtatctcacatgaaaaatcagaagtcaatatttaaattttttgttgaatgagaagcattcttatttagttatttgaatgataatcattctcatttgctgaatgacaggcacccccggtgttttgtactccggtttcgatgttcccgctatgtgtataatataggatacctggcccccgtttgcaagcttctttacaattctttacaaataggcttaatgcgagctaccggcgatccaccttccaaccaggtctccgcgcctggtatgttagccccgcctttccgccgtggggtggcgtctcttctcctgtctgataaatataacccatgtcggggccgtttgcaagccccgcgataaaatattttttactcccaggagtccgcgagcacttccccattttccgctacaattctcaccctggtaaatcctgcattatacattttcaacgcgaagggtaaaggcacgatcctaacctggggcgctgcgctttccgtctcccaggtggaaagggtgaccattgtctcactcgttgttacttttgcgttttccatttcgtttacctttatttgtgggcgtccttatatagtacactaaccaggcctgggcgcaagcccacacgaacaaaaatatttttaatttattttcatccaggggattgacggcaattagtaaagcgcttactatccatctcatcaggtccccccgtcgcccacacttaaaaggtaaaatagaatgaaaatttccgctaacaaacaattgatcgacactgtaaaaaattatatccgccacccgtatgagttcggtgggtatccgaaaattttaattatgcgtgatggtggttgcctttgctcaaagtgtacgcatgaaaattttacccgcctattggaagaattaagggatgagagtgatctggcatggatgccagccgatgtgggtattttctgggaaggtgcggatttcccatgtggtaattgccagactccgatccctagtgcatatggagatcccgaagaagaagaagaagaataaatatttaattgacacgggccagtgtccggggttacaatccccggacctgacaatcaaaacaaaaaactacacaaatcgaggttacaacatgaaaaacatttcttttactacccgtgaccaggcccgcgcttttgcccgtaatgttaacagcaaggtaaccacggcggcgcgtttacgtcaacctgttaaagatggcgccgggcaatgggttatccctgggatcaaccacggcaaaaccttatccctggctaaataaaatattttatcctgggcgcttgctttcagttagcgcctttgataaagtgttttctcaggcggcaagggccgcgataaatcgaggtaaaaagcaatgtctacgtttaaacttaataatgatctggttgtcaactctgaatccgagatcgtgcatagtgtacctggtaaaaaatccacagcaaaaaagggttatgtattatataaaggaccgtcagtcctggataaggccccgatcgtagtcattgctacaatgtcaaccgctaacgataaaacaggcgacatggttcaaacctggatcatgcgagaagatgttagcccactggaagcaagcgcgaaaaaacttgattcctccgtttgcggtatgtgtccccatcgtaccagcttaaacggcgcttgttatgtgacattacaccaggccccgctgtcagtctggaagtcttacaaaaaaggcaactataaagatcttgattctcgcgatctggtacattttgcgggtcgtcatattcgtttggggtcctacggtgatccggcggctgtcccttttgaggtatggcaaaacatgatcaaccatacgcaaggtaacacggggtacactcaccagatccaccataagaattttgatcatcgtatcgctaccatttgccagatctcagccgatacggagaaacaagcgatcacagcatggcgtaagggttataaaactttccgcgtgaaaactcccaacatgcgccgcttggaaggtgagatcacttgcgttaatacaactcacaatatcagctgtttagattgcggattgtgcgacggtaaacgcgccaacgttgtgatcgacgttcacggcagatccgcaaaaagattcgataaattcgaacgtatcatttgacaagccaggccaaaaggccgataattctcaataaggcggggataggccccgctacacaaaaacgaggtaaactgtcatggccctgaatactaaacaactcactgctaacatgctttcccagcgcacattcaaccaggttagctattttgggatcttttgtggcgaggttgaatacaataaaaagatggatatatgggcgaaagaaggctatcacggtgaatatgtagctgtaagaaaacagttttattattatttggggcgcttatggcattttaccttgatcaaccaggagtggcgcggtcgccgtcctggtgatttaacggcggcaggctggcacgttgtagaggataatcaaaaccccacaccaaaacagatcaaagcgctggctatcggttcccgcttgcgtatcggtggcagaacgtggatttttgaaggagttaaaaatcgtgtatctttttacggtcgccttgctggggtggcaccaggtcaccaaaacagcacattcacgatcaaatattcagaggttaccgaaattctttaattgacaaccgcgccgcctcctgataaggtggcgcatataccagacaagcaaccaaaaggcggttcatcatggcttacatgaataaagagaagaaagcgaaaattgttgaagcggtgaaggctgtattgccaaaaggttggaaagttacgtttaaagtaattcactattctacgatccgttgtaccgttcgatccgcgccgttcaatttggatgatgttttagatttaacagattgggaacgggaaaacgggcacaaggatttaaacacataccactatgaaagatattgcaaaactcctgaattcaaaaaggcagttggcgaaatcatcgaggcattaaatacagataattataacaatagtgatataatgacagattattttgatgtcggtcactatatcggcctacattttggaggccatgataagccatttaaaaacagcgccgcgtaatatgaaagaattgttgattctactcatattttgttattatgcaaaaattcacgtcaggatctggcgtgttataaaatggttttactactggtacagggttaaaacaatgttccactatatagaatatcgcttccagggggaggagtaccacaccaggagatccgggccgttaaatgatttggagggtagcggcctgatttgtgagattaaacaccggggaggcgtggtcctggtacataaagagggatccttcgactacatcgaagagctgatcgaatatcgcaaaaaacagatcgcggaatggcgagcggaaacatacaaccacagggaatcaagatatgacagcaaaaagccgcaactttgagaagatgacaagccagcgcgatcgccttgcttttggtgagactaacgagcggcgcgagcgtaacaataaacggcataagccggaacggatcgcggttcaatggtcgccggaccagtatgatccgaagctaaataaacgcatcgccgatcgtaagcgtaatttgcagcgatacgccgtagcaggtgaataaccagtccggggaattatccccggttttttttttatgcaaaaaagtgaatttagcgagatctcagcgtagcaatgcacttaccagggttacagattgaagcgcttagaatcgatttgagggcgttttagatggtatccgataaccgcgccccgctcaaaacgtcgcaaatttagttaccggttgaaactaattgcataacagcgattttctatgcacatcactgcatatgagaacagttctcaacaattcttaaaaatatttgttgcatcctggcggcgttatgctatcctttaatcagtggcggaattcaccgccacactgaaaaaggtaaacactatggaaaagcaaaacatgtataaaacggcctatagttctgaattttgttgttatgttgggattaatcgcgcttggaaagattcaaatggtaaatggatttttgagtgttcaaatgtggcaaagggcctagataatttcctttttcgtgagtcagaactagaaaaattttgtctctaattgttgacactggttaatgtgtggggttatacttcctacacattgacaagtgaaacaaataaccaaaaggtaaacaacatgcaaaacgtaaaatctgaaatcgccgctcttgaatcaaaattcctgggcaaaatggtgtatcataactatggtcaaatcgcttttggcgtggtaaccggaatcgatgatcgcgatcccaataaattacgtttacgcgtgaagtttacccgcaacaatactccggcgcatatcaaaaaatatgacaaccgcgcggatcgtgttcgttgcttactccctcaatctgttaccgtgtcccgtgttcaatatgggatctataatcagacaaaccagatcaacaaataatcaatagcggggccttgcgccccattaaggcggctaccatgtttggatttattatattggcttgtcatatttctgttagttcgatggcattacaatgtgattggaatgttaaaaaaacattccccacggaacaggcttgcaacgtgtacgaaaacgaatacacgttaggcaaaggcgagcagatcgggatctgcgatgagttagaccccggcgttaaagaaggcgataagcgccctattctcaccctcaaaaagtaaggtaacgatcatgtttgaagtattcgccggaatgtgtttttatagtgcgctggccttaaaacagtgtgatgattatgtagtagaaagctatgatgatcaattgacttgcgagatcgtcgccgttgactatcagcgccaggggcgctggattaatccggcctgcataccatcgccggaagtcgaaccgatgccggaaagcgaaaataattattgatcccctggcccggttaggttatattacttggaccgggcaatattggcccgctgcgaaaaaggtaaaatagtatggaaaaggcaaacaaatttttctttctggaaaatgttaacgataatgtcaattgtgactttaatcgccagggtgaaaaaaccatgttagtattttgccatgagaatgacagcgaacaaacggaccgtttaactgtccttatccgcactgaaaaatccattcaatcccatagcgggaaacttgaaaatcgtcattttatcgcctacacgcttgaaagaagcggagtaacaataaaacaggctgacagcctgcctataactaccccggatctagtctggatgtttacaactgctattgttaacgatgttttccgttctaactgattgggaaaattatctaaaagtcgcttgcaaacgtgggcgacttttattatatttaaggcatacggcaggaaatggttccggcccaagataaaggtaaacgaaatgaaactttcccagcaatttgctcaagaatgccgcgaagaagcgaagtattattttgatcgcgccttgcaagcgaaagcagaaggcctgaattattcccgccgtgtttgcttacaggtcgctttattgaatcgcaaaaacgcccgtaaatggtccgccgaataatttgttgacactggttaatgtgtgggataagatacccgcacattgtcaagtgaaacaaaaaccacacaaaacgaggtaaacagaatgaccactaaaatcaccgttacttattacatcgactccggcaagctgaatgcaatgtatacattgcgccgccgtaattttggtggtggcgtttttgcagattcttacatttgcaatctttcaaccgatccccaaaaagcagaaaataaagcaaaggaatattttgatcgagtaacgtcccggatcgccaatacagaaaactttgagcaagtttttgcaggctatgcggattttgagctggggcaacgtcgcggtaaattgtcgatcgtcgataccgcccggatcgaagaaatcgaagctgggcgctttccgtttggcaagcattgcggtaaaacgtttgccgatgttaaagaatcctatgttttattttttgccgatatggcaaacaagccagacaacggcccggtaatggaagcattaagcgcggcatgtttgggttatgctcttgatcatggttacattgcagcccgtgaccaaaaacgcgccgagcgtaaagccgaggatttaaaaagcaattggatcggcaacattggcgatcgcctggtttttgagggtgagattattttttcttatctgaaaattgatgaatggagtttatcatcttactatattataaaaattcgccagggtgacgatctggttacctacatcggatcaaaagagttaggcccggttggcgcggttattaagtttagggctactgttaaaaaacacgatacctatcaggacgtaaaaacgaccgttgtaaaccgtcccgccatt

SEQ ID NO: 137 - DNA, 177937 bp, Unknown; identical to SEQ ID NO: 7
  source: /note="Description of Unknown: colon-14-15 Bacteriophage Sequence"

SEQ ID NO: 138 - DNA, 178567 bp, Unknown; identical to SEQ ID NO: 8
  source: /note="Description of Unknown: colon-36 Bacteriophage Sequence"

SEQ ID NO: 139 - DNA, 179531 bp, Unknown
  source: /note="Description of Unknown: KP2-4a Bacteriophage Sequence"
cgtcattagccagaataccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcagagtacggcgatatgtggcaacctgaccgtaatatgttgtgtttccatatggaccgtccgttacgttaccaccgaccgacagaacatcgttcttttcagtaaccgcagcagccccgaaactgtttccagacataccgcgaggaatacccgtgatataacgttcatcatggttagcccagtttgacggagttactgtattcgcagtaatcgcgccactaactgccattgatgtagcattcgttaagccgaggttagaagtcccgattacacggaaagatccttgctcaactgttacctgttgggtttgtgaatccagactcaacagcgtattttgagtaccatttttaaaggcacggatgtatattttattacctccgtctgtgcgagcgttcacgttaattgcacccgctaactgtccgccagaaataccgttgtatgcgttaatgtccatcaacccagattccgcaccaggaaccgaagtaatatcagggcgacggaaaacaaccaccggagcagcagcacttcgagtgatcccgaccgaccggttagattgaatagtgtttgcggtcaacagaacgcctactgtcacgttttgactaaacgtagtattcttcgcaacagtaccgccgttaatcgtcgatagtgcgtttatatcctccgctgttggacgatcgttttcggtgtatactctccagcctttatacgttaattgtccaccagagggcaatagaggaaggttagaagcactccagatacccgcaccacccagcgttgtacctaatttcaaatcagccataaaaatttctcctgtaatgactgtatttatgaaaaaggggctttcgcccctttaacgcacaattgacagattaacgtctttagcggacatcgaacctgtgcttgtgttgtttggataacgatataaaccgaaatcaaacataacagcaccagcaggaataaccccttcgtttttgtagaatgaatatacgttcgggatcgtgccaacatcacgcatgttaattccagagatatacgtattgtttgcatcccagaactgcattacgatgtacgcgcccttactatttgcgattgctgttgcatcacgtttcatttggcattgcatacggatcgtatcaccaggttttattccataactgcttagtgatgctttcgttaccgccgcttgctgggtagcagtccattctttgaactggtactccgctgtattggtagaagtatattcagtcggatcagaaacaatataatcaagttcagcaaagttatgcgaactaattttcttgtcactgataaccccaacaggcgaaacaggcagagaaagcaattgttcaatcgggtttacggttccagcatcagtgacttcggaaagtgtttgcatcctaataccgttgacaccgatagccgccccgtttctgttcacctcttcgcgagggactttacagaattggatatttcggcatcgggcctgacctgtggtaactgttgacggataatgataagcagaaacacccaaacgagttatatcagcattatctggaatagtgtaatatcccgataccgaatgccatgtatccgcagcaagtccagttgttctaagaactgttgatgatatccactgtccagacgcaatatgagtaaaggcatacagataacattctgcccccgcattacgtgcagcctgatcgatatagatgtccgcagtgattttgaaaatatcattacgagaaacatcactcccaacgttccaaaccccgtatgctttgaatggataaccattaccgctatacgtttgaggatcatccagcattctttcaggaataccagttaccccgatatcactaaattcatcaaacacaacttcaacaaaactcgttgtattgtctttcaaccccgtaccagaaccaccgacaaagttttccatgcaaatctttttcatcgttgatgaatagatagctgaataggatgaacggtgagaatagttggttgtggtgatcgggatattaaagaaccgagtttcgggccacgcaacagaaccaattttcctcattgtcgctaaaaagttatcatcacttctgatcgcatcgaaagtataaaaacacacaattctgttcgctggaagtgaattcaggtagtctttaatcgcattcccgttcgtagcaggatcaccatacatatcaaatgatttgtaatccaataatgctaaagttgttccatcaatgactgccaggttaattccgcgagcaacttgtgtccgcctgttaataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgctgggtttgcgaagattttcacgttaccgattttgatatagttacgtacaaccagagtatcgacggttgaacccgctaccgctaccgccccgatttctgccggagtcggtttacgacccgcatgatagatcaggtttccgttgatcatcgctttgttgtaatcggtgatattgatgttgaactcagtcaataccttatcgtcaatgccagttaagcgcattttctggacgttcccagagaaatcacctgcctgaacatgtgccgtaccgctcacactggtaaagcgtccacccgtaccgtttacgctaactgacagcgcaccagtcatagtatcacccgctacgttgacataggtactgtcaagatgctgggtaaagtttcgggtgttgatcacggttgcagtggttgtgccgccgtcattactgattgttacaccgttccaaccattagttgcagcggttcgtaattgtaccgtaggcgttgctgtactcgcaacaaacaaatcacccgccgtgttgatgttagccagagctttaccattcagacgaatgttcgtaccggaatacgccattgtgccgttaccgacatcacctactgtcagaacgtcaaccagatccgttgtgcccgtcgccaggcgatacgtgcttgcctgaacagtttcatgccagattgtatccgtcacaccaccacggaatgtacgaagcaggtttttggttcccgcagcctcaccactcagaacagtattagcatacaccgtgtttgctttcgcagactggttaatgttattgttcgtggttacggtgttgttaaccgttaccgcagcgttagccgtcagtgttccgttagtggttacgttaccaacgaagttgctcgtaccgttaaacgtgttgtttccagttaccgtctggtttgcatcacgacgcatccagcttgcagcaaccacaccgcccagactcaaactattctgcgccgttgccattttcggtaagaagttttgcagagcaaagttcagaccgcgaggcgatacagcatagaaatcttcgagataatcgtcaacggcctgagtagaaccaaccagattatcaccgatgaaagtgtttgctttggtagtgataaacaccgcaccacgtcgagttgttgttgcaccccacgccggatcagtaccgttcaaaaactgcatggtagccggagtaattgccaggttagtagcagtacccgcacccgcttccgcgttagtcgcacaacgaataataccttcggcggtatccgtcgctttcttcgcttgcagttttttaggcgtaatgaacacggtatccagaagacctgcatcagtttcgccctgagtcgcaacgcgtaaagtaccacgctgtgtttcagtcgcagacgcaatccccaggttaaccgttgtccagatagtgccggactgagttaaaccatcagcagttgcaaccgcaacatgactcgtaacgtcgaagaactctttcagcttaaccggaacaactgccttattcgttaccgtacctgctgaaacttccgcagtggtagcgagggcaataataccatcaagcgattcagtagccttgcgatcgttcagtttcttaggcgttacagcacggagatcatcagttcccgtgtttgtttctgtctgggttgcgatctcaatcaatccgatacgcgattcagtagacgttttacgatgcagcatttcaggagttactacgatcggcattgaagcagatccagcagcagcaccagttaccacttcgttttcagtcgccagaacaaccagaccttttgacttttcggtcgccgtcttctcgttcaatgatttcggggtgacaaggtcaacaccgttattgaagttgtagacgttcgtaccagcatccccacgtaaagccccctccgctgtcgtagcgcccgttgtaacgagttttccgatacctgctaaggtttcgctcgcacgacgcgtatcgagctttttaggcgtgattgcggtagtgtcatcagtacccgcgtttgtttctgcctgagttgcgatttccagcaccccacgacgatcttctgttgctgatcgttcgttcagctttttaggcgtcacgatcacgtcatcaaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacggtttgttggatcgacacgttcaatgatcgggcgatactgtgcaactacccattctttcgtagctttcagatacgacaattccatgtatggaagatagtcagtatcggcattgaaagtcagagtgtcaacactgaaccaatcattaggcggataatccttacgctgtgggaactgcatcatgtttttgttggtgcggatcttttcaccggaaccatctttaactttgatcgtgcagttctgcgttttccccatcatgtacatactgatatatacgcgatcaccttctgcaacatcttgcggaagagtcagcgttacattacgtacagttggtgggttgccagcaatcggagtgatgaacacgtaatcgttaggcaacatgttcaggtcatcactgatacgacgcagacgaacgcgctgatcaccgtcataaacaacccaacggttattagcctgatcgaacatgaagataccataaccggaacgctgtgaagtcacagaggttacgttattgataccgtcatagctgatcgtgtgtccgctaccaggataaacttgcagagtcgcaacgttcaccgaagcaaggcgatccagatcgtaagttgtgattgagtcaccatcgtttgcgtaacgaggcaactgcaacgtaattttacccgtcccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgggtgtttgaacgcactaacaggttgttaacccctgcaagaccaccaccatctttaatagtgataatatcaccctcaacaggggcatctggcagaatataggtcagttcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcaggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagtccagaggacaccgcaaccgctcggagcatttgacgcagccagggtaacgggttgtaactgaataatgctaccacgttagtatagctcgaatagaagttcaacccgtgcgagttgtacgggatttcctgcccctcgctaaacttcgatctgtatgtgttggtgcaatagatgaactgttcgccccctaaaagcgcctccacgcgttttttaatctgggtgtatactgtcgtcccagattgagagagatcgcccgtataacgcgaataatccccctctgcgagcacatgtattttaatgcgcttcgtgtttttatattgcttaaagtcaaccagcgtttgaagcggtgaatctttgaactcaacatcatgaaacgtttgtaggatcttccctgtaatcgtatctttgatgttggatgaagcaatagttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtatagagaaaaatccttatacaaatcaaagtcatcaatgtttttgagtgctgcatgagtgataaagatcacatcataatctttgacaacctcacgcagcgcatcgttattggttcttttggttcggtgatccgtgtccacaatcaccgctcgtttcccttttacctggttgatgtagtagtcataagactgttttgataacatcatggaaatcgaagcgatgattgctttttcgcccgtttgattgatatggttcagaatcgcctttgttttaccgcttgacggaacacattcaatcgtattaaagatcatttattcttagcgtatttcttctggtatttctttattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcagggaattgatctttaatctgcttatgaagacgatcttcgagcgcgtccaggtgagtaggagtgatgatcgcggtgttatcgcgttcaacgaatttctccatgtattccattgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcgggaattccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccactgaaaacatgttgcaaggcgaaacgcagcatcgcatcagatttacgtactggcatcggtgcgatgctcaacgtttccaggttagccccgaatgatggatcgatgcggagatcacgcagaggattttcctgtacagagcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggcgttacttccttgaaccatttccatagtgatgcagggagttcatattcgtagccaccgtccatgataaatgcgcggtcttcaaactcaccgatcgaggtgcgatcaatcgtcacgtaacctttttcacggatgatgtttgcgatacctgttttccaggttttctctgcaaagatttcaggggatacggttaaaccgtaagtttttccagcgaataattccatgattacctcaaataaaaaaggggatgccgtaagcacccccgaattatattacttacttgccagcaatgcaagttttgcggcggcttcacgaactgcgcgagctttctgcgcaacaacttcgatcgctttctggtgttctgccagtgcgtcttctactgccagtgcagcttcgatgatctctttattgcgttgctgtgcagcaacatcaacggcctgaactgctggagcgtttgccggagctttaccagtaccgagttcacggaagaacttacgctcacgatgcatgatatacgggagagtacgatcttgtgtgatagatgcatcaccgtcgccgtcaacagactcaagcaccataataccgttgttatttttgatgtgttgcacaatgcgtttgttcgcggtatgagagcgcaggaaaccagcttcatctaccagaacatacggacgaccagcaacgaaatgtgtaggcatagcttcaaccgttgctggttgtggtgcagcaggttttgcaactggttcagttaccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgtgatgtttacaacaccgttcagcaattggtggatctgttttgattgaacactgttcgcaatgtttttgccgttgtcagtgaaaccttcgacatcaaccagcttgtaatctttaccagtttcgaagcgggtttctttggttctcaccgtccacggatgtgaaccgcttcctttggtgatgtttttcagtgggatcgaccacttccagcaatagtcacgggcttctttacgggttttgaaattcagaatcatgatattatctctcaattgggttaaatttatgctacgtggatatcttaacagaactaccaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagcttagagcgttctgtatcgccctgtaaggcttcgagggtgtaacccgtccaaacccacacatctttatcagggaacgtcgcacggacgcgctggagcagttttaagagcgtcggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtcacgaacaacactacacggattcctttaccgttaaccacatccatgttatagatgcggtcaaagttcatcagcctttcgcctctgggaacagacgggctttgatcgcttcgtcgataatttgcgggaattcattattcacgcgcttaacgatttcctgacgaaccgttacttcgaggtttttggttacgcgagcaataaacgcttcttcgtccgctttgaggtttccggttgcatcgttgattgcttccagcttgattgaatccagcaggtcggcgcactgttttttaacgtttgtcgtgatcagttctttgatctggcggataccgcctgaattgatatcgaaaacattgctgtatgcgtaacgtttctgaatgtaatcagcaaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccattcgcgcttgtgttccttctgggaacaggttgttcagcgcctgtgtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttacaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatattgttatgcgcagactctacaacctgggatactgaatccagcggattgctaccagacacccagcggagcagatgacgatcatcaccgttaatcggatcaacgaattcaaatttgataccgttttcaatcagttcgtgcagaagaaagtttatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcgaatgttacccggagaactataccgcgaaacgttgattgaaggaatacgaatatcttcaacgatatcacatgacgcaacagcttcaacgaaatcaagaattctggtcgctttgatgacgtgcgccttaaacgaaccgacttctaactcatattcatctttccagcctgaatagtagtcaaccgcagggctaatcgctttcatgagcgcttcgggaatgtcaatgtgccatagctgttctgcgtactgtttgcgccagtctggataagttttacgtgctggtttgaatgcactgttgccgtcttcgaacatcatttcacttttcctctctttttcgtaaatgtcgtacacacttcttcgttcgtaagcgtcttttaggttgctgtttactatactatcatgcgtcagttcttcgcaatactttttatcccattcagaacacgcatgttcaaccatttcctgaaaaacgcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacggaagcggcatttttgccacccagcaacacatcaatcttcgtcacgatggtatcgacgcttacggaagtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgtaagccctgccagatgttacggtgttgcagcgccagcacgtaatgactgttggacacttcctgccccgccgccagcagttttttgatctctgattctttaccagtgtgaaggtttttgtgttcggtaactttctttttcagcttcgcgatttcctgaacagcagaaacgcgagtatgttgcagacggtcgatctctttgatcaggatacgtgcagcactgcgccatgcttcttctggggaagtgttttgttcgattgcagtttcaactttaccagtcacgaacgatacgagtttcttgaacataattttgccttatttgatttcgaattgattggtgaaccattcaggggctttaacaactttcccctctctgatataaccgattttacatagttcgttggttaagtcaagtctttttccacccgccatgtaaaattttaatctgcttactgggatcaccggacggataacgtcacgatagccgaaatgcgcactacgcaccactatagagagcatacgcaagcggttgatacaaccagtatacgaacgcccagtagcgcgggagaagtcctccagcgtaacgccaggggcaattgcacctatcagatcaagataatccttttcaacccagaaccgcccaacagaacatttcgatacaccctcagccattaccgcgtttgggtgtttctcgtcttcgcgcttctttttgtcctcaaggaacttattgaaccggatttcttcgagtcggttttcccgttctacccgtgcgcgtacacggaagggaaacaaagtatcaaggattttcccgatcatatcgttggctttccgtttggtcgtttaagatcgaaaggaacattcacaggccggacggtttctaattggagatattgttccatccccacacgtttaccgcctactttgttataacggatgttctttccgtcatagcctacagcctgtgaaatgtagtagttcttagtttcgcgtaaacactccatccattcttgtgttccggttttgttgcgaacccgcgcctttaatggaaacatcattcaccccgtagaactttcagttcaccagacaaacgatgtagattggcggttgcagtatcataacgtttttcggtgtctttcagggtagtttcccgcgccttacgcaagaatttttccagatcacctggtttcgtcaccagcttaccatctacgtaaattcgtcccagcaggtgagaacaatccagcagttgttgtgcgtcggctttttcaacagcaggtttaatcgcgacaaactttttaaagaatccgcgatcctcgttatcaaacagatacgaatcttcggaataccatgttgtgccattggcatcaacgatcccactaacacctttccggttgcagtgcgttaccttgataggaaacacgacagatgatagttgattaggcgacagaggactaccacgcaaagctaaattgcggtatacagtcccaaaactttcttcatcgcgaaattcaaaatagtcttttgtccagtacatcatttttcaatacctcatagtttcggtatgtgcaatataacaaaagcccctcactttcgcaaggggctttttgattaattttgatgcttagttcggtgcatcatttctttgttcttaccttcgttgaatccacggacagcaggagcacccaaataaccgcatgtacggcgcgtgacgctcattttagccggatcgtgattaccgcagtgcttacagtggaaaccttcttctgtaggcgtgaactcgtcatcagagccacatacaaagcacttatcgaccggaaggttagttccgaagtagtccagtttttccatcgcataatcccagactttttccagggcttgcaggttgtttttcatatcagggaattcaacgtaactgatatgacccgcagtagcgatataatgataatcggcttcatagtcaattttctcgaacggtgttaccttgcggtcaacgtccaggtggaaactgtttgtgtaccagcctttatccgtgacacctttgacgcttccgaacttctcaaagtccagcttacagaagcgatggcagagagattccgctggggttgaatacaggctgaaaccatatcctgttttcttcttccatgcttcggttgccgcgcgaaggtactcaatgatcaatctgccgatattctgggagccgatacgatcgaatgggtgttggcctgagccaaacatcaacagcgtttcatgcagtccgatataacccagactgatagagctacgcccatttttgaacagttccagaatttcatcatccggtttcagtcgaacaccaaaagcaccttctgtgtacaggatcggcgcaacactggctttaacaccgcgtaggctttcgatacgagtcatcagggcttcaaaacacagttccagacgttcatcaaggatgcgccagaatgcgtcgtgtgcgtcttcgttttcctgtgcttccgcttcaatagcgatgcgtgggaggttgattgtcaccacacccaggttattacgtccatccagaacttcattaccgttatcatcatgccacacgctaaggaaactgcgacaacccataggagatacaggaacgctagaaccagtaatagcgcggttattagccgaactaatgatatctgggtacatgcgtttagaagcacattccagagccagttgtttgatgtcatagttgcgatcctctggatcaaggttgattcctttttccatgaacataaccagtttagggaataccggagtgataccctctttacccaggccgcgaatacggtttttcagaatcgctttctggatcattcgttcaaacatacccgtaccagtaccgaaagtgatggtaacgaatggggtttgaccattggcagtatgtagggtgttaacttcatattcgtaagactggaacgcatcaaaaacatctttttcagtcttttccatcgcgtatgtacgatcgccagaaataccgtatttccttgcggttttttcgtgtttttcatacgtcatacgagcgtatggagccagcactttatcaacattcgcaaaggttgtcccgccgtactggtgagaagcaatctgtgcggtgatctgcgccatgagagcggtagcaacaccgatcgatttaggcggttcaatgtccgcgttacccatcttgaaaccgttctccagcatacctttcaggtcaaccagacagcagttagtgtaaggggtgaacgggctatagtccagatcgtgataatggatgtcgccggagtcatgcgcttctacgatatgtttcggaaggatatgattacgggcgaaatgcttcgctacaatacccgccagcaaatcgcgctgtgtcgggaatacccttgcgtctttgttcgcgttctcgttggtgatctctttgttggacagattcaccataccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtcccgccagctttttctacagcaatacggattttttctttgtcaaaatcaacggctttgccgtctcgtttttctactttcatttcgttgccttcattaattgctttctatattttgcggttaaggctttgcgttcgtctttgtctgcgtattcaaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcaacatcacgggacaccagaccggatctgttgaatttgtgcttcacaataccttctgtaccgttgcataggttacacagtaggccgcgcacacgtccggcgttttcgccgtctaaagcatggtcatggtcaaggtgatgtttctcgatctctccctcaagaggacgtttgcagagagcacaacgcccaccttgtttttcaaagagggcttgcttgatagtcgggtagtcttttttggtaattcgtttcgtcagcataataacaccattcagtaaggtgtcattatttattacagggtgcggacgtactcgcgaagttggtcgaatccgcctacgtgtttcccgtcatggaaaatctgaggcatagtcatccggcgcgtaccaaccagggcttcgagttcgtcgatcaccgcttcattcagcacaggtttaccgtcttccacggaatccgcaacagacacgaactcatacggatgttttttcgcgtccagcaagcgctttgagttcaggcatggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgtagttcatccaggaaagcatataactcgcgttcgcgatcttcgttccagaacttgttatacactgcatcggtgatcaggtacggcggatcacagtacacgaaatcattttcacagatatcaatgtcacggaatgaaccactggaaaactcaatacctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccagacccttcgatgcaatcaattctcgcaccggagacaggtcaggaagcgttttaagacgctcatacatatcaatcagcgtcttatcgtaatcgttgcttagaacgggtttagggacgtttaacgacacactaaggccaccgcaaaaacaatcaatgaaacgcatgtatgaacttctttcggggaacagcttgaagagttcaggtaatagcgactgtttgttgcctgtataggggataacacccaaataactcatagaaaagattccagattgttaacgtatggctgaacacgaagaatagaatcgtgataataattctccatcagttcgaagcctttgaaccgtctgttggttagtatcgacattttcatcactgtaccagagccagagaatatatcaagaaccaagtccccttcaaccgtccacgttttaatgtgatcttctgccagttgttcaggaaatattgctgggtgtttgaatgcaatctcgtccttcgttgagtgatttcgccctacagcgtaataccagatattacccttaattttatccttgccaacaggtttacgtttcttaccggaacgggctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgagcgcgtacaaggcttgacggaaagatgtacccgtttcactaccgttgatagtcgcgtcacccacaacccacacaaccacaccaccgggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaataattttcgcctaatttctcaagcattgcaatagcacggtgttcatcttttttatctttcaacagataagcaattcgaacaacctcttttagtgtcgcgttgtccacctgttccaacttgaacccgtagcccaccaacttacaaaaaagccccttgcgagcgacaaggggctgattgttgtagaagactaccgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgaggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccaccagcagcaatgatttgctctttatattcagcgatgcgatctacagcgcctttgtagtcccaggaatcgtacacacaagcgtagaaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcatgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatgtccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcatcgtcatcgtcgtagccaccccagctatcaatatattctgcttcactcatgctcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttgggttagtgtcttgtctacgggagctatattaccacactcataactcccgtcaacaagtttttcgaattattttcaccaggtgatgtaataagtcagatcgctatatccgtcacgcttaggatcgctaaaattggtctggatacgacgcgaacccgcgaaggtattgagtaacgcagcttgtcggttgcgctgtgtatcgaaagtaaacccttcttccgccaaccattcacccagatccgcatatgctttttcggtacattcctgatccatagtcttaccgataaaacgtttcatatcaaaggtatatgattgtttagtcggatatttcaggacatactcggaaatgtctttgcgggatgcttcgaccattttcgcgttgatttcgtcaaccagtttacgcgcacgttctgccagtgtcgggctacgtccgcagcggggatcatcttgcgtttcgcgtttgacccacgatgtcccgcttcccgcctgtgcgttcacaccgattccattgatttctaccattatgtttcgccttttttaatgcctcttcaactgcgaggcgttcgtaattacgtgattgttcgggagttatcaccagagaaaatccagagtaggaggtttagtgttaatccctaaagtatcgcagacttcatccagaacgttttgattccaaaggttgaacgttggaactttatacaatctggcaagccttgcagcgatcgcagtaccacctttaacacaaaaatctttctctaccgcccagaatagaacaaaatctgtaggtttgtccaggttttcggttaatacctgcattgaattgcgagcgtatcggcgttgtgtccattcgctttggttgtcgaagtgtccagctacctttctcgcttcgtcagcggctttgtacgtgtcgtattctgtatagtcgatgatatccttaccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttggattttcgaactgttccaggaaaggcccgtagttacgttcgatttcttccagcgcgtcctgtaccgtcagccccatcacgcgaccgaaatctttcgcggtgagattcgcgctgtcaatttttgacagaacatttttcacacggttttcagtcaggtagcaggtgaattcgttcagcttcactttgtctgtttctgacagttcagaaggagcattgaagcggttcgcttgcttgttcttcttctctgtgaacttcgtcgttttgcatttgattgcaacgcgttcaccgttcggcatgaaagcgggttgaacaggcttcatcacgaaaccttctgcgatgttctcaccttcaccatctttcagcgtcatgaagtttttgaactcaggttcaacgccgttctttgcagggatcgcaccggagttcgccaggttaaccaccgaatcaaaggtgataggcagtgtgcggatctcgtcaaacgtaccgtatgccagcagtggagccattttcaagccaacagcaacagcgtaattcgcaacaacgttatcagggaggaactgaccattgacgcggatatcaaatacgtagaaatctttttctccgtagtcaacatctttctgtacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgcaacccatacgccaccagtcaaaccattcatgatcacaccattgatgaatttaccttcataatggttagtcagagaagaatatttcacaaacataattaacccttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttggtcttaggcttacgctgttcttcacgatgtttgttgatatacacacgacgcagaacatgtttcacttttggattttctgcgcggaaagcacgaattcgctcgatttcctgaacaatcacgtaaatgtcgccgttatcgagcatgtgctcacgggcgatctgtgcatagcccagtttcagatcattgaatttaaaatgaatctgtactttttcctgctggctaacttcgctgatattacgctgaacgattttcatagttactttcctttagtagaatcaattttacgaataaactctaacacttcggcatttctgctgtcaacattttttagaacaaaagttacaactacatgaacaccggatgcttcgttccaaccatcagcacacgggatcatcagatcatccagagtgttgacaaggttttccatatccgcagggtgatcgacaaacaaagtttgtgtttcggtgatactggctttgaagcgtttcccgatctgtgcttcgagttcgtccagcataccagcagataacgcggcgatgtcgatatttttcatcccaccatacacaacatgaaatagtttcatatgcaactaacctcattttcatatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttccctgtgaaaataaatccacgattggaacgacgcatcaggcggatttgatttgcaaccagcaggataaaattcaagcattttgatcagcctcattcgcaatacagatcgccataaaggtaaacataacccccaacgcaaccatccagatcgcggttaaatccccatacaaagaagaataaccacccatcacttcaacgcgatatcccagcaagaaaacgagatacgccaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgcccgacaagtcaacaaattctttttcaacgtcttcttttgttctgaacaggtaatcagtaaggcgacccgtcatcaattcgcgagttttagcaactgaacgaacacggcgttcacgttggctttcggcatcaccaattccgtgacctggttcccacccttccatatccaacataatgcgcgggtgcatcatcacacgaatatcgtttccatatgaatagctgttatattgcccgaatacaaatcttttgaatttttcatgatgaacatcatcaacttcgacctgttcaccatagtacacaatttcatcacagaacgcagcgagaatcaaaccaccagagttttgaatttttaggatcgcgtagaccatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgagcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcctatccgtcgaacaattgcactataaacacactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggcgcgggttctggtaaagggttcaccctcgaaaagctgttaggcatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgaccagcttgataaagagttagtggctaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggagacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcatgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttgcgggattcgatgaaatcaacatcggtgtaatcaatatacgcctgtttcagtgtgtcgaattctttcgcgtatttttcttcggcataatcacgccagtcttcgcttgcagcattcgcagccacgatgatatcaaagatccaccacggcaaataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggtagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacgggtagaagatttcccgtagagtatgggttgtgttgccgatcctccatgtagaggaaatgacaatatcacagttcgcatgatttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggcgtagccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcatttgaattgactactttcttcactttaccatcagcccaaacaaacagaactgggtagtaagcatttttcatcatttcgtttttcattttgctttccttcttcactgcgagagccattcccccgccttcgagtacaaatatactttaaacgagggtatgcgtcaacaagttttttagcaaaaagtgctaaaacttaaatgtttcgaatcggctatttctggtttcgcgaacacgaacttcgccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcgacgatttccggttctggtgaatcgatcagcagttccggcttttcttcatcttccggtaaagcagcaaccagatccgccagcatgttatcgaaggatttttgtttgttcagcttaaccgcaaacacagtcatagcgtaatcggctaaagcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaactgaggatatcacgcaagaagattttgataagtgggttagcgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaggacatcgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggcttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagatattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaatttcggaaaccgtttgttccgacacgtacatttattttatttcagtgctgtactattctgaattacaattaactggcctttactcgaaggtatcttaccaatcaccccaccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaatttaatacctacgatctgactcagcttagatttacctgcaagagcagaccaatcatcacctttgatcaggcgatcagaatcactttcagcagtatacgggttcacggaaagaccgtaacgcatcagaatagcaacttttggttgcagggatgccggatctacggatactttgattgaacctgcttcgtcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattgatacaggatacgacccaatgctggggcatccttcgcggtgtatgcggttgtgccgtcaaaaataccatccgtaacgagtccatccacgttgtaacgtttggaaacggtgatcagagtttgaataatgtctttgttgacttcttcacttgccacggttcccagaatgtcttcgatcaccccatcagcttcaaactggtttgcttccaaatcctgcatcagttcaaccgtcatttcggttttaaacttacgcgaacgtaccggaatattccagcgatccatctggaaggaggttgacgcgatatcttcactggtttcatacttagaagtatcagcggcttcgctaaccagacgaatcttgctttggaacacagctttcatgatcgcggtgtctttgtcagtatccagagtgttcagggtaataggtgcaatcacctcataaacaacgtcagtaccgtcatgcttgaacaaatcacctttaacgtaggctttagtcagatcgatttcgtcgatgtctgtacgtccagagattcggcctgaataggttgcagcactggagaaagtcatatcaccgttagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtacctgttgcttcgttgataactttttctcgtttaccagacggaagcgaagactgacgcatcaacttgtgaattgtgtagtgtttatcactcatttctttggttcctgaattagagggctttttacctgtatctatttacaccaacaaaaaaggcaacccgtaggttgccttttagtgtaaagtcgattacagacctttaacccagaccttacggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagccaacggtctgagtgaaaccagtcttaccaatctgcgcggtgtagttgatcaggtcaacgatttcgcggttgatttccagcatgatttcagttgccaggattgcagacagttcggcgtcagcgtccataccgtgtacagcacgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgataccagtttcctggaatacgtgcttaacgatagcgccggaagcgatagcagtaccggaagcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgtgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgtgcttctgggataactacgttgtgttcaacgaacagttctttcattcccattaccagagattcgaacagatcggccttgatatcacgggatacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcgcttggcccccaaacaacatcaacgcctactgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcggatgattcatttcacccagagcttgacgggtattaacctgagttctgatataatcgtttactgcttcttctaatacttttttcggatacagtcgcttattgcggttaactttttcggcctggaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgttgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttccctactacaccttcaacctgtgacattaacgttaggcgacgttccataatctcaatatctttcacttccgcataatatgaatcttgctggaaaatgaaggaaattttgctaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcgccaccaccaccaatttgcatacccccatcatcgcgaggcatacggcttaatggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgcccgttgtatgtatagccatttttaggagcgctatacacgaaaaattcgcgataaccacggaatactttcacgccaccatcgagggtttcagtgatagattcgcggatcagttccatcgaacgcggatcaagttgacgcagttcgcggatacctttgctttcgtctttatgcatgattttatggaagtatatacgggaatccacataccaatcacggaacagacgcgcacccatgttatcaaaatcatagatatttagaacgttatcaaattcttctacgattttgtcctggattgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttatagcctttattcccaccagtccagcgcgaaagtaacctcaaaggttgacacttcgttgttgctgtcccagtccagggtaacttcgcctacgttagtagggaaaagaccgtgaatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgacgttatacggcttgcggccctaccagttcatcgaaatctgcgcccgtagacgttgctacgaagttcagagtgatgtagttgatagaacgaggcggtttcacgtagatcgttgctacaaactcgttacggtcgattacgtccggtgtgttgttcgtggtgtcgcagattacacggtaatcgtagcagccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccaggaagccatagcttgaacttacgttcaggttattgtcaaccggagtaccaccactgagtttatatccagtacgccattcaatgatgttatcaaccgctgttgccagtggaatattcaccatcagagagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaatgccaccacgacgcacaacaaaagcgtactggttgtcggtctgtggcccgtaggtcattacagaacgaccgctattcttaacggaaaccccagaagggtagcctgaaatcatagcgccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcagaaacaccggaagactgagaaacaatttcggtagtccagccagtagaaatatctgggtaagtgccaatctgtttagcacgggcaacgattttttcgcttgggatgattaccgcgaggatcttgccgttactgtcaacttcggacactttaccgttttcttctacaacaacgctgttgtattttactttaattacatcgtttacagtgtagttagaaccctgtgatgcgatagttgttttgatctggttgaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccaaccagcgatcagggttccactggttcccatgaattccgcgcagtgttcctgcaagaatgcctctttgctggagccagcgatcatcttcgcagaccacgaataaccgtcatcaaatgtaccgttgtcgccgtctgtatacaatcgctctttaaccgatgtccagatcgccgtgtaaggcacgaagccggattttccttctatagcagcgttccagatatcatagaagtggttaagcccgttaggtgtcgttgtgataaggattttcgatttacgaccagaagaaattactggctgaatcgctaaccacgcatcaacaaagttcgggataaacgcgcattcgtcgatgtagatcatcgcgaaggagttaccacgcaccgcatcgggagaagatgcaaacgcaccaattttacatttgttgtcaagttcaatagaacctttgttccattcaacaataccaggctgcaagaagtcgggcagtagttcgatcgcctgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcctttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttctcgtaaacaaccacatcctccccagactcaacgccgccagggagggaatcaatattcagcaattgctgtaaatctaatttttcatccattttcattccctcggcttaggaggttcatcaccagacgggatcggcttatcgtgcgagtacgtctgaatatattcttcgcccgtgtagtcctgcataggcaaatctaccggatcggcttgactatccacggattcaaagttatctttatctaacgggttcatgttagcgaagaaatccgtgtaaacggttctgatttcgcctttaacatcagttacaggcgggtacagataaccctgtaattcaaacataaatgaccactcaacatgacggcgttgatttgcatcgccctcgaatgtggtatccggcgcaaccgattggagactgattttgatgtctcggtcaactgtgatatcgttcttatgcagttcggtaatcttacagttgaaatgcggttgaaaatatggcaaaatctgttctgcgatttggaacatatcatcttcatatcgcgtgtaaacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaaccttgatgtatttttcttgatcgccgcgtactcttttaacctgaacatggttaaacaattgtcccataagaacaatatagttacgcagtgagctattataccagtagccaaacaattttatactccttctataatattcaacagtttatcgtaattggatatatctgttgtttctgtatatccatccatcatatctgatttatcgactacgccacaaacaagagattgtttgatcttctgttcaatactcattgcatcaatacctttatcgaataatttttgataaaccagttcgtgtttataaacggatttatttgattgcgcacacattcttttttttggtgttctgttggttatcccaaatttcagaaattttccagatagtgattgtacgtatacgtatgctggtttgttcggattgaacccagacgttgcgcattttttacagcgatgaccttgattgagaaaagcaactatacttacatcccaattatggcctttatcgcaaaccattgatatttttgtgtgcgcatctttatacaccccaacgaaatctacgaatgtatatccaattgaatctgcaagagttttgatttcctcgattctgttttcctttgatattttcatcttaggggaacacaaataacatccgtttggacgacttttgttgacaaatggtttgatctgtttttctgttctatgtcctttactgcaaacaacataaaactttgaatattttgtgatcgctgattggtctacccatccatcaaaagatagttctaattccgcacaacgttcttttaattgatgttctctttgttctatagagatttttgcaaccatatcataaaatcctcttcgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcgatgttgatatcagccagcccgtcaagatttcggataggttcgagatccagttctgcatcaggttcgatatggattccttcatttcgctgcaattcaggagccagttcttcaccagtgtagatgaatttcgccaggttgattttacgctgaggacgatcaccgaactgatagaacggatcggcttctacccacgtaatttcaaacaggctattgtccataggaaaataaaccagatcccccagaacaggaataccaccatcagtttgatgtgcgaacaaacgagggttaattaccagcgtcatttcatcgtttgaactcagaccaaatttactaaagaaatctcgttgtccttcatagttggcatacgattcaatatatgcagcaattttccatgacttcgtaaatttggattctcggtcttcgcccaggatcttatcaatattcacgaagtcacgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcagacatagaaatcagttcatcgcgcagactttgcagtttggtttccgcttcctggatcagtcgcgtaccatcaggagcaacaccgccaggcaattgcatcccctggaatttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcgcctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaacaccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattattcgtaatcatatgatcctcaaaaggggcttgcgccccttgttaaaattatgctaccgtcacagtacattcagcggaggtgatggtcgccggagaagtcgcggaatccgtaacttcaactttgtacacacccgcttctgctactgtagccaggcttgcgccagtttccccagtaacttcaaccgtatctttaaaccatttgtatgtatatggtgttttgccaccagtaacaacaacggctaaatccatattatcgcctgttgtataactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagacttgacgatagaagaaccagtttcaccactcaatacagatccgtctttatgccatacgtaagtgtacggagttttaccaccgctaaacactacttccagagtcaatggatcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttctggatcattacactcggtgaatcagtcccgatatttgcggttcctttcttccactggtacacataaggcagtttaccacctgtaacggtaacagataaagaaatatcatcaccctcgatataatcgttacgaccgaccagattttgagtaaatgacagtggaactttcttcgcttcgtatttgttatccgcttcaacttctgtgatatacggaaccagagcatcagcaacatcctggcgagaggctttattctgttccagatcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcatcaccataaacagctttacccatcgcgatattagccgcaacgagtccagttgacgtattacccacaattgcggtaacatcaaccagtgcctggtgatcgtcgcgctgtgtgttttccacattcagcagacggcctttgatgcttgttggctgggagtcagtaccgatatcggtcataacctgcgccatttcaccgcgcagaccatcatcacttgtttcaccaacgatcatattcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcatcggttaaattacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgcttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcatttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatccacaccacgcccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacccgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatggcgggtgttaaacacatagttcaacgagcgcggagtaagagaaaccagatcgtttgttactgttactgattctgcatcagttgcgtaacgagtgtaaccccatacggtttgtgatgcatgagggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccgtattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgttgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcacgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgtccagataccaaagcccatataatcgcctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcggtatattcgatctgattaaccagcgtcacttcttcttcgttgttcaggtaaatcttatcggtgtgttctttaataccgcctacaccgtcccattccattacagtaccgatatcattgttgaaccagcgaatagttaccacatcacgggattccagaggttgagcaaatttaatgccagtaaccacggagtcaacaaaaatcagactgtaatcctgtccagaaggaacccacgcgccggagttcgcaatacagctatcttcatcataaccttctgcgccctcacaaacaaatgtcgggagatccgcatcgcctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtctcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggcgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgcaacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccatgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgatcctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcgtacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagttgatcctgaacccctttgataccatcaccaacttgcggacggaatacaacaggacgatcaacagaaatactaccgttactatttatgaaatagaacccttcgccgggtttacccgatggaagaacaacagtaattggccctgttgaagtatccatatcatgcaatgaacccagttcgatcgggttgcctgaataataagttcgcggtaatttctggaaatatccggtcgcgtggagtaacattgtacccacaccatcattcgcagtcagtaaacgcacatcaccaaacgcgttgtatacgttggtgatgatttcgttaagtttaacaccgccgtcatacagcgggtcaccagttgacgggttgccgatttgccccacgtcaattaattttttaccagtttgatatgccattatggtttccttagaattcgaaaataatactgacttcttcggtctgatcaggagaacgaataatcggttgacggttttccatgtagatcatttgtcctgagtcaagttcaagctgtcctttcgtgtaatactgccccgttgcttttacttctgggtcggatggttgcgcctttttcaacagcggatttacaataacgctgatttgacggaacccacggttgccaggtaaagaggcttgcgggaagaacagggaatccatatacgcgcggaatcgcattgagtgaaccttcattcggtacaccaaatcgtacatatcaggataccatttgatcacgttatcataaccccaacgaaccggatcttcttcaagttcatcagggaacggaacaacgatatgttcatttgtacagcggttgataacaacatctggtggaattgtatacagatattcccagatatagccgtcgcccatgtcgataccgttcgcttccccgcgcggaggttcgatcgattcgtgggtcggtgtccaaatgccaccaatgcgcacacattcaactttacccgtgatactggagattgaacaagatccaatatcaggaacgtctacaacgcggtataccatccatcctttaccgtagtcagtacggttataaggcgcggagtttacaaccacgatgtcattaatgtaaaagatttttgggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttatgatcgggggtgtccccgatcatttcgcgaaagttcatcatgttttccgtgcggaacttaccagttacgaccgcacggtagatgttttgttgagccattatgctacctttctctgagtcggtggattcggatcgcgaggattacccgcgtcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggtcgtacaatgcttcaccagttacaaggtcaaatgtctggtttccgttaccgtccagacgtgctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgcacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacctgtgaagttagtcttttcagacttgacaacctgcccttcaaggaagttaccgatcacgttgtgcagcgttaccgaccaacgtaattgaccgtcatcatactggcgttcgatatacgtcacgtttgctctcgctgttggtgtgtaaatcgtccggcctacaatgtcctggttgatatttgttgaatgaaccagaatatcatattccagagtgttcgaactttcgatttctacacttacatcttcgttatacaacagtttgaacaggaatttatagcttgcttcgatgcctttcgttgagtagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgatccagatagctttgaggcgcaaagcgcgtaatcatatggcttaaatctgggtcaatcaaaccaggtgacagatccggttgatacggtttttcgcgttcctgctgaatcagatcggcaatcaataacgtattgtctggtttccagaaaatcgttaagttgtcgcgagcgcggtaactcagttcaaagaacccgatgatttctcctgaactcttatacagcaacacaccgttcgtatacttcgtgaatccggtaaacttaatgttgttaatgtaaatcgtaacatgtccgcgatcccatacctctttgttcacacgaagtgatgacgaagggccagcactatcggttacaaggctgtaggtgattttcggatacaccaccagaggacggttatcattagtgatccatgtgcgcacagagtcgcggaagaaccagctataattcgcctcgttgtaatattcctgcgcaccaaatttccaaacagtcgggtcgtcgatatgagcgcgaatcgtcgcaaagttaatcgcaaggctggcagtatagccaggacgcaaatcatattttacagcaccgaccagtgcagggttctcgatcaacaattcaggatcgggaagtgtgcctggatatttgtagttcgctacggaaataaaaatctccgtgccgttcgttgacatattggtgtattcatgctggatataaaaacgttcttcctcggtgttcccgtacaggcgcacaaaggttttcgtgtcttcttgccattgatacacaccagcagcagcggacggaaccacgttagcgggttttgtaggatcttgcagagcggttttcacttcacccgtaacgagtgcataaagaatcccgttcatcacatccattttcttgacaacgatcttatcatttccagggacaactgtatagcttgctgtatcgaaaatcttttctccgaacgttggagaactcggatcggtgtcgatcggtgtctgtttcagcgcgatacgacgcacaacgtttttcgcaaccacataaagccagtcatcggaacatgccattgcttctgcatatttcgacacgttaccaggcagtttagcaaacgtgttgtatgagtctacgtcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaatagagcgcgatacagggtttcctacgcggtcgttaaatgctttgtagtaatgccatgtctgccctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattgaagttaacgtagttctgattgttctttgcgaatttttcgtttatgaatgcatcacttggcgtaaattcacgcattgttgaatatgcgtaggcgttaaggctgaacgtccataattcatctgtataaacccaatcagacggttcaaagcccttgtgcgtaaccatgacgcggaatttataaaaattgtttggttggacatcggaagaaaaccattcattcaaaaaagcgtaacccaactggaaccaggttaaatcttcatctggaatagtaacaccacctgccccgcgagtttctgccatttccacgacatagtaaaaatccatgccgacgctatcccacttcaaataaacgaagttagcagccagtttatcaacgcgcaaactggtaattgacggcgctttaatcattatgtttctccaaatttgcgttacttatatcccatatttagcaaacaaaaaacccctgccggatgacaggggttaaaattattgactgattggattcattgtcaatgttgtatattgaggacggagatcgttttcaaacacaatcagagaaccatcacgggtgaaaatgttctcttccaatggtgtaccagtcagttcgatataagcagcgctgaatcgctcggatggaacgttcaggacacccagatcgaaactaatgaaatcagtgtagtgttccacatagccgacttcgtaatatttattacgatcggtcactccaggatatttatcaaaatcggttcctgtataggctgcgatactgatatcaccgtttttgaatggcccgataacaatttttgcacgtccggttgtggtgttcatatcggttgatgcataacgcacatcatacgaatcaccagcagcgtttgtgtatttgaacccgttcgaaacaacagaacgtgatttcacctggtttaagaagtgaataccagacatcggagcgctgtaatagttatcaagttcacgcaatagctgaatagtcgcagaagaaccaatgatcgacacgtccgcgttatcaacataggttaacattttggacttactgaatgatttgttgaaaatttcaacgttatcagtataatatctgtcaacctcattgattacttgaccacgcaaccattcctctgattcaaccaacttactgatatcatacgttactttgatactttgtacgatgtacagatagttcgggtcaaggatcgacggcgtaatcgtcgcaaggttatacttcgccagatagttttgcatatcctctttttgaacagaggtcaaacgcaaccctgatttcggtttaaccgcgatgaacgcatagccaggtttttctttatcagtaaagcactgaaccgcctgaataacagaaccgaaacggtgagacaagaacgattcataatccgatgcagtaacacaacggcgttgtgtctcacgcatgataggcgcgagttcgcgaatacgttcgatatcttccggttcaccaccaccatcagcgcctacatagtccgctgaattagtcgggttctcaacaatactcgtaatgctaatgtttgtcaacgtatccacgtaaacaaagttttcagcaccgtttgcttcttcgccgttggttgaaatatattcaataacaacggttgaaccgtttgcaggtttcaagcccccgatgtaatcagcagtcagagcaccacccgcgacctgttggctggtttcaccttcaccaaagtaaacttcggtatgtccatcaacagtttcacgcatataaaaaacagttgatgcacccgttgcgtttacgatactttcgtttgtccagtcatcccattgtgcgccgttgacggtaacgcgaacctggctacggtcgatgtttggatcgcggatcaggatagtcgaaccatcaaagatgacttcggtacgtactaaacgcccctgaacgatgttcaacatcgaaacatagttattgtttttgtcacgaacgatcaccacgtcatcggatacgacgaacgggaaactgtttgtttctttcactgtaccgatgaatttcgtaccgcgtggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagtttattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacagtaatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccatcttgcagagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgctttcagggtgttgaatagttcttgcccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtcgcatgatgttacggatagccagcacagcagaccaaagcgggtttggtgtttcgggaggcattgaccagatctgcatcatacgcccgtacaaatccaccagagcaacgcaaccgttttggaacatagtcaaacaccagtcaaataacgcgctacaagcgtctacaaggtcgcgagcgccagccttgacatattcaacggtgtagttgtaagaactgcctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattgatcagactccatgccccacccacgatgttaaacgcagagctaatgatctgccggaacaccttcattgcggtttgccatgcttgctgtgacaatgccagagcacccgctgtgatttcttccatcccgatcgaaagcccgtcaaacatcgtcgcgataccagagccgtttttaatcgtacccgtcagcatatcgaaagccagcttgaacgttttacgagtctcgttccacgcggaaagcatagcatcgctgatattcgtatacgggaaccctacggtcgccggaatacagcccaatccagagcgagcagaaaacaatctggcttcactcggtagcgccccatacgttgacgggagagcagggggaaccggaggaatgctggtatctgcgttcgtgtttactgacatccctgtatatttgcactggtgcgcgggggattcgtcgtgtttcatgtacgcaatacgattaccattccagtagtaatcaatgctggtaaacgcgcctgtagtctggttgtatacctgtcggattcgcggatcgcaacggggaccggaagtcagcaagtaaccaccggagttttccaccttgtacatcgcgagttcgccagggttcttgaacagattcgcttttgatagatccgccccgtaccagtcattacccgcgagcttagtagccccgatagatgcgatataggcatcaatatccgcttgactggcgaaataataaccaatcttcgtaaccagaatgtcagtagaaacccctggggttccgtctggattcgtgggtacgtttggagagttcaccaccggaagcggatcgcttttctgtccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaaattttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacagttgcattctgtttaacgttagccattaaattctgattaacgtttacggttgcatctttttcaacggttaattctgcgttgcctttaatcagccccaaatattcaccttcaacggtttgatttacattaccgcgaacgaactcggtcacgttaccatcaacggtctgttgaacgttacccatattgtaaatgaacgcatcaccctcgataacaacctgtaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggattcgaataccatgttgtatggatattcagcagcgtatgcggatttaggttcctcgaacattacgcgagtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatactcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccacgagccagtacgttgacatcgttacctacataacgaggatactcgccaaacgggtcacagaagcctttctgggtgtccggcttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattgttcgggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaacgaaaataacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctatttcatggatttctatgttgaaatggataacggtgtgacctacctttgggaagtcaagccgatgaaagaaacgttgcccccaccgaagccagcgaacaacaacgttcacaacaaaaagaaatttgttgatgcgctgtatacttatgcggtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagttttatttttgagttcgagatcatcgcagaagaagacaagccaaaaccaccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctataagcagcagattgatgatgaaatcgaacgccgtaaagcagaaaccgaagcccgacgcaaacgtaatgactatcgtaaaaaacacgcggttgatatcgtaaacgatttccgcaacagtttgaagaaaatgactgttggtgtaaccgctgcgaaacgtcagaaagattcgaccgattggtttggtgatttcatcaaaaccagcattaagacgcacagggttgcgaaaccagcaacgggtcgcttgtatacgttcatctacgatgcgaaatacaaagacacccttccatactgggatcggttcccgctgatcattttcctgggttcaggacgttcgaaagcgggtaacttggttctgtacgggctgaacttgcactatgcgccaccgcgagcacgtcaagagtttttagaagaactcctgaaacgtggctacggatcaacagatcgactttctaacaaaaccagactgaaaatcaattggaacaacgtgaagggaatgcgcggggctgatcaaatgatcaaagcctacctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaagccccaaccgaaaggaaggggctttatttttacagggtactcacgatttccgcgagttttccaggggttgcgccaggtcgaaccttcatcgcatctttcaggtttttatcaaccatcttttctgcgtctttttcgttaaacccacgtttcaccaacaccgcaataactttttcgcgaatatctttagcggcttcgttcaaatcttctgattcagctagaaccagtttagacagaacatcacctttgtattcctgggtaaagcgtttacccgataccagacgaggtttaccagaggcatctacaaccgtaaacacggcgtattcacctgtttctttggttttggtacgtccggtatacagcaagcacatatcgttacttgggagcttgtacacctttcctttcaccaatgcttcatccagaggcagatcaatttcgaaatcttccgccaactgattatacagatccaggttttcttctgcttctttgtacagagaagcgcctttgaatttcagtggcttgtcgaatttcaggtcatcagcaggatcaccgctgtagaatgaaacagtacctttcgcccagtcaatatacgctgcctgagtcttgccagtggttttacctttcaggcggacaacacctttaccgaagtaagcgagatcgtgggagtccggcgcatacacatcgtaatcagcaccatgtgcaaaatgcaggaaaccaatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaggttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgtaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgccgtttgatgcaggtgttcgggactgatattgtttgtaaaatagatccgtctatatggacttcaattgctattcaaaaaatgttgaaatcctacgcggatcactttatcattaccgatgtgcgtcaaccgcacgaatataaatacctgagcaagttcgggactcgctttgtgttccttgaacgtgaaactggtattgaagataatcattcaacggagcaagggttgacacctggcttgagtgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccaaatttgcagtcttctggaaatcgacggttcgcagggtgtatcccctgatgccctggtcggcgcgatcaaagcacttctgccagcaacagcagaaaccgctggcgacgatgaagcgattgatgcatcaaaagcataattaacgcttaggcgtttaaccactggggggcgaaagcccccttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgtccgactggttgacgtggagaagtgggaaacgaaatacggtaatacgatcgtgggcgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaaccgctggatctggataagaaagtcgaagacatcacggagcacatcgaacatcgcggcgataagtgggttatactgaaccatgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcggtctacagtgaaattcttaatagtctcgctaaacattattcgtgtaacgttctgtattacgcggtgaaagcgaaaaacgaaggtatgcaggaagtcattgcatatcgccggatcaatggcaaagtgtttgcctgtgcgttcaccgtccagatgttcgaaaacatggatgattcggttgctcacgaaaaaccagtgattgctgtacgattccgaaccgttatccctgagtacacgttgagcctgaacacgcgaaacgcgatccatgtgaactacatcgcacccaaaatcaagttcgagtatgacggctacagacgcgttatgtcacgcctggatcgcctgattgcttcaaaagattgtcctcctcaactgcatatgttgaaaaatatttgaaaaaagcccttgcattcgtgcaggggcttttgttatattaggggtgtcgaaacaaaggagacaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggattgttcctctctttcatcaaaaaattttttaagtgagaaatatactatgcgctcaaatgtaccgaaaaacctgtataccgttattgacgctggttcgattcgtattgctgatgtaatggcactagtcgaacgcttcgatcgttcaacgacgctggggcaactgctgagtatggttaaatcccagtacccgcacaaatgcccgaaatgcgagggtaaagggttcgaagttgtgcgtgtcaacacgtatccttctggcttgccggattctggctgggttgatcagatggaagatttcaacgttacctgtgatatctgtaacgggcaaggcttcaccaaagaacgccttatcgcaaaacctgtcaaagtggaatatgtacccgcatgaaaaacaaaatctatgctcatatgtctgagcacacaacggttcgtgttatcttggtagatgggccaatcgctcaagtagaaaccaacgataaacctttctcgttgcctttacaaaccagtgtcggtactttcgatgaagttatcgaagaattgacaaaacacgccattgtttatctgtgggaagcgcaaagttatccatacccaactcctacaagtccggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgcgaacacgttctggatgtacttacccgataatgtcggaattcgccagcctactttcttcacgctgtgtatgttctgcgaaacttatctccctgaatgcgatgactacgaagaacattatggggaataagatatcaatgggtaacaaagtatccctgatgcagtttgataaaaagctggggtttgcattctctcacggattcgccccagacgcggaaaccatgtttaaaatggcttttggcatcgatccggctaccctcgatcaagaggtgttgtcagacatcaacaaaactggtacgctgtattatgcccgtctgccaaatccagaaaacggcattcagtaccaatcgactctcgaaaaactcaaaactgaactgaaagaaataggtgaattatgacttctacagctattcaacaacaaaccattgatcatgatgctgaattcgcacaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgtaagttcggagcacagtaatggaacggtctgctggtattctcttcctgaataacggcagcgttttaatgggccacgcgaccgaaacgcctcattgggacatcccaaaggggcatatcgaaaaaggcgaagaacctattcacgctgcgatccgtgagtgcttcgaagaaaccggagttcttgttgaaccgcacgaactggaaagcctcggaagactggattataccagtaaaaaagagctttacttattcgtgtataaaggcaataattaccccgaagccgataaatgcttctgtgcgtcaacgttcgtgaagaacgggcgaaccatcacagaaatggacggtttcaaatatgttccgtatagccagatccgcgatcatgcgcgtaagactatgggacaacttctatctaaacttgtgggatatacatcatgaaagcaacaacttttcaaatctgtcaaatgatccttctggctaccgcaacccgcgccgctgaacctatcgcgtatcagtcatggggtgattcattcaccgtgaaaaatattcgcgatctgcctggacgcctttacgcttcccctgatttcgaacccgtcgatccgaatgatttgacgctggaagaaatgaaaaatctgggcttccgtaagtgggaagacgattcaaagatgatgctgatccctctgtatctgttgccatacctgaaagacggtttcagcgctatcagtatcagcggcaagaaattcgaattccgcgctggtgaatcagataacgatcatcgtatggggctgctttcgttcggagcactgcctaatgagtcacgttgatttcaacaccttatctcaattggggttgatctggaaaatcaataaagatatcctacatcccctggggctggcgttgacgcgtgatcctgaaactggcgtatcggttggtgcgctggtttccgatgatggtgtctggtcgttcagcgaaaaatcagactttgagaacatagcaaagctgaataaactttatgctttacaggccgaaggaaagctgttagagttcttacaacaaaacgtgaaagagtgattatattatgaatggtgaacgtgtaattgtcattggcaagtcgaagcataaagctaacgcgaagggtgatcacttgatcatcaacaccgatcgcggtgactggtacggtgcaacgaaagtaacgagtggttatgcaaccatcgttgaaaaagatgcagttcgtcccgcaaccgctgctgatcctggttactatggaacccgcgaagagttcgaaagtgaaaaggatcaggagatcgcagaactgaaaaccaaagttcacaacgcgcgggtgtatgcggtgatttgccttaccgttgcggctatcaatactggtttgctgggttgggtggtgaatcatgtctaaagatgatattccggttcataaccgacttcgggaactccgaacttttcgtagtcgcgatcatgcgatcatggttggaagttatctcaactggtggaagcataatgatctggatctgaatccatcttatcagcgcccctacgtgtggacgcagaaagaacaagatgcgtttctgactaccttaatgacggggttcccttgtggtgtcatcgcgatcgcggttgatagccagttcaatgaaactcactgggtagaagtcatcgacggtaaacaacgcctgacgacgattatcaaattttacgaaggtgaaattggtcttcctatgccggacggttcccgtttattctggcatgaactaccccgacacgaacagcgaacctttgaaaatatgtcattacctgcactggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaacattgattcagtagaaccaaatcagtttatcatcggtaaagaagatcatgaactgttacaagcggttaaaaacttgctgacgtatgctcatatccgcgtaccgaatggcgataacgcaaaactggaaatcgcgtgtgctggttacggttacaccgctaccgctgataaaatcattagctattcagcatccagaacccgtgaactggttcattaccgcgataaattgagtgaagaaatccatcaaactcaggtaattgtagatcagttgccagaaaaattcgattaaagtgaaaaaagcccttgcagtaatgcaggggctttgttatattacacacatcgaaacgaaacagagaaaggaaaacatcatgaacatgaacaaaaacattgccgctgtagttggttgtgaagtttctaacgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacggatcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccgtcatgacaaccaggcgcaaagggatcaggaacgcgcgatcaacattgaaacggctaaactccttacccagatgttccgtaagtttcctagcaaattcccatgcaattctatgcattcaagtaactgtatcagcgtagaactggctgataagcgttgtatcagggttaacctggcttacgggttatccgaagacggatataacctggtgatgggctggacatcaatgattggcaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggcaaagagtataaacgcgcgttctcatatggtgttccatatggcgacagccctacacagattaaaagctgggaagagggtctcggaaaatatctggaaaccgtagatccgcaaacggttctggatctggttagcgatctgtcactcgcgcttcgagacaagcaaaaagcagaatcagaagccgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgatacccaaaacatgaaccgcgaacaactgcgctactggcaaacacatttccgcaatcctaacgggtggtaatatgttcggacgaaaacgagaatgtaaacatgttgctaccggatggatgcggggaactccttacgcctggatgcatcattccgtaaccgatgggatcgggcgtatacatggcgatatgtatgcaacatgcgacaagtgcggggagaagtttttgatgtgtaagatacacgttgaccacgcgatccgtgagctggcaaaacatccaatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaatgcagaaaaactggaaaaagttgaagatgcattacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactccataaccctgatctgttattgtacacacatcgaaacgaaggaggaaattatggaaatcatctacaaaagccggaactacaaaaaagaagatgttgcagcagtttacatcaagtaccggaacgtgaaatgtgagtacagtggggcatggggttatgaaatcgttgttgaagaagtcaacgccgacaacaaaaccatttgcagtttcaccactaataccgatagccctctgttcactactgaacagcttgaacaggcttatgaactgcgcaaccaggcttttaacgcggtacgtatcaaatgagattccgtccttatatcgagttccttcgcggtatcagtgagatcctgaaccgcgaaatcaaacccagtccgttagctgttgagctttaccgactggatgcaacccccgaagatgcagcgaaagattacggagatcagttataatgttaacttttgaagagtacaaagcacagcgtgatcagttaagcaactggcacagagagatcggcagggaattgagcgcttaccctaaaaatgaaatgggtatgacgatcgaatcaatccgtaatacgccggaatacaaagcgaaacgtgctttgtgtaacaaagttttccaacagcttcgcatccttaacgggaagtacatcaaaacctacaaaaaagaactggctgacgaacgtaaactgaaacggagtgtaaaatgatgcaacacgaactcaaaacagagattgacaaacgtactttcctggaaaagaataaaacggtaacgctgatgcattactccaccaaaaacggttcgagtgagttctggcgcgttaacattgacagcaaagagaaacaccagtcgataccgttcgacaatgaaagccttgctcgcgctgtcttccaatcccacgttaaattttgagaattatattatgaaatctgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggctgactcaatgcgcactcggtgctgatgcacaggggcaaacaaaccctgatatgttcgatatgatggcgtatgcgcgttctaaaggcattgtgccgaaccttaccattgctgatgtatcaaaagacgttgcagcgcgtttagcggcggttgctggggctgttgcggtatcggtttataaacacgctggctttgatgtcgctttcgactcggtagcgaacctgacagaagccggacaacagcaaatcaacctgcatttcatggttagctcgaaaacctatgatgacgcgtttaacgtggttgatgccgtgaagaatgatccgcgcctgaaacaagtaaacgcgatcgtgttcctgggactgaaacaaaagggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcaacgatgtttagctcttacattaatgaacgtggtcagttcttcccttgctcgtttaccgaacgttgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggatgtgtcgcctatggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtatctattgacattccaacaaaaccgcgtacactggaatcgttgattgaaaaatactctggaatggttatttgtccttctaccgcacaggtggcaatggcagaacgcgatgaaattgtatttgaatgtgatgcgaaaggctatcacaccgttgaagatatgcagatgattgaatatctctggggaatccgaaacgctgtagtacatcacatactcaccgctgaaaagaaagccgaagccgtgagagaagttgaactgcgcgaagagatccgttataatcggatgtctgcacaggaaaaggatgaagcatatgaagtgtaccgccgtagtcgatgaattaatgagcgcgtttaaaacgcgtcgtacagatgggcgtattaaagatccgaagtcaatcgcgatcatcgaacggtacgcgatgaagttaagcgaacaggaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactcggttatgtggaacctgatgcacctggatcgtttgatctgggaagtgctcgaagaagagggtattgtatgaaaattcgggtagttgaagttcatacgcctggatgggttcctgaaagaacatacaagttagagaaacgagtatttgggtttttctgggttccattgacttttaaatctggtattcatactatccaatacgatggaagaaccccagaagaagcgctggaattattcaggctaagaaccgaaaagaatttaaccgttgttaaggaaattgattatgaaactcgatcgtgaattaagtatggctatccgtactattgaaatgatacttgataaactgagtgcggaagaagagttttgtgtaagcgatatcgaagcggatttagttgaatggcgtggtgcgctttacgaagcgacaaagggcaacgatcctctgttcgatgaatatgatgtgtacaacgtcaaggtatggaacactgaataccgtttcaagtggcctggcgatgcttacgggcatattcaaaccatttacgtaactggtggtatggtgtttgcgaccagtgttggggctagtgaacttccgatcaatcccgatagtaaagtaacgacaccgaacccattcggacatactaccgtttgtttgggtgtagcggaggacttctccccgttctattcaggctggatcgaagccagcaaaactaaccttaaaagagtataaattatgtggaaaattgttgtgtgtattttgatggttgtcgttgttgtgttcttgcagtcaagctgtactgacgagaaagaggcacagcgtaccctggaagcacagggttatacgaacatccagttcacgggttacaagtggtttgcatgttctgaaaaagacacatactcaaccggattcgaagcaactggtgtgaacggcaagcagatcaaaggatctgtgtgctctggaatatttttcaaaaatagcacaattcgtttcgaataactgttgacactaatccccgttgtgataatatctctctcgtagacaacaaaacagataaacaaggggattaaaatgaacttactgaacgaaatgctggaaatggttgaagcgaacaaagaagcaatgaaagcgaaagaaggttgggtagttgttactgactgctacaaaccgcaaagctggcttcctgtgttcctcaataaagatggtaacgaagaacacggcttctatgatgctgcaatcttcgaaaccgctgaacaggcttgcgatttctggtcttacctgagcggtgacaagcctttcaccaaatacggtgtttgccagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgactcaccctgacgtgaacgtattcgcttcactgatggatgatgtgatcgctatcgactcggacgaactgatctgcatcgagacaacgaacccagaagataagacgatcctgaaacaagcgtatgagcggatcgagggattacacgatcgcctgttcacgttaactttcccaaataaaaacgatagaccttgttgacatcaaaacagattgtggtaatctgtatatgaaaactaattgtgaggaatacattatgaaaagtgcttttgaaaaacgtgctctcaagaaagatgtgaaacctggtgcgatcatgtatgaagtgttctgcgtgaacggcgaaaaagcggaaatgggtagcaagatgattgttactggcttccctcgtatgcatcgcggtattgggctgtttgcaaaatgcatcaccctgtacaaagactgggactgtcacacagaattctctcttgacgatcgtagtatgaatgggcgcaacggatataacttccatgcgttcttcctgaccaaagaggatgcacaggcttacattgatgaagtcaatgaagaccgtcttcctcctgatatgaaagagcgaaaagaagaacagatgaaacgtaaacgtgaatttgacgaatgtttcggttatctctattacgatgattattaatcgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcgcctgttgatttcggtgtccgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaacagggcgtaaaactgcgttacggtatcaactggaagaacgatccaaaccttccgattgaaacgaaatttatcgacgcaccacacgttgaacttgcataaggcgacaacatgatttcacaattctatgttgacgctgtaaagcagtcacgtaacctgcacctggcgcgaatcattgatgggcgctgggggcaagaatgcggcggggtgtctatcttcgaaactgcgctggatatgggtcggatgtcgggtaaaaccaaagcggctttcgatatcatcaagcagtctaaagggacactgaatatctatgttgcaccgacaaagcagatgggtatttgtgctgcggtagaacatggactggataagggcgctgattcgtctttcattctgtcgaaacgtcaagatctgacttccattttccgtggacaaacgatcaagtatcaggcaatcaacctgattttcgatgaatgtgacacgacgatcgacgaacggtttgaactggcaaaaacgctgaccttgtgtatgcgttcaagtcatcttcatccgttcccatatatccatattatccgtttgggtatgtaattgcagtgcgcggggtgcgaatccgcgtaccccgcaattaacaggaaaacttctatgaaatatgttctagataccaacgttttaatctcgaacccatattcaatcttctcattcgttgaggcgggtactgaaatcattatcacctctgcgacaatggaagaactggatcacctgaaaagcaaagagcgaaccgctcatgaagcacgattggcgatccgcctcctgtctaaagtaatcctggggcagaagtacgaagcaattacccaaacaggggtttcgttgaacctgacgaacccagcactgccggaaagcgtgaaactccgtatcgttgattatatcggtttagaagagttcccgcttgataaacaagatgcgcgaattatcgctacctgtatgcaggaaaacgcaaccctgatcacccgcgacattaacatgctgttgatcgcgatgtctaagggatgtcctgttgaacaatacacgggcgatgactcgctgaaagatagcgatgtgttgtattctgggtatgtcgatatccctggattctgggatgatgtcgaggtgttgggatatgttggcgaagtagcccaaataagctattcctcgcttcctgacggcgattattacccgaaccaatacattctatcggatggtgaacttgtagggcgtgtagtggctgctggagagtatcagcttgaactcttaccaatcaaacacgaatccgcgatgaagcgtaagctgatgaaaacaattcagcctcgcgatgcactgcaagcgtcattcattgatgcaattatggataaaaataccgatgtggtgaccatcatgggcgctgctggttcaggtaaaacaatgctggctgttgctggtgcaatgcacctggttaacgccggacactttgcaaacctgatgtatgttaaatcggatagtcctctgtcgggcgaaatcgggttcttacctggtactctgggcgaaaaactgcgtcctgctgtggaaccatgtattacgagcctgaacattctgtttaaggatcaaccggaagttgacaaatacgtagaagggctgctggagaaaaacgttgtccagttccctagcctgtattacttccgtgggcgctcaatcgggcatcctgatccgggtaaaggttcggttctgattgttgatgaatgtcaaaacttgagcaatcacgaaatcaaatccatcatttcccgttgcggtgagaacacccttctgatactatgcgggaacattaaacagattgacaacccgcgcaatactgctgttaacaacggctttgtgtatgcggttgaaaaacttaaagagtacggtcattcaagtcatgtgatcctggataccgtatatcgtgggcgactggctgcattcgtcgaagagaacttttaatcaagggggcttcggcccccttttttcgtgaggtatacatgatcaacgttattatcagtccaaagctaattaccgtttgcgctaattgcaaaagtgggttagagtatgaactgtctgatgtacagaagagaaccgaagcgttttataatggtttcttcaatgcagcagattacatcgtgaaaaaacatatcgtctgcccgaaatgcggtagcgaagtgaaactattcttgtgaggttattatggttcaagttgtgagtattaccccaaaacaaactacctgtcgttgtggtgctgtcctgtcatacactgcgcaggatgtcaaagaaaaggtatctactgattacactggcggtcgtgatgtgtatcgtgtgattcggtgtccagtctgtgataaggatgtagtagtatgaaacgcgaagaacgttatgcagtgcttaaatatgcggatattgatgccgcgttaagtgatagcgacaaactgcttctctctgcggtagtgaataaaattgatcgctatcgtaaagagcaaggcaaagaacccataaaaggggttgttgtcgagcatgattggcctgaatatgaacaggtctggaagaagatccaaactcgcgttgaccgtgaagataacaaccgcaagttcgaaacgatgctggacaacaaagaacgtctgggttatttcttcgtggttgagactcaccaggggaaattcctgatcaccagtgacgcacacagcccgaatcgtttgaaagattacagcggatacaaatatcgcgccatgttcagccctgattgcgggttcgacaacagcgaaatctttacgactggctggagtgttcactttaaacatgtggttcaggtatcgtttgatgaaatcgtagctctgtacgatccgaacgcttcgatttcaaactataacattgctgaattcatcgagaaaaaactgaccgaagcaaaacagcgtaaaatcgttgcataaataataagacgagggtatcatagccctctcttgttacaaataggtattacaatgaagaaaattatctttgctgccagcattttcttatgctctttttctggcaacgcggcgactgatccgttaggagagtttatccaaacactcccttctgtgaagtcaacattaccgctacaacaagcaacagtaatgaagaaagccccagccaatgcccccagctatgttaaggaattggacgaaattacaccaaagcagaaaaaggttttggagtatgctttcaggatcggtaacgaatacgatcgaaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtacgcacttcacgaactggaatactggcttgattaccacaaaggcgacttgaaaaaggcgctggcgagttacaacgcggggttcaagtattcaaagaaagaagcccgtgattatgctcgcatggttaaccataccgcgaagctgttagaagaaaaacgcattatctgataaaaagcccttgcaatttcgcaggggcttttttattatgtgtgtaccaactattgaggattaaattatgagcacatcacatcgagttattaccagtcacccgactatcatcaagccgaacatgctgcacatcattcagggtgtgttagatgaactgaacaaagatccaaaggttaaagtggaaaccatcacggtcgatcgtcatcgcatggaatctttcagcatttacttcgcatatggtgaagaaaaacgcaaactgtttatctgtgaaagtcacgatacatatcttgacgttggcaacaacacaattcatagcggcggtgtttacttcaacctgaacgtgtggggtagcaacaaagagatcatggatatcgtgaaagcgggtattcgtaagcacgtcccgaatgacgttagcatttacgaatgtgttaatgatgcaattgaagatcgctttgtgcgcgtaggggcttaacatggaaactaaactgacaccggaacagcagttagcaattattgatgaacgtatcgacgaaatccgagcgattgtaaaaccctatcaggaaaagctgaacgggttgctgaaagcccgtcaggaggtcaaagacgagatcgatcacaaaaccgcttcccgtgtccgcgcgatgactccaaaacaacgcattgagttctacatcaattccccgaacagcggacatgaaattttccgtgatgcgactaagttcttccaggatatggggcttgcgatcgatgggtataacccagaaaccaatcagcatattctccgtattgcgatgaatgaggatcgcagtaacctcgaatcagttctgaaatcgcttcaacgcgtgaagccatatgtgaagccgatcggcggtaaattactgttcgatatcttcgaacatacatgttcacagttcaatacgtactggttagcatttgacgttgcagaagaacgctggatgtgtttcactggctggagcctgaaacgcaatcaaaagccagaatttgaaagcgatagtttgcgatcagtgcttgcgtatgtctgtgaaacccattattatacccctatcgaaaacgattcatactaaggtaaaacgatgaaaaaacttgcgctgttactcactctgtttgctggctttgctcatgctgatgatcgactggctgaactctgcaataatcgtgacattaaagacgttgcggtatgtgaacaggtgattgccgaacaactggacgcggcttatgtgtggggcgaagaaaacgcgcacctcttcaagcgtcagaagttggttaaactgcatgagtttttacagtctgaaccaatgatgaacctctgtaccaatgcgccaaataaggaacgttgtgaaaaactccgtacttacctggttgatgaatatgttgctggcataggattatactgatgatgggattagtgatcttttacgggtgtgtgattgctgctgcaatcattatatggtattacgttaaaaagccaaacgaaagctcgttccctgtatatgatgacgagttggaagcctggcaaagatgggacgacgaatttaaatgaacacaggttatatcttaatgtgtgttgtggttgtgatcgcggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggcgcgggtattgctaaagaagtgaagcaaaaaatccctggtgcgttcaaaattgatgcactgactatgaaaggcgatcagcggaagttaggcactaactccatctacatgacggaagaaggtcagattgtcttcaatgcctacactcagtttaaattctggggtactggcccacaagtggattatgatgcaatccggtcatgctttgtgagcgccgtagaacgcgccagtgcgtttcccgaaaaattgcctatcattacccctcttatcggtgcggggcttgctgggggcgattggttgcgtattagcgctattattgacgagtgtacgggagattacccgatcatcgttgttcacttcgatccatcggttgatccacgtaaggcggacttatcatgattgaagcaaataaagaaaagctctatagcaaaatagagaagtttgcgagcgctcgtgaccgtttccttgatggtgacgcgaaagcatcacaggaagcgctggattggtgggatgatatcgttagctttgtggatgatctggttgatgccggacgtaaagaggcgagagaatgagaccgcaagaacaaaagctgttaaaacataaactgaaacaactgggcgaagcgtatcaggattatgccgaagatgacgatcctgattcacgcaactacaatcaatcctgtattgacgacattacggcggatattctggatttcgttgaaaatgaaatcaatgatgcggttcgtgatgcggtagcagtggagcgagctaatcatgattgatcctatcaaagcaggtcgggcgatcaagaaagctaacaaacggatcgccgcaatcaaaggacaacgcgccgcactggtgaaaacctgtgaagcgctggcgcagtccatgaaagcgaacaaaatcaacatcacacagcgtaaaacggtggttgacattctttgtcttgttgatgaaggactggataaagaaatgggcgaactgaaaagcaaaatcaacatgtggtatcttgatatccataaagcacaagatagcgaaatgggcggttataatcatgactgacaaaatcaaagctaaagcaatgaaggtgattgcgacatacggaacactccgttggtgtaacgcgcaggtgtgcgggtgtatgggttgtgcaaatcatactatgacgaaagaagagtatgatattgctatccagatgccggaaatcaaagagcatcttgcgcgacgtaacaaaaaactcatgggtaacggatggtttacaattggctaaactgtattatcactatgcatcaatgaacgctggaaagagtgcgcgactgttgacggacgcgcacaattacaaagaacgcggtatgcgtgttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaatgttttcgatctatgtcgcgttgttgatgaactcgaaatccctgtaatggcttacggtctgcgtactgatttccagttgaatctgttcgagggttcttactggttgttggcctgggcagacgagatccgagaactgcggggaatgtgtcactgtgggcgtaaagcaactacggttgcacgtatcgacgcacaaggcaacttcgtaaccgaaggggcgcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcctccatcgaacagatcgaagagacaaaagcattttcagagtattatgcacagcacggggaaagtcctgatggtttacgttggtatacaaccaactggaaacacaaatcaggttgcgcatatatccggttcgataaaaacctgaatcgcgacggtaacaaagctcatcgtgatatctccgcgatgctttcaatcgctgtgaaaaagattgattcgaaagtacgcgctaaaatgcgtcaggaattacgccggatgaaagctggcgtaattggatgggatgaaaatatcgagaacgcaaataagatccgcgcttttgagcgtagcttatgctggtatgagataacttgatgtatttttagactaattttacataaggggcgattcgccccttttttgctataaatatatacaggaacggatctattgttgatccgtaagtacgtagagaattgcttatgaacattaaacgcatatctaaagcgctgatgtttggtttgttaatcttgtctccgtcatcacatgctgatgataggtcagtagtagccaaagagttcgattactatatcaatgcggcgctacaggtatatcttgacaccatccctcccagcgtaaataccagtgaactattctataattacatggaacgaaaatggcagcagaagcaatgtaaatccgaacccgaatgtaaacgtttagggctacgggttgcaagtgaattcgccgctattcatcgttcataagggatgaagatgcagacgtttaacgaagtaacagaacgcgataccgcgagtaaaattgatgcctttattggcacttgcttaatgtctgtaacctatatgcacagcgcacattttgcgactggttcatattcacagcataaagcatttgaagggttttacgaagatatgcaggatttggttgataaattcaccgaaatccatataggcattactggtcgatacaaacccgtattaaaaacagaaaatgtgcttgacacggtcgcgtatctccgtaaaatagccgatgaagccaacgaaatctatgattcagtagatagttcattgaagaacgtcctggacgagatcaaaggcttgtgctatcaaacgatttacaagctgacaaaactttcttaaaaagagtttgacaagcgaaaaagtgatgatagaataactatcgaattgaaacataaacccaatggaaataatgatgaacttaaacactatcgtaaacaacccgaagaaaaccactctgatcgctctgggcgtaatcgccgctctgtggctggttccgaactcgtacactatcgttcaggatggtacggtaaaaactcaaaccttcatgggtaaagtttcaccgaagcctgttctgcctggcttccacctggtaaacccactggctgatttcgaggtgttcaacaccaaagacatcgcaatgaagtttgacaaattgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccgaaagcacaggatctgtataacgcagaagttcaaagccagctacagatcgcaattcagcaggaagttgaagagtatgcccgtccttacggctacaccgtgaaacaggtattcttgcaggacatcgacctgccggaagcgattaagaaacaggttgaaaacacaaaaattcgtgaagaacaggtgaacgcagaaaaagcagaactggcacgtaaagagcaaatcgctcaacaggcagttgttcaggcaattgccgataaagaagcccgtagcaatgctgcacaggctaacgagcgtgatgctgatgcccgtctgtatgcggctaagaaagaagccgaagcgaacgccgtgttgcagcgtaccattacaccagaaatgattcgctggaaagaacttgacgttcagatgaaacgcgcagagaaataccagggcggtgttccacataccgtaatgggtgcgggttacgatggacaagtgattttcgattctcgtaaataaggttttaaagcccccactctgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcgaagaagcaaaaaccgtttacatccttttgggttcagcttacgcttaccctaacgttttaaaccctctgacagcgcgtgagcgtcaaacgatgatcttctcatggttaaacgctaacttcccgatcgaagatgttgttcgtgttcagtttgaacacattccagattatctttacaacgaagagaaatggaaaacctctgttcgtactgctatcagggaaaccaaaggcgacaaaatcgctatctacggttacgaaaaagatgcgggttcatactggcttaaagcgttcggatggacacacgtacctgttgatcctgttcgggttgacggcaaggatctatcagcaaccgatctgcgtccgattattttcaaccacaaaaacggatgggataagaaactgctgcgctttgttcctcaaacaaccgtcgattatatcgacaaatggatgatggaagacacgttctggcgtttattctacgaatacgagaaatgggaaagcgaattggagaaattcaaaaactacccataccccgacgcgctgaactgctgcacgggtgatagtgtggttgtgtgtaacaatcacctgctggtaattcgtcgtaagttcgccccaggtaaagacgcgttagcccttcctggcggacacaaaaactcaaatgaaacgttcctggattgtgcgatccgtgaactgctcgaagaggtgcggatcaaagttcctgaaaaggttatccgtggttcaatccgtaattcgatgctgttcgatcatccgaaacgttccgtatacttctcaaaaccgactgtggcgcagtacatcaagttagaacctaacaatgatggaagtctgccccgtattatgggcggttctgacgatgcgttagacgcgttctggatgcctatgcacgaagtcaaacaaaatcgtggtgagttcttcgatgaccactatcagattatcgtagcctttacgggactctgataaaaagattaaaaagcccttgcgttcgcgtgagggcttttgttatattaggggcatcgaaacgaaggaggtaattatgagcaagaaatcagaagtagccgaaatcaaaaaacttgatgatggtaaaatcgcggtacgttggaaaggcaatcgcaagttcaatgtgattgaagatcccgaagtcgctgctttcctggtgttcatgattacccagaaagatacattcgttcctgatccaaacaatataaggctggcggattaatgaaacatccttactgtttagtaacccgtcctatctgcgcgggtggtttacctgtcaactgctggcagttgattcaaacaggtgacgcgttcctgaataagcgcggtgataaagtgtttgtctatggcgtggattccatcgaaaatgaaacgatggtgatcaccgacgagaaaacaaaagaaaaatatacgttgacttctgatcacgattgccgtaactttaacgtgtactggaaatctaatgaagactttgaaggaattaaatcatgaaagtagcaacccttagcggtatctctgatgtaaaatgtcgcatggcgctggaacctggacatcgtgtaggaattaaacacacgggttctgtaggtacaaagaattacaccttgcaatcagttgcgcgtgataaaaatgatatggtttatgtgtttgttactgaacctatgtcaagtagcattcgtcaaacgctggtgatgaaactgggaaccaaagaacccgcaatgctgatcggtggaactgtagagcctgttactgttgcgagcatcgcgcataaaggtattgaatgcgccgtagacggtaacggtaaactgtccttcgaagggactaaacgccaacccgtcgatcgtccggttgttgttggagacatcttcacgtcagaacgccgtgaataccatgttgaatacatcgcacaagatggttctctggtttgtcgcatgtactcccgtaagagcgcagacgataacaaatacatgggattaaccgtcattgatggacgtgacgcgatcctgctggattccctgaatgttaaaattaagtttgcatactcatgattcacacaattagcgttattatgggtgatgtcgtaaacatcaacgggcacgattactacgtagcggaaatcaatacaaagggtaatcgtgagatcctggaactggacattgtaaggccgtccgaagggcaatcccttacgatcgaagtggttcataacacgaacacaggggaagacgtagtgaagccagttctggcacgtcttccggtgttctactgtgaaaagtcaaaacgttggaaaatgaaatgatagatttaactgatgtgaaagtgggtgataccctgtttgatcctggtattcgtcgatacagtcatcacaaaaccccacgacctcgcaccttgtatgtgatcaaggttgcccgtcaatacctgtatgcgtcggaagatccaaatatcaccgatattaaagatttccgtgttgagcgacttgatcgaaaaacaggtagcgctaatgactggaataatcatacacagggttatcatagcgaagacgaatacaaagaacatttgtaccgtatcgaacttactgataaaatcaaagacgcgttcggtcgtggacatgtaacgcgtgtaccaaatatcactaccgctgaactgcgcggtatcgcaaaaaccctgggggttgaattttgaaaactgtaatggaaaccgtgttcggttctcacctgtacggactgaacacaccgacaagcgacaaagactataaagggatctttctcccgcacccgcgcgatattctcctggggaaagccccgaagactattgacaccagcacaggcgataaaagctctaaaaacaccgtagacgacgttgaccgtcagttgtatagtctgactaagttcattagtcttgcgtgtgatggtgataccgtagcgctcgatatgcttcacgcttcggatgacaagctgatcgttaactctcaaatctggcagtatatccgcgctaaccgctggcgtttttacaccactgaactaactggcttgttcggttatgttcgtaagcaagccgcgaaatatggtgtgaagggttcccgactggctgcattgcgcgaagttgttgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgcaagtcagtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaaactggaagaagtcatgggtgaagtcgaacgccttgcagcgatttcaacatatccgaaagaagttgatcgcgaattctggaacgatttcatcgaacgcgtatacagcgatcatgttgtggggtattacaaatgatgtatcctaaattgtccggcgctgaaattgatgttctgtataaactttacggatacgcaactaaagtgctagacttagatttcgatgacgtacccagcaaatcagggcgtgatgccctgattcaaaaaggttacgctcgaagggtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcagttacactggaacaggctgttgttcagatcatgcgcgatagcctccgactggaagttactgaacgcaccgaaagcaattacacgggcgggattgatggtcgccagttgtacgaagatagcaaacacgttaatgtaaccctatgggcggacattgacgaaaactcatacaaaatcgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtgccggatcatgatatcctgctggcggggttcccgtgtcaggcgttcagtaaagccggattgaaactgggcttcgatgatgtacgcggtacggtgttctttgaaatcctccgcattatacgcgctaaaaagccccgtgtgttgttctttgagaacgtgcctgaactgctaacccatgacaaggggaagacgttcagaacgatttacgggcttctggaggccgaaggatacaacgtattctatcaacgcctgaacacaaaggatttcggactaccacaaagacgggaacgcgtgtttattgtctgcttcctggatgatgtattcttttcatttcctgttcccccgcgtacacctacacgcgtaggcgacatcctcgaagatgctgatgattcattcaccctctcagataacgcatggaaaggctttagagagcgtaaggaacgaaataaggcaaacggtaagggtttcggttatcaggccgtcacaagcgattctgcgcacactgggacgataacagcgcagtattacaaagacggtgttcaatgtctggtattgcaggacgggaagaaccccagacgattaaccccgcgtgaatgtttccgcttgcagggcttcccagattcgtttattattccatcgagtaagaaacaggcatacaaacaagcgggtaactccgtttccgtgccagttatcgaggcaatagcaaaacagataaggaaagtattatgagaaatcaacctgaaatcccgatcgataccgttgttgaatggcattacaaccactgggaaaatgatgaatggtctgccagccagggcgtattgaagtaccagaaaggcaacttcatcctgattgaactcgaaggtaagccaaccgtgctggacggtaaagatttggtaatgcgtccgtacaaagaaagaccggaaacaaaattctttaaaaaagtgtttgcatccggtagttgatagtgataccttagctttaccgaaacaaaggagacacaaaatggctaacatgactaaagcgttattccagaagaaagtaaaagcggttaaagaacttgggttcactccggctttgatgactaatggcaaaactctgatcattcgcttcgtgaatgcttacgatgaagttgtgtgggaaaccgtttgtgtcgcctcttgttatgacgttttgaacagacaagagaagaaatatcttgcatggtttaacgaagtgtaatatattggccttgttgaaacgaaactgaaaaggaacataccatgacttttaatgacctgtttaacggatgtactggcgctggtgcgaaattcaatctcctgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgctttcgcagagtctatccgtggtgtgttcggacactgattaatcaagccccgaaaggggcttttttcgtgaggaagttattatgatctatactgttgaatgtcttgttgattgtgagcctggtaatctgatttgcgcatcggatactattctggactgtatcgacgcagtgaacaatcacgaaaccttcccgtatgttgccgatgatctcgaattcatcgcatggaaagacggtaagaaagttgcggttgctgtattggtggggaacagagtaggcgatacaataggcgctaacggttatgaaccgaaccctgtgacctacgaagaagttattggtaaaatggtgatcgaatgaaaaataaaaacgccgaacgcggggagaataccaacgaaatgttcttcattcgttgcaatcgtaagcccctcaaacgcgggtatgacgacatcgacgaagccctgagcaagtttaacgaaatcatccgttcatccgtctaccgtagcggggaacatcctggcgacctgtgggaactggtagcaaaagatccttacagtaacatcgtcctgaaatccgaaacaaagggtaaagtatcatgaaaatttatactgttgaaagtttaagcgaagattactatacatttagtgatttggtcggttctaccgtatcgctggaacgtgcgattgaaatggctaaaccttttgactgggtgagtatcactgaatgcgacggctttactggcgaacgtctgcgcatagtaacactgagcaacgaaaaagccattgcgaacgcaaccaaagaaaacttacaatttgaggatgtaaaatgaaaatccgttctggttttgtgagcaatagttcatcaagtagtttcatcgtccggttcccgaaagatccgactaatatcgacaacctgcgcgaaatgatgggcgattgcgtccctgattgtggttactacgatccgccattgacagcggaagaagtggtcaatcacgttcatcgtgacttaggcggtcatctgggtaatagctttgaatcgttctacgacgataagcgctatgactgggaaaccgaagaaagcgcggaaaaccgttaccgttcaaatcctcaaattgcgcttgcgtatgacgggcgagactggtacgatctggacacagaagagaaagacgctctgatcaaaatgtggttgtatgaagaatacaacacgaagttcggcaatcaggacggcgtgtttatctttgaattcacgtactccgatgaatgcggcccgatcggaactcaactggaacatggaaacatcttccgtaaccttgaacacacatcaaagagtcatcactgatggataataaactgaaaacagaagtttgtgttgttatgcctcgctatgcattaggggagtcgatcccctttagccaggatcgccccgcaccgtttgatgtattttctttgcgaaaatatcttgaacgatttgaactgaacgagtatactctccaaatcgttcgggtatggaatccggtaatgtatgcgcttgcgtttgacgttgctgaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaacctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatctgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcgcgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgttcactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccgctggaaaccgatattccgacactgaaaaaccttcgtgcttctggcctgactatcaagccgctggaaaaaatcggtgatgatcgtatgtcggttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaaacgtgacgaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcccatgcatggttcgcggatctggacttcgaagaaaccaaagtttctatcgctgcaaaagatattcttccgaaagaagataatattccatccgatttctggaaagtctgggaaaccacatcattcgaatgtgaaatcgtcctggaagaaaaagaagtcaaaatctaacaatgaccgcccccgaaagggggcatattgaggaaaataatatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagattgatttagtcggattcccttacaaaaagggtgcaatccttctcgaactggaagatcatcatttcttcgcccatgttggcaacatcgaagatcatggtgatttcgatatcgaagatatccgcgaaaagccgtatgtgttcagcaactactacaaggtcggtggacacctgcgcagtgataacaaaactgttctgtatctggatggtattctgtctgggatgcataatttcagcattgagaagccaggcaacagcgcagaactctaccgcttgtttggaaagtacgatcgccagaatggtaaactgttaccgtcagaaatggcttatatcatcaatcgtctgatcatgggacttcacaaaacattcctgattcactatgatggtgatgtagaacaggcgatgactactgtgattgacatcctgaaagcaaaatctcgtgaaatggataccctgccaaaatgacattattcttcatcattgcattaggtgtgtttattctgggagccacgatcgcatttatggcgttcgataaacgcgaatatcaactggcggtcatcgggcttatagtagcttgtatcccgctggtgttgtcatacaacctgtatcatgagaaaatcgcggagaacgcgaaatatgaggcaagacgatgaagattcgttctgggttcgtgagcaatagctcaagcagtagtttcattatcgggatcggacttgtccgccctggtaaagaacaggaagttgcaaagatttacggtgagtcaaacgttgaatctctgatggatatgtttgatgatactcgtcctcgctggggttcgcctcaaatacacgatgacggtacaatcacactggaagcgttcggatgtaatagcgtcgaaataacccgcatttgggacaagctgaaagaactgaatctggatgatgttaaaatcgttcacttcaatgagcgcggcgacgaaccggaatacgacgatgaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttaccgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaactcaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaattgagaaggaattagcatgaacagcgtttatctgattgaagaaaccattatccagccaaacggcggagtgtatgaaaagaatatcgtgtgtgctgccctgaatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcaaacaagatcggaatgattgaatattccaacttctgcttcgaagtcgaagaagtgcgttatgatacgatggacgaagtatacgaatatgtgcttcgtggtgaggaagtgattaagtcctataacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtgtcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgttgcttcctttgattcggatcttgattgcgttcttaccgaacgatacacaatacaccttagtgaaaatgttttcctgttcggtgcgggaataacccggatacataatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatgtcaatcattttaacctcaaaaggggctttcgccccttattgtccagtaaccacaccacgaacggcaattgctgccccttcgataagtgattgtttgaatccgtcccaaccttctttatctgcttcaacaagccagcctgttttataggcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgacaaccattcgttgaatactttcaggttacgcgcttctgaatccacacggaacgttagcgataattcgccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatcaattaaagtatcgcggatactcccgatcgtgctgtcgagaatgcgtgatgctggactggttgcgaatacaacactaaacaggttgcttcgctggaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcacctgtctggaagtcacgaataaaccacacaggaggcgatttaataacttcaacgttcgatacgaagtcaacaatctgatccccgatgctgccgttgaaatcgcttgctgtcgtctggtttgttgatggtgcaaaaacgtttgcaaccttcgaagcactggaattatacgcttgtttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttcgtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggggctttcactgcttccggttgcttgtcaatacttgcactcgtttccggtactgtggtgatcttttcctgccagcgggagatcatatcacgatagcggtctttgtcgtcctcattcagcttgttcgaattgtttttctcttcaagcgattctatgagtttttccattacctttttatcgttgcccgtcagattgtctttgttcaggatttcatcaccctgatcgaattcattatccgctttaggtttcgctttcgcttgcgcggcttcgatctgtttggtttcgtccacgcgcttacggttagcggtattctctttatcaacctcagcctgtaacagtgcggggttttcctgcaatgctttcagttctttcttcttctcttcggtgatcttttcttcaatagccacacgatcgcgcatctgttccaattgcttagacaatgctttctgtgcgtctgtttgctgtccgaaactatatgagaatgcgccctgggtagccttaacctgttcgacaaccttagaacgtgcctcaaccactttatcattctgatcctggatctcctgctgtttcagcagaatcagatcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaaatctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttgattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacgctgtctttgatgtccagtgtattcagcgcggtttcaagggtattatcattgatatcctttaactcacgcatcgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgccttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagaaaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatttgtgggaagatggttccggtatctttatgaaaagcaatacggagatcctcgcacaaaccccgttaaaggcttacaagttcaacgtaagtaacccgtttttaggtgacgctttggtattcacgaaaggtgaatacattacccataaggataacactaccctgttaggggatgcaagtttctttagtttctcgatgacggataaaaaactgtatagtgatatccttgcgagtaccgatattgaaaacgcatggatcaccatgaacaggaacgcggtatatgagaacaacttccagaacccagacaaacagggtcaaccgttccaggctgttaagtgtcagacgttatccagttatgaaaaacgtattcggtttgatatcaatcagggtcgaatggatgttaaagtgggggcattgattgaggtgttaggggatgaatattcagggaagtatctgatcgttgaatgtatccgcgatgtatcaaaagatttccacctgcaaacattggaatgtgtacaggtggcagcggctacgaacgacaccagtaaaaccagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcaaacagttcatcttcggtgtattccttgtttttgtccagatcgagaatgacgcattgccaggtgtcttcatcgctggtttgttgcatcatcaccagtgcggcgtttttgaatcccagattatgcgcaagcatttcatggacgaattcgcggtcgccgtcttcataacggagttcgttgccttcccaacggataaggcgcacagtcttacttggttcatttttcataacgtggtttcctgctcataagttcgcgtaaacgtttcgtcggttcaggtgggtttttgatgatctcttgaatccgatcccacacttccggtgaaacttctttcctgtccatgataacgatattctgattatcacagcactttccaaccattacggatcgcccacaattaaggcaaatcgtatcagggcattttccaagtttatcagggtcgatagattcaaggaatcttcttgctaccgataaccgctctttaacttctattgggtcatattctttatttttcatgctaacaattgactcccctcataattggtaggaacccgacaggcaaaaaacaattgttggtgttcccagtttttacgcgcctgttctggagtatcaccccatgcagcatcaaaaccagttttcgcacagcaccagcgatgattagggtcttcgctgatagtttcgaatatttcgagtttcttactcatttcaggtcaccgataatttccatcgctgcttcgatgttttcaacaccataaaaggtattcccacttacttcaaggagtttgataccatgaagataaaccccaaccagcgcaccgatagcatcgtggatagcgtagttgccgttttgaagttgatttgcagtgtgcataattttcatgatgtttctcctttcgtttcgatatgggtaatgtaccactacattacccagtaagcaagcattatttttcgatttcgtagcactcttcaacttcgatgtttaccagaggtacttcgatatcccatgaatccgcttgtgcatcgtatacggctttgtcttcgtcgttcagaggcagacaagtaacccaaccgtcagtaacacgcatcacgcgcattttagaaaggctttcgagtgcgtccgctggcagtttttcaccaccgttacccagttgtgccaaacggtcttcatttaccagaacgattactttgccttcgagttctttagtgatttgcatgggatgttccttttgtctgtttcgtttcgatgtttgtaatataacaaaagccccttactcatgcaaggggctttttagcaaaaagtgctatttaaaacagatcagcgaagataacgtgaatatcatccggttcggtcttatcgcgtcggatcttcttgatgattggcaagaagaaactgaactcaggttcgcccttcttacgcgttttagacttctggagtccgtcaacttccatttcgacgatagcgccgatatagtcatctttgttcgccatgatgtattcgcgatccagttcaccacgttcttctaacgggatgtacacgcggttaataccgtcttcatcgtatcggtagtccgtatcagtcagaccggaacctgtgtttgttctggcttctcctgataagtcctcaaccacgaaccctccgaccttatgagcttctttggtgtgttcgtacacgtcgatgattcgcagttcaatcggggttttgttcttcaacttcacctgatccgcaacgcgtgaatccttccatttgaaatcaacgtttttcaggattgaaccctctttaccgtcattgcggtaattgttgtaatcctttttcgcttccgcgtagttctgcaccaggatagaagggatcaacttaaccgatgttacaccagagccagccagcgcaccttccaggatagagaaacgatcgcaatatggttgaacactcggagcatcgccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgttcgaaggaacgacagcagttttttcagcagggacataaatcagttctccatcaagtacaacatcataacccagataatcacgaatctttttcagatccttgtccagattcaccaaaccttcatactcatttcccgcgcgggttgctttgcggatctgattctctaacagttcggacatacaacgcgcaccatcggctttaagctgcgagaaagcagggaagcgaatacgttttaaggctttctcgctaaacggcgtagcgaggcattgaggctgttctggaatgagtttcttccatacgcggttcggtaacgttgtacccgcaccacattccagatcgcggttaatgatacggcgaagaacttcgcgatcattctcgttcaccgatgatacgatatccagcagacgatcacgggctgcattgcccgtatattttcgcgttgccaaatcagacatcaaatccgcgatagcattcgatagcggggttgtgcctggcttaccgtccacctgcggaaacttcttaatgtgaaacataatctgtttcgtgtacgtaatgcggaaaatctcttttagcagatcattacctgcattacgtttcaggatcgcttccttctctgagattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatgacattcgtttaagtttaccgcaagatcatcaacgaagcaaaccagacgattaccatatttggctttcgcttccaggtagcggtgtactttggtttcaccatgcccgacaaccatcacttctttgaatgcggaagggaacagcgtgttcaggtttgcaatacggttaaggcttgctgtaggagtggttcccagcgccgtgacagccacgaaatcatatttggctttcagacggttgatcacaatcaacgcatcgtcatacgcgcttagatagcgaataaacgaactgttattgtattcttccatgaggattttagccagttggtgatcacacccaaagatttcggtcatatcacggaacttttcatccgtaaccatatccagcgcgatatcggtcggcatgttgtgtttagacaaaaagaacgggaggccgctttgccattttacggcgatcccgtcaatgtcggtaagaataactggtttcaagatttaacctcataacgatcaaagaaaagggtactcttaaacgcttcaatatccgcaaggaatttgtcacgctcgaatgtacgataataatcaaattcgatacacagcatatcatcgttcgtaacactgataccagtgatatcttgatgatatttctttgcctgttgtagaacgaaaggatcgagatccgaacagtcgaaataaattacgtaactcattatcaacccttgtacatataaacagcgtcgaagcctggaacatccatttcgactttatcgaacacaatatctttcagcttgcatttttcaacgtagctgttgatcacgttaatgttgttcgcgccgatggtaacgtaatacacacccgctttgtagataacacccataatcagggtagaactcaaagcaccctgtgcgtggagtaatgccagcgggttaatcgcgcctttgaacaggaacgcgcattctactctttcatcataatctttcatagtaactctcagtcaaaaaatagtgcgaatattaaccatataccgaagaaaggccagaataacacgatcagcgggaaaatggtatgttttaaaagcaaagtttttggtgtgtgatatccgttatgacttacaccaaagcaccaggaaaaacgtgcggcgcagtatacaccaacaacgaggtatagaatgataccgatgacaatcaaggctatcatagtagatcccgtaatcgggttaaatttcggacaaactcacgttcagtgagtaccgtttcattcatcttattctttcccattgaatgagtcaaggtactttttccggttgcagccagcgcacggcggaacccgtcattcaggaaaagagcattgtacgcgttttcaatcaggatttgatatgcttctgattcacggtgaattggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtgaacggatgcggggcgaagttgctcaatgcgcatgatggatactgactacctgatccgatgtccatcatcaccccacgaagttaacgagtaatgcagaaaccatacaacccagagcaaaaccaaaagcaatcaaagccagttcactattctgtttcattttcggcttccttcttcccttcctggcgagcgcgtttgcgtccagcacgtaccagagaatcatagtatggacgtttacgatcgatgttgtcagtgcggtatgctttaccgaaatgactcgttttgaatccgtaatacttcacgctttaacctcgtaaggcttatggagtccacgcgccggatcataacggtcatatgttgtcccgttggttgatgccatgatagagacatcctggcgacggttccagttcaacagagcaagaacgatacgatctgccgcttcaataaaatactttttcattagaaacctaccttccatactttttcgaatttgtcgaatattgcaccgatacttttcagatacgcggttgcgtcgtcttcggaatttgtgtacatcgcgaaggagtatcccccaaattcacgacacactgatagcggtttgatgctggtaatgttttggttatatacccgcatcttatcgatcattgcttcggtaatttgatgctcatgatattcgagaatatatttcatttgattgtatacccgtatttgttggtttctgcattcaatgcaatagccagcttattcagatccccaatatcaccctcaaggtctaaatcaatgctgtcaatcttcgcatcattataaagatcagtacccgcgtatgcatcaatttctacgattttcacgttgtgttctcgaatgagattcattgatgcttctgggatacgacgcatttcgaactgaaacgttcttacttcgataccttcacgcatcacgctctctccagacgggttgttacttcacggttatagatccgcgcatactggcgaatgtcttcgttatcgctggtgttcttcgcgatatatgcatcatcttcggtttcgaatgatgcggggttgcgatcgtcgtttgacagatacagtttaccgaagatatctttctttacagtctgtaccccaacaaacatcacaaaatctttttctgtgttaatggaactcatgattatttcccgaaaaggtggcggtcttgggggtttgcatcccattctttttcccagctactacgctcgcgatctttatagacaacctgaaccgatgcatttttaagttcttcgatctctttgtcgcggcgacgtaacgcggtgatcagttcgacaatgaggtgttttgcatagcgatcttcgctgttactcatgaaccccattactttctgttctaattctttggtactcatgttaagccctcaaaccaaagctacgttttttgatgacggtgacattatgaacacctctgttattgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcagtttcgtttcgatggggctatattctcacagcccccagattaggtcaacaactttttagaatttcgcctgaacgtcagagatatcgtcggcgtattctacttcaccgtttttgtgctcgatccggtaagagtagcccattcttttcatttccgcgtctgggtcagagaaagcgatttccttaacttctgcaaccacaacaccattatcaactactacgaaatgttttgctgcgtcgattgggtttaatttaatcattttctcgttccttttctctgtttcgtttcgatgtgtgtactttaccacactcacgattcagtgcaagcattattttgcataaaaacgaaaaaagccgccacctttcggcaacggcttgatttttaatacttttcttctggctggaacaccgcacgacacgcccacatagaggcttctttcagtcggtctttcgccttttggatttgatggatacgttcaagcatcgcatcgagttcttcggtagtgaatgaatcggtatctgataccgcgtaatcacttgaatactcttcatccagttctttgaagatttcgcccagggcaacttctgcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggacacacggatcgttaactgcgggtatttttctggatgcttcacagcatcttccagagtttcgcggcgcaacacgtttacgtttaagtgttgtccaccttccactttaacagtgggttgaaattcaatatcgacttcacgttttgcgaatggatcaacgcgagctttaccgatcactgaatccatttcgagggttttggataccaccacacgaacatcattaccttcttccaggtagattgtgccagtgtgtaaaccttctaaaatctgatatgctttcattgtattacctttctacgacataataacgcaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgtgatggatcggaaccaccttctgttttcgggttgcccttccaggcgaagtctgactgtgcttcacgccctaagacgtgataagcgaagttgtacgctttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacgaaaggagccagcagaatagccagaacaccagaaagaatatcaaggggaaccagtacaagccagcttgcgtattttaaaaagcgcatgtgcttctccagaaaaaaggctatccgaagatagcctgttgattaacgaactgctttgatatacttatacgcttctgcgaattcttcttccagagcttcgttgcagaacggaataccttctgctttaaatccaccagtgataaggtactggataaagaatacagaagaatccatagagatcaactgatggttcgtaggttcgatatcagttcgacgaacgatattgacgatcgaccagtcaaagaatcgtcgatgatattcgtgtttgctattcacctgcggtgatgcaaagaaaccatcaacagaatacgcatcgaacgctttacggtattcgttatcgaaatctgggatttcttcggtaaacagtttcatcaatttaccgttgatttctttttcagttgatgcagcgacgatttcgcgaatttttggggttaattcaaacagcttttgaagacctttcatatttttctcttttaaatttcatatgctgcgtctatacaagattgtattagtgcgtcgggcgaattctcgataattggtactgtttcaccacatacatctgctgcataaggatcgtcatcaacataacattcacggaattttaatttatatcggtagtcatttttacataaccccgctttccattcgttgaatgtcatgccgtaccgctctttgaattgcgctggcgtaatctctttgaacgtatggattgttttgcctaacttagagtcatacaccgtcttttcacgaattctcatatagatctcacattgtttagtgggctggaagtttctttacttcaccccgcattccggggaacctattaccggataccaacagagcctatcccgtgggatatggttgcatattccgaaccatttaacggcattgcgctacgcacccgaattggagcaggtgaagggactcgaaccctcaacaatctggatggaaaccagatattctaccaattgaactacacctgcaaattttttagaactgtttgcgatagatttcgcgaaccagcggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaattgatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttctgcaagcgtgaaatccattcatcattaccacgatcgtatttatcgagataatacaccgatgtaatcgccccgctagcaacataccattcgatatgtttcgcgcagttagggcaaggcgatgcagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacggcacgaccacctatcgcgataatagcacctacacgattcgaaatacattgagaacgttgactccgatcgattgctctcaacatattcattactttgaatttcattaacaatcatccatatatttcagaatgtctttgatgaaatcgttatcagggttaacgatgtgatacgtagtacctgaacgtgtcaccacttcaacaaacgatttgttcgccggaatcgcatattcaacaaccggacttgttgcaatgtcctgttgaggatcattatcaaccaacccaaacacacaaccataacgaagcatcgttggttcagtacataaccatgcctgatgaatctttctgattttgtcgctcataatactcccgcccatgctacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacatgggataccgttcattcgccacatcccgactggtgtatccctgtcgtccactgcaagaacaggataatacttatcgagaatcttttcaacaagtatttgctcttttacgtggaaatcgtgacgatgatcaccttcttcgcgcatgtagataccatcgctcaggtcaacatcgtatccgatcaggcttgcagcggtatcatgtgcgcactgtgcagtaccctcacgcccagacacaacaacacaggcataaccagcggccttatacatcctgaacagttcttgaacaggagggttaggcggatcgttgataaccttcgtgaagtcatacgggctacgttgtccaactttggttaatgtcccgtcaacgtcgaagataacgcatttcggtttgctcagatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagcgtgttccccagttgacgcgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatggattgccgtcataaggcatgacaaggtattttttaccgtcaatctctcggacttctgcaaccactttccatttcacattcaccggattcaccttagcggggagcgtaggcaaaatcttttctgggggcttctcagcacacccgaccaacagaacgcccagaacaagggctaatgttgaaattttcatttgtcgtactccgccatatactcttcgaaggacttgttgatcttgatttcgatcagtcctggtttcttgaacaacaggtctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagcgtgattgtcatgtacaaaagccctgctaacgaaccagcaactattacaggccatatccacgaacttatattaaacgtacccaatacgtttttgatattcatataacgcttcctcgtaagctattgatgcttgttcctcggtatcatagtaaccgatgtgtttttgcttcccgtctatctttatctgtgctcgatattttccacgcgaagccctgtaatcaacacctttggatttaaccgttttaggtgttgatttagcttttcttttcagcatattatgaagcggatctgattcctgtagattttctataccatccccagcttccaacccatgcttatgatcaataagcaaaggcagataaccattacagtaatagaaaattatgcgatgtcttaaatattttctatcgccgtgccgaattctcacgtaaggttttgatttgctcataatagaaccagcttcttttccctgattctgttttgctgcattgctattccaaaaaatttttccggtttctgggaaaacgtcaacgtaaagaagcagggaatcgatccctgctttctcttcttctaacgttgtgcttccagcgccaaagcactttgtcatttatattcttccggtataaactgttcgtagttcttcgccattaatgcaacgatgttatcaaccagcttttgcttatcggtatcatcgaaataacgcatcataggcccgaagatgatacgaccgtcaggggttaagtcagcgctcagggcgatcgcgtagtctttgcgtgattttcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgattacgtaaccctcgaaaccttctttcgtgtaggcttcggtaatgaatgcatccagatcggtgatttcgattttctcgcgctcaaccaggaacggacgtaatacaccatctgcgaagatatcctgataatcaacatattcgcccgtgtcgttattacggatgttcaggatcaccactgctggttcctgatagccaattacaatacggtttgtcggtgcgacgtattccatgttgacggtgaaaccatcgttaaccagttcggtcaggcggtcgaacaatgcgcggttagtctggatcacgctcatagcgtccatagcctgttcagattgaacggatgctttagacttaacgcccagatagccggaatcacagaaggtggagatcagggaaccatcttccttaatcatcacatccactacggtttcaccaatcgtcacaggagaggctttcagctcttcccatgcctttacctcggcatagttgaaaaacttctccatagggcgactggcgagttttacgggggtttccccatccatcgcaaacatgataccgcgacattccagcgcaccgggttttaaccagtcggaatagctcgccatgcgatagttaaagatgcgcacgttggtttgcatcacagttttttgatcaatgaagtagaagcattcgctttcgttacacagtttcatcaactggtcaaagagggttttctgatttttggttagctttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatattactggggtttgcttccctccagtatttcgaattgcggtatgtgtctaaccgcttccacaaatcacgacattttccaacatacactatccgaccgtcgatttcaataaaatacacacaatgccggaattcgccacatttaacgaaactccggtctatcctcttgtctgaacccagacgcaaaggaaatattacaccaaatgttacatcgtccattatatatccaacttattcacctttccggtcaacacattgacgcagtgagcaatataatcaccgtggcacggtagaggtttgcatgtacatcctaaccgcttcccgtccaatgctttcagttcgtcgattgtgatcacgccagttcgaatcaagttttggaaatacgggatgaacttcattatgttttcagcccgtgttcccttgtagaagggattgccgaatttcgtacctctctgaatatcgacatcccagctacctttatacttgtttacgacgcgacaatcaagcgtatttttgtcgccattttgcataggcttcgtcgctgatctcggtgttgaggttgccaaccaggtaagaactcacttctacttcctgtggggctacctgtacgttgtcagacttcaaccatttgttcatccacggatacgggttcggcgttggtttaaatggagactgcaagccaaccgcgcgcatacgctgatctgtcaggtgttcgatataagcgatcgtacttttcagggatacgccgtctacatcaccgatagagaacaggtgttcagcccattctttttcctgttcgtacacttccaggaaaatctttgtcgcttcttcttcatactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaacgtgaaggtaaacgacacgtagaagcggatcgcttccagagcgttgacagcgtgcatacacaggtatagagcaaccttacatttacgcatttgctctttgcgtttcttctcgtactctgcgatcgattcgtctgggtatccgtgggacgttaacatttcgattttgagcacgatgtttttcagttcatgacattctgcgatcaggtcatcgtagtattttgtcatggaagccgaacgtttcataatcgcttcgttgcgcagaattttatcgaactctttcgacgggtcgatgtgtaggttgcgctgaatgtgcgtataactgcggctatggattgtttcgctgaacgcccatgtttcgatccacgtttccattgagacatcggaagcgatagggaggaacgccaggttcgggccgcgtccctgaatggtatccagcagggtttgatattgcaggtttgaatcgaaaataaccttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtaaagcgttttgatgccgaaatagtttgcatacagcagatcttcaaggatgatttcagatttcactttaccatctgggaagttagccggatcatagttggtgtttgcagagatagcctgatcaacaaacttctgcataaccgctacgtgcgacagataacctttgtttccacgttttgccattgtccagagataatcatagaagtcaatctgattattctggtttggtactacctgattgaatgaaccttctttcgaagatttcacactcacagggccgcgcggaggttcaatcccgttggttgagttactcacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcatggaacagtccacatgcaccgcgttcctgtgcgagttccatcgaggcaaccagcaggttaaattgaaacgcttccatcaactcatgaacgtttccggcgtatgcttcggagtagtcgcaatagttgcttgccagccaggatgcatagttggtgataccaacgcccagagaacgacgctgtttggctttcagagccgctgcaacagggtagttctggtaatcaagcaagttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacaacacaggttcgacatacgaaccggaacagagaaactaccctgctggtttacgtgatgactgttgaaaatgtatttgcgtccggtctgtgcgcgttcctgaacaagcaactggaacagatctaccgctttaatacgtttcttgcgtaccgttgggtctttttccagactggtatacagttcttcgaactcactctgatccgcttgatagaatgcgtcatagaggcgatcattcgcaacgtcagggctgaacagggtgatgtaatcgttattgattaaacgcttatacatcaaatcgttaagctgtacgccatagtccaggtgacgaatacggttttcttcaacgccacggttatttttcagaaccagcaggttttcaacttcaagatgccagatcggataatacagggttgctgcaccaccacgaacaccaccctgtgaacaggatttaaccgccgtctgaatgtgtttccagaacgggataacgcctgtatggactgcttcaccaccacggatttttgaacccatagcgcgaatgtgtcctgcgttgacaccgatacccgcacgttgagagatatacttcacgatcgcggacgtaacagcgttcagagaacccagagaatcaccggattcgattacaacacaactggagaactgacgcgtaggagtacgcacacccgccataataggcgtaggtaatgacagtttacgatccgaaatcgcgttatagaagtcaacaacatgactgattttatcagcgtgtttttcgtcctgatgcagacacatcgcgatcagcatgaatgcatactgtggtgtttcgtagatgtcgccggacgtgcgatcctgcaacagatatttcccgatcaactgctgaacgccagcgtaagagaattcaaaatctttatcgtgattgatttttgattccagataatcaatctcagcaggagtccattttgtcaggatttctttatcgtattttccagcctcaaccagcttagtgatgtgttcgtagaacggaatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccaccagtccaaaccagatcgcccacttcatacccgcaaatatcagcgataatatgcgtcaggagagcgtaggaggcgatattgaacggcaaccctaagaagacatcaactgaacgctgataccattgtagagacagtttaccgttgattacgacgaactggaagaaacagtgacacggacgcaaagccatatcatccagatccatcgggttccaggcagaaacgatgatcccgcgatcgtctggtgtggttttcagttgttcgatgattttcttaatctggtcaacaccataataagaaccttccgcaccaaatgagcgccattgatgcccgtagatcggtcccagataaccatgcgtataacccagcgctttagcctgattttcgtagttatcgtcccagatcgtccgcttatcgctatcttcaccccacgtcattttacgcagtgtttccacgttggtagaaccttcgaggaaccattgtaattcatgcttacacggtttgaagaatagctgtttgctggtagtagctgggaaaccttctgcgaggttccaacgtgcttgcatcccgaagatgcgcagtgtaccaacaccagtacgatcggttgattcagtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaacgaaacatcacgtttaaaagctggtgcattatatacatgatgtccgtaaatgtgcgtcacaaccacttcatcaaccattgtattattgattgcttgcagaagcaaccacttaccaccaatgagacacacatcacgatctggatgcgtttctttcattacgtcgattgcagcagacaacccgccaccgtggatgacataatcagcggtattcccgttctttgttaccagacgttgaccggatgcagacagaacgcaatgaactcgccctggcaatttaccaggcagagaagtaaaagtgttcgcacccatgatcaggacgctatttgcggtttcttctttgaagttctgcaaatcctctttgcagtggccccacggtaaaccctgttcataaccaaacgcatagtccacttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaaaccgttaacatgagcgttgatgattttggattccagatcgaacaccatcacatctaacggactccattcaacagaatgaagtttttcgcgggttaacagggttgtgtgttttggtagtttcattggggtacagtttgccatagccattgttccattttacgtaaatcttcctctaacggagtgaaaccaaatgattcttcgatcacaccgtcttcccatacatcaatttccagaatttccgttaccggagggtttgacatcacatgatcacgacatgcagccatagcggtcataatggaatttgttactgtcagggtattgccctgaaccgatacctgaataatcatactttcacccattctttatctttagtccatgcggttttcaaggtaaaacgctggcggtaatgcatacccaaacttgggggatgcagcgaattgataccttcgacggcgatccgcattgcttcgaacttctcgcgatcaataaactgccctggtagaactggcattctcacacagtcccattcgtaagtatcgctgatctctttactggcattaaccagaatttcagcaatgtcaaaatctgtaggtgcgaaccatcccagattgataaacacgcgtttttgcgtaccttctttcaggttttcaaagtgcgcccatgttggacaactcatagtattttcctcataaaaaagggaactgcttttcaacagttcccattatagcataatcagttagtgtttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattcaacatgtttctgaccggagtgcataaagttaaagctgctgaaactccagaaacctttacggttgctgatctcgcgtttgaagtggaaagtcaaacccgcgccgttatcaaactcaccgtagttactgcggaatgttgcccccgcttgtttcagtgcgttgaaatagtcatctttattgatgcggttaacggtgcgtttcggtttctgttctggttccggcgctgctgcttgctgtgcggtacgtttaacaaaagatgctgaacgatgccccgctgcaaactctgcgttcatcctgtcgattactgctgcgattccgcttgcgtctggtttcactttctgcatttctttgaaagtgtcgatgatcatatccagacatgcaccgtcttcgtcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcgcggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtgtgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgcccaaccttagacatgatgatgtgtcggtcgaagtcctgcggatcaagatcctggtgactgattacaataacgttaccatctacagaatccagcaaggatttaatcgcgaatgaaccctctttatcaagtggcccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatgctcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagtgtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacatgccggacactcaccgcctttctgatacatcacctccagctttttaaactgttctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttcgggggttttcagttccatgaatggagtgtaacccgctgtacccagaacgataacctgtttgaagcccacaaggttgatgttcagcatagattcaagctgtgcctgataatcacctgctgcggagtcttccggcaacttctcgccgttcttccagatctcgaacaccttcggcttttgtccgcgcacaactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttttttgccgtatcaaattccagttcgatcggggtgttcccaaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattttccccgaaatattcatcataacggctatgcacttgacacctccgcgtatagttcgctgatcagcttattcacttcctctttttcatcgtcggtgatctgcatgttggcgatatactcagtgataaggccacgaacggttttgatttcaaagtcggtatcgacatccgaatctgtttgaactttgtctatgatattgatttcataggcaatttcttcaattttggtttggaactttgcaagcccctgatcaatttcactgacaatcagacgcaccgcgcagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcaatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttagatctggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatctaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcgcctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgctacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgattgcggtatacaaactgtatctggtgatgaaaaatcactttgcgggacggtatgacgcgatcaagtacaaatgggaaataaagatcactgaaaaagcgttcgaaaagagaagagataagtattttttcaaaaagttagccgaaaggtttacatttaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggcattcccctctcaacggtgtttcagtatagcgtcaaatcatcaacctcgtatatcagcaaactcgtacagtctggggtgatttcttatgaatcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtgacctgtccgtttggtggcgctaacttcaccctgaccgcgaagaaagtaggcgactggcctaactacgacgacagcaaatttggtgttcctggtccaatcaaaggtatcgaagacgaagcgcgtcagaaagaaatcttcgaaggtatgagcgatctgcgtccaatcactgcaccagaccagttcaaaccaacggcggaactgaccgcgaagttcaccaaagtattcggtggtgctgcaatgggtgctggcgcaagcgctggtgcggatctggattccgaactgaattcgtttgacaacgaactgaaaaacttcgataatggcaaccagtccaaaggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgatatcctgaaaaacttttcccagatcaacccgtctgtaatgctgaaaaagggttcgttcattatgacgaaatccatcaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaacttatcaaagcgtcacgcatgatgaaactgaccgacctgtctgttgagccaatcaacggcaagctggtaatcaccgcgaaaagtaaagaaagccagtcaaccttctctgtggaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggtatggcagaagcacagaagcacatgcgtagctttatcgaagcgtacagcaagaacgttactgttatcatcaccgcgaacaacatcaacgggattcaccctgcgctgatctcccgctgtccggtagtcaagttcggttctccgtcgaaggaagaacgcgttgaactgatgaagcaaatgatcaaacgctgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaatgtcactggctgcttttctcgatgaagatgaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgtcacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggtcattaatcaaaagcccttgcagaaatgcaggggctttgttatattggttgtacaccacttgtgaggactaaattatgaaaattcgtattgaagaaatcatcaaagctattgaatccggtgatcacttgatcaaccgtctgtatagcgaagacatcaaactgtctcttacttgcaatctctctgatctgcgcacctacgcatacgcgcgggatcacttccctaagttttatacccgcatcatggaagaatacactgtgctggttgaacaactaaatcggcctgacacccaacgctatcacaaattagcgcaacgctcgcttgatctgatcaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaagaagcaaaaaactggatgcagcgaatgaaagatgtaggcatggaagcgctaggcatggatgatttcaggctggcgtatatctccgatgcctacagaaaggaaattgaatacgatcgagacaagatccgcattgcttcacttgatatcgaagttaccgcgcctgaattccctgatccacgcgaagcaaaatacgctatcgacgcaatcacacactatgacagcgttgaagataaattctttgtgtacgatctggtcgagggcgggttagatgaatgggtagcgtcgaaagttgataccgaaaacgagatcagcgaagaagacttgaagaaaattgtttaccgttcattccagaccgaaaagtcgctgatgtctgcttatatcaaagactggaaagagcggacacctgttattgttacgggatggaactcaaacaagttcgatatcgcgtatatcattacccgttacttgaatatcttcgggcaaaacgttgttcgtcatttcagcccgttcgggaaagtgactgcgaagacaacgaccgaccatttcggtaacgaacaactgggctatgagatttacggcgttgctcaaatggacggaatggatctctataagaaattcagtttcaccccgcaaccgtcttacgctctgggcgcgatcgctgagttcgaaacaggtaaaaacaaagttgattacgaaggttcgctgtctgaacttcgtcaagcggatcaccagaaatacatcacgtataacatcgttgacgttatccgcgtgttggatatcgacgggaaacgcaactttatcgaactggttctgtctgtagcgtactacgcgaagatcaacttccctggggttatgtcaccgcttaaaacgtgggacgcaatcatttacaactctctgcgtgaagagaagaaagtaatcccagaaaacaaacgccatactaaaacgccgtatgatggtgcatacgttaaagatccggttgtcgctccataccgttacattgtatcgttcgacttaaccagtctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaaggcgtggaaaaaacgaatgatggcgggtgagcgaaatctcgaactgattaagcacgaactcgaacacctgacagacgcacacaaccaaatgatcaaccctgatttcgagttctacgaagatttcggtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagtgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaagtaagttcagggataacaaccattgggttgacttcctggataagttcagtaaagaacgcatggaacctatcattgataagggctaccgcgaactgtgcgagtacatgaataacgtcgaacacctgatgtttatggatcgtgaaatcatttctgggccacctctgggatcgaaaggtctgggtagtttctggacggcgaaaaaacgatatgcggctaacgtatgggactccgaaggaacccgttatgagaagcctaaattaaagatcatgggaatggaaacccagcgaagcagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaataatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgttcggtgatgactggtaagacctgacggggcagaaatgccccatttatataaatttgtgaggaaaatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggtccgtcaaaacactttaaatcgaatctggggctggtgacggttgcggcgtacctcaaagcgaatgaggatgctgtgtgtctgttctacgattcagagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactctattgagttctggaaacctctgttcactcaccagccattccttgatgccattcaggataagtaccgtattcctgacaaagagatcactgacggggcagcactcgaagatctttattctgacgatgaagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgacgaagcaatgcaggacgttattcaagaactgttgatcaacgatgaaaacgatgttgcacacttagtgtacatccataaggtgtattgggataacggcctgaaagtcgaatttagtacgccggacgaagacaaagaaaaactgattccgctggttcacgatgcaatctacgcgcagatcaagcctaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaattcctggcgttggggcaatccctgacatcatgacggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggggcggaacgtggtacactgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgtgccactggacgatatcgacaacgggaacatcacctatgcggactataagaaccgtatggaacgcctcaaacagtcgaaggtcgggcgtttaatcgttaagcaatacccaacagcaggggcgaacgctaaccactttaaagcgctgattaaagagcttaaattgaagaagggtttcgtacctgatgtgattattgttgactacctggggatctgtgcttctacccgtgtacgcggggcggaaaatacatacatcctggttaaagcgattgccgaagaacttcgtggtttggctgttgaaacaaataccgtaatgtggactggtgcgcagactacccgcgccgcgtgggatgcttctgatatcagcatgggcgacgttgccgaatctgctggtcttccggctaccgctgactttatgttagctgtgatcgagactgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaactgttgaagaagcacaaggtgctatggtaaaacaagctgagactaaccgaagcaataagttagccgaaattgcaaatagtacagacattcaattttaacggggcttcggcccctccaaaggtatagtgaaatgaaaaagattctcgttattgtattcctgatcctcctgtctctgaaactggcagcaatcggggttatggcaaatgcttcatggtggcttgtgtttgcacctctgatcgtgatcggtgtgattaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacgaaacggattaggagataccaaatgaacttactgaacaacccatacgacaaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaaattaagccccgaaaggggcttttttgtatctgtaggtattgcaatccttctcgaaaggtgataccttattctaaacaaacaaaggaggacatcatgaaacttgcaatcgcttttatcttactggttctaaacgcacttatgggctttccgttcccgtggttagtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaagaaccgaagttcgatagtccgtatcgttccgaatggatcgtatcggttgacgataaaggctatgtcgatatcatgcgctggcctaatattcatcctggctatctggacgaaggtatcaatgcggaaattctgggtatgcctgaacaggttgaagatcctgctggggtgtataagtggatttgtagcccgtgggaaacccgcgactgggaaagcaatattgttgatgactggggctttgatgtggtagaatctacccctctgttcttattaccggaaaaggtcaatggcgaagttaacgaaagcggaaaccaaacaacacaacaagataatggatctggtggagtctgacaaggcgctaacctacgacgaaaaattattcattatcgaaaacttccatgaaggtgcatttacgaataactctgaactgggcgcgttctttaccccgatcggacttgctcgcgatttcactattgatgcttgtaccagtggaagcgttgttgacctgtgtgcgggtattggtgggctatcgttcgcgatgcttcacatgatgatgtacgccaaaccgcgtgaaatcgtctgtgttgagttaaaccatacatactataagttgggtaagcgtatcgtaccggaagcgacctggattaacgcagacgcattaacgacggagtttgatactctgtttgatatggcgatcagcaatccacctttcgggaagataaagacatccaattttaagggtaagtatacgggcgcggaatttgaatacaaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgcggcattgataccggatactatctggaggaatggaaaggcgtgaaaccgatgtgtgaagttgtctgtatggaattccctgaaccggagccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtaatcaagaacccgaagacgaaggaagaactggaagcatattccccgttccatcgctctgtaagacacatcaaacgccgtttaaacgcggttccttatatgtctgggttcatgaaccttacaagcgcgtatgactcgctacggaaccgctggaacctgaccgagcaagaacatgaagagatcatgatgaacctcccagaacttcgcgaaagactcaacgaagaaatggttgcaggtgattcaggcggaagtgtggataatattgcttcgggtgtgactacaggcgcgatcacgaacaaagggccgaaggttctgggttctacacgtccgcataaacgcaaacgtaaaatcatgaagagtgaagaatgaaaccattaccgccattgaattatcggatctgggttactgcgaacaattacacctggtttcctatccgtatcaagtacatgagcgacacagcgatcgtgtacacgaacgaaagaaaaacatcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggggaattcagtatccattcccgttgtccgatttgtggcgactccatgaaggataagcacaaaaaacgtttctggatattcccgtcaaaacgaggcacacacatgatgtgtggttgttttaactgcaactacagcaagccgttttctgtgtttctgaaagactattacccggatgattacacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccgcgtttggtgatccctatctttgatgaaaagggtaaaatcgagtcattccagggacgtgccttacgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggttcttgacaatgaagcgagacaccctgatactactcaccgccttttaaaattgattgaggctggcgaaaaggttgtgttgtgggacaaatgcccgtggccgtcaaaagatatcaacgaaatgataaaaacggacggcgcaactaaacttgaaatcatgcagtatttgaaagagaatactgtttctggactcacggcgaaacttcggtttaagtcgtggaacaaatcaccgaaaaaatgagattgatatgactgataaaactcctgtgtttaatagctgtgcgcacctggttaaagccgatgatctggaaatggtagaaggtttctaccgcaatgcattacagaacggaattgacccgctgcaaaagatgctggacttgcaaaaccatgcacaacaaagcctgtctgataccctgaattgggttccacgtccgaacgaactgaaaacgtgcggtgagatcctggactggctgaaactgcaagatgatgcgatcgcagacgaaacccgcgaactttacaccgctctgggtggtatgtcacgcggtgcaaaagcggcttccggtgtctggaaaccgtggaaagcaaatcaccaggaactgcgtagccaggtattcgcagaaatgaaagaagaagacaaactggaaattctgttcgaactgattgaccagtggcacttcttcatgtgtaagttcctcgcactgggactggatgcggaaaccatctacaagctgtatgctctgaaacaggcggaaaacctgcgtcgttgggctaacaactactaatggaactcaccgcgctacatgccgtatttgctttgtcttatatcgtttgcgcggtgataacgtatctcttcggatggtgcgttttccacgttaacggtgttgacagaaaagccgctttgatagtattatcattgctatgggttataggttttttctacgtcatctatgaggggcgaaaatgattgacaaatactatatcattgttacgaaagacaaagacggctttactattccacacgttgaaaacgggaaaacgccggaactgtttgcaactccagcagaagcaaaggataagttagactttatccgcaagtgctacgaaagcaaactcaactacgtaccggacgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgtgatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgggctgtacgtgatggtaagatgctgaaaccgatgtctgtcggtgatctgggtgtgttccaacatgctaacgctgttgacttcctccgtcagtatttccgccgtgtcaaaacgccggatgacttgatagagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcaaatcttcaccgagattgtttataacaacaacgaaaaaatccgagtcttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcctacgttgcgagcacttataagcgcatcaagcagcaaacaggctataaagccccgtggcattcgttctgggcgattaaaaacaagttccaggatgttaagcctcttccggtttgcacgtaccacaaatcgcaggggagcacgtatgaccatgcgtacatgtacacgcgcgatgcgtatgcgttcgcagattacgatctgtgtaagcagttaatctatgtgggcgtaacccgcgcacgttacaccgttgattatgtataaggggctttgccccttttgaggttattatgaaattgactatccttgtaaaagacattccccgaattcttgaagcactcgataaaattcgagaaaaagatccacatgcggtcaatgtgttcgggatgtatagcgcagcagatccgcaagaagttattcaccgtttgcgcttcattgaaaaatctaacgatattctgtattctccgaacggaccaagttattcatggagtcctattgcaaaagaagtcgaactgacttatgatgaatatggcgttatcgtgctgatccttcgaatggcacgaaacattcgtgaagataaagacatatggacattaatatcatgaaaaaagatatatctatccagatcccacgcctccacgcggaagcgattgcagatctaattttcaaaacccctgttcaagaacttccgcatttcatcgatcgcgatgtgttggacgaattcacagaagctgttgaaaacgcgaaccgtctggaaaaggcaatttatcattccggtctgcgtcagttcggtatgatgactttgcaaagcaaagagtttgaaacttttgatatcaacccagaagttgcgcttacgctggcgtacttcatggaagagtataagcggagaacttcatgagtcatttacccgtagattacgtatgggattatgaaacggttggtccttccccgaatgggaaggtgatcgaactctcatacgttccatttgttgacgatccccacaacccgccaacgttcgcggaactggttgcacgggggcgcaagtacaaatttgatttgcgcaaccagcctgatcgtattgctgatcagggaacaattgcctggtggaaacaacaaagcgaagaagcccgtcaaatcctgaaaccgtcaccggaagacctggaactgtatgcaggacacagacaattctttgaagacctgaaagcggacggtgtgagccgttggcaatcactcgattatgttcgtggccctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtaggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgcaaaaccgttagcaatgcaagctatatccttccgggtatggttctgaaattgcctcaattagtagaattgtgataaaaagcccttgcattcgtgcaggggctttgttattttgtagggactgaaacaaaagaggatgaaacatgtttggtgatttgaaagaaggtttgaacattttaatcggattcgcgataattggtgtgattgcgtgtgtatccggcgcggtgtggttgtcttatcaggcgatcgtgtggttgggtgaatggcttcacattctggcacagtaaggggatattatgcgtttatgtttagttggtgtaggtttcggtcgtgcgttaactcaagggttaatcgactcaatccgctggattcaaccaagcgttgaactgtacgcaatgccgaaccggatcgaatactctgatccgacaccgtacaaaatgaaaccgtatcaagcgccacgcgttaaccgtgtgctacaccgtcaatctgtaaacaggggtaagtgatgaaagagcttacgatcgtcgcagcagttctgattttcatcatagtttcaatgattatcgtcagactgtaccagcacggggaagcgtttgaatggttcctggatcacgacaaagcgtttcgaaagcatttcgctggtgagttcatctttactcatgtaagcgtagcaagcggtacggtaacgtttgattttgacgggaaagggaaatcataccatgttgaactctcccttatggatgctaaacgcgtgtatgatgccacacaaaacggcggtatgcgaaagatgcttatacctctttcaaaataattttaatagcctcttgcaatgcaaggggcttttttgtatattgcgcacataccaaacggaggcaactatgacacgtattaacacaatcgatccttctcttcttctgaacgaacacctgattgcagaactgcgcgaactcccccgcattcccaatgccgttttatccggtaaggcaaaaatcaacctgtcaaaaatccctgctgtgtatacgctgggaaccggacacgtaaccttcttttacaataagctgggataccttcgcgatcgtcatgctgcattacgtgctgaataccttgcgcgtaacggtaaagaatacatggacggtgcatacgaagatttcgatcttagtccgttgtcaaactccctgtttcatcgtcatttgtgcgcggactggcaaccaacgccggaatcagtgaaaatcaatgttgagcgtatccgtgaacgtttcgaactgcgcaaacgtgcttatcggttcggtactgagatcatcaacgacgaagccgcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagccctggttaagaacggtttcaacgaaaacgacgcagtagcgatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgacatcaagcgcgaccctttgtttggtgtcctcctgtttggtgatagtttcaatctggggagaacttttatcgagcgggttattttcccgaaatggtatcaagggaaacgggtttaacaaatagcactttttgctaaagacttcacgggatagctttgatatagttatcccatcgaaacaaaacggaaggagagttatcatgatgcagaacggttctttaatcaaaggtcacggcaaattcctgattcagcagatcaacgacaacaaaggcatcatcgcctattgcgacgagaagatgaacagcgatatcgcagcatgggaaaagaaagagtatgcagcagtgaaaaaagccgcagaaaaatcccttgctaaagcagaagaaaatctggctaacctggagaactacgcatgaactacaaaactttcgtgattaccgtcaaaactaaaaatggtgaagactgcttcttgtatcaggcaaaagacgagaaagaagctaaagcaggtgtattgaagttcattaaacgcgatgcattgagcaatatttgcgaacaaccaaaataatgcttgcaatcctgaacgcataatagtatattacacacatcgaaacgaaacacacttaggagattttaccatgtatacttttgacgaactgaaagccgcagcacagcctttactggacgcgatgcacaaaggtcgtaacactggcatgtggttcagcgattacactgaaactgtgttcgttctggaaaaaggccgtaagtatcaccgtatcgtgcaggatacccgcaacaaagaaacgggtgaaatgttcaatcagcgttcagttgctggcttcatcgacaatgacggaaatatcttgaaagccgctggctggaaagcacctgctaagggtattcgtggtaacatcttcaacaacccagagaacgcgatcgaccggagtggatacgttcgctatcttcgctaaaatcggggcttcgtcccctttggaaattaaaatgaaactatcagcaaccgccagttggtcaatcttcggactgatagccgcaggggttttattcttcgcatggcaatcaagagatccgaacaaagcggcgtatgaagccgcacaacgagtagtagaacaggatgcagaagcacaacacgaagcaatgctacaacagcgtcgtgatatgggctttgtggagactgtgagttacacaaacgcttttggtgatgtcactacgcgctctgtaaacgtcttagggcgcacgaaagggacaatgctcaccatcagacgggaaggaaccggaaagctcgtagacgtgtgtttcagtgcgattacggacgattccaaacgcgaactattcgccccgtatttttctacgcctgtatatgctaaatttgacggcggagaaacaaaagagtttagcgcaagcagaggaagtaccgaagatttcctgtgtattacttccccgcaacgcttccttttcaatatggatcgtgctagtgttatgcaagtccagttagtattcctggatcattactccaaagtgccagaagtgcatgaatggaacctgaaaacatataatgaggttgtgaataaatgagcagacgcccaaagaacagcaaaaccgaaatgtttgcaacgtttgatgtaaacggaaagagcattgagggtaaaccatgcacgaactcaaagtttatgcatatcgccggattgcctggtatgagtgttaaaacttcttactgttgtcactacaacgaagaaaccacctctgtttatttgggcgaagaactcatggctgaacgcgtcatgcaatgtgtgcatttccctggcgaacgtccagaagtgaactgttttattgttggttatcataaaggtattgtaaatgagcaagtataaaattggtgatatgtacgccccgaaatctattttaatggctgtgtgtcaaatggcatcagaagccgatccgattcgtcgtatgtatgatgcgttgcgtaagaacccgatggacttcaattcaccacgccggatcagtatggtgtatgaagaaacagggattctttatcttgaaggtattcccgttcctatcaagttcaacgatatgaaagggcttttcaatccggtatgggttgcaccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgcgttggatgtgatttacctgaaactgggtactacccacgggacaacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtacacgggttgtgttggtgatgaagacgatctctatgagtatcttgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatctgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaattcccgaagatgtccagcatcgcgagccgtgacgaaccgaaagattgtgattgcgggggcgaggcgaaacgaacggttgataagccgcagatggtgaaagacggtttcccgtacaacaagtaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgcttgagcgatcgcgatcacattcgcaaacgtccgaacatgtacgtgggttcagtgaacaaagaagcccatgaacgttttatcatgggtaaattccgcaaagtggaatacgttgaagggttggtgaaaatcatcaacgaaatcctggataactccatcgacgaagcgatccgaactgatttcaaatttgcgaacaaaatcgaagtcaagattgatcacaatctggttactatttcggacaacgggcgcggtattccacaagatgacgtgagaacgccagaagggaagattgttcctaaacctgttgcagcctggacaatggctaaatccggttctaacttcgatgacgaaaaccgtgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctattttcggtgtggacggtatcgacgaagagacaaaggaagtcatcaaagatcgccttatggcgcttgcagtggctttccctgccgttaaattcacatataacggtgatatcctcccgaacaaattcgcgatgtatggcgcgatgtacggtgataaaacgattacccagacaaacaacaaaatcagtttcatcctggcgagcacagaagacggtttcaaacagaaatccttcgttaacggattggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagccgcagccattaccaaagcgaagaagaaagcgaaaaaggcgaaggttgcaaaacatgttccggcatcagggatcgacactgacggggtagaaaccactttgtttctgaccgagggcgattccgctgtagggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgatgggggcgatattctcaccctactgattgcgttctttagtcgctggcctgagttgttcgagaagaaaaagatccgttatatccgcacaccgattatcattgcgaaagtcggtaaagatgaaaaatggttctactcccttgaagatttcgcaccgttccgcgataaagcgaaagaggtacgatatatcaaagggctgggttctttacgcaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgttacattaaatgtaagctgtctccgctgttcaaggctatctacatggatgaagatttgacaatcccgcatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacgctggatctgaaatacccgcatttcaaaggcgacattgaaaacggtacgatgtacggcaagtacgaactccagggtaaaaccaaactggtgatcacagagattccggtcaagtatgatcgcgtgaaatatatctctattctggataagctggaagaaaaagggtatatcgtaagctataaggatctatcgaaagaagatttccgctacgagatcaccctcaaacgcgagtatgcaaacgggcttacccctgagaagatcctgaaagatttcggattgattgagaactcaaacccaaacatcaacgttatctttaacgggaaactgcattcatacgagcgtcctgaaacgttgctgaaagacttcgttgatatccgtattggtgtttaccaacagcgtattgataaacgcatccaggagactaaggaagcgttagataaagcgctggcgaaggttgacttcatcgaccagatgatcgcacagcctgacgcattgaaggggcttagtcgcagcgaagcggttaaacttgtctctacgtggacgggttgcgagaaccacgccgaaatcctggttgcgatgaacatctatcatctaaccacggatgaacgtcaaaagctggaagacgaagcgaacgaactgcgtaagcaactgaaatactgggaagaaacgaccccgaaaactgaatatctcaatgatttgaaagaactttcgaagaaattgaaataatttacaaaaagcctcttgcattgcgggaggcttttttgttatagtgtcctcactgattggggaggatataaaatgttcaaaactcgtagcgatatggaaataaccatctgggccaaaagcatcatggcgaagcatggcttatctcattggtctttcaaaattaacggacgtttcaagcgtactctgggacaatgcaattacagtcgcaagtcaattgaattaagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgtaaaagccgtatccgtgagaaatcagtgattcgggaaagcaaaaaggatatgtatgctttgttcctgaaaactccgaacggcgaagtttatcagtgcaatatgcctgaaaagatgtacaatgagatccaggaaggtaaacgcaaccttgcgaacatctacatttcaggaaacaaaagagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgaatatgggcttgatcaaaagcctgtgaaatattcatgcgataacatcatctttaacaccaagtgagatataaacaatgaaattgcgtcagttagcaccacaaaccattcacactacgggcttcgataaaggcgaacgcacgaagtttaaaatggctaccagtgcgaaaacatacaaaatcatgtcatcaaccatttacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctatttcgaatccaccaaaaccgacaccgacgaactgatcggggcgctgggactgggtagtaaatccccgttctgctacaccgaaacattcactatcgaatccatccaggacggcgttaaacgtgcgtacacggcttatatggataatggtgaacctttcgttgaccaaatctacgaaaccgaaacagacgaacctaacggcgttcaaatcaccgttccggttaaagtcgaagatatcgcagaatgggaacgtgaagcggcgcgtgtttatgaaccgtttacgggtatccgtccgcgctttatcggtgttcaggttgatgtaaactggcaaccgaaagaagcagacgatcgcgggatcatccgttataagtccatcaactattcaggcgtatacgcgcgtatgggtaacatttgttatccaatcgatctggatatgttcgaaaactcgctgttctactgctaccgtaacagcaattacgcatatattctggatttccctctgggatcgctggacttcatgccgtcgcgtgaagagttgagccttgataaagtcacgaagaaagtgattacggatcgactggataaaatcaacaaacgctttgatgaagagttgatggaacagtataaaaagcagaagacaacccgcgataaactcgtatggttcaataatctgcctagcttgttacagacattcgtaacccgtgataaccgtttccgtgtgggtaaagaatcgctggctgaaattctgacgcgtatcaaaagccctgatacagcaaccggaaaatatgtgtggggcttctgggctaacccatatgacgggaaagattgcgtattcgaacgtgtgggttctggtcgccgttatgagaagtataaagcggaaaccaccaaacgccaggacgttatgcgcatgatccaaccgtggcgacagaagaaactgttcatcgttgaaaatgataacgaagcgcgttcactccgcccgtatctgatcggttactgcatgatgaacggttcggatcgtatcagtttcgtaactgccgatcgtaaaagtgactctgtgcgtcagttgattgaaactggctatttcgatgaatctgagatcgttacactgaaaaccagtgaattgaccaaagaattcgaaacgtacaccgaagatcgcaatcgctggaaagcaacgcgtgaatcatcttctggtgattctgaaccacgtccgaaaacgcctacggcatatcattacttccttgatgatcagggtaacttacagaaaaacgatctgttcctgacaaaagcacagttcgtgaaactggatgaaatgtacgctatgcgcctctacgggattgatgaatatagccgactggacggagaagcaccgaactatacactgggtagcatcgccagcagtatgatgaccctgttgaaagttaccggactgaaaggcgtgatggttctgcgaaactccctgtggagccgcattcctgatagcaacatgaaatgtcttgatgactatctggtacagcgttttgccgacgcggtgaaaaagatgaagcctaactggtatccagcctggatttcgtctaaacatggtagcgaggttcgaacccttcgcgattatctggaggtgactcttgatcgcatggtgaaaaaccgctataatccagaattgtatttgttgcttgattatcttgatggtaagtttacctacgatactatcgagaacaaaaacaaatcgaaaaatgtggtgcgcaatccgttacttcgtgaaatgtcggtgaagcattacaaaatgctgaaagatatgaaagaacgtgttgataccgcctttgatttgtttgaagaacgcaaccctgcattggtgtatgtgttgcgcaattcgtcttactctttaggccgtaccatgattacggacgataagatcaagacgaacctgattaaccttatacggtggaaataatgagaaacgttaagatccttgatgatgtacaaaagaaagctgtctatgagggctttctgaccagcgcgaacaaaaccgcactggctaaacaatttggtgtaagcgtccgaaccatcgggcgcgttattaccgaacaacattctaagtataatacggaagcatcgaaaccacttccacaaacagatgtcaaatctaaaatgattggttctgaatcgttcattactctggtactggacggcaagatcatcacagcggattcgtcacaccctaacttcgaaaaagcacatgctttaatggttaagggcgacatcgagggagttgctaccctgttggacacaacgcaagcgttgaagatttacagcaaaggcaacattaaaatcatcgggcataaagtcctgtacaaagatatcgtgtttgacagcggtatcacacaacgtatcgttcgcgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataattcccctggtgttgtggttgaaatgccacgtaaccaggtagacgagaataaaaaccgaacctgttcatgcggtttgcatgttgccgcaaaatcgtacctgcctcactatggcggaggacgcgggaaagttattcaggtcaaggttaatcctcgcgatgttgtagcaatcccgacagattacgacaacgctaagatgcgtgtatgccgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccattaaaaccgccaaagaactctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctctttggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgcgcatgatcagaagcaggtcgaacaggtagcagcagaccgcaaagcagcggaagaagaacatcagcgtaagctggctgaactggctaccaaagaaagcgatcacaccgcaagcgcaacccgcgccggacgtatcgcggataagatccgcaaactgctggattaattcgaggggcgaaagccccttaaatatttctttttgaggggctttaaatgaacaatctggtagcaaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacgggcattatgtgaacggatgcaacaacaccccagaacaggatcacgctgtcaatatcgttaacctcatgttagggccgcgtacagacgacaacctgaaatgggcgagcgaatccaacgttcctcatgagtatgtcgggatgtattatcagtgcaacgttgacgataaagcgccactgataccggaaaaacagattgatttagtagttcgaacaggtttcttcttatgagttcacaaattctgttcagcaaagaagatccattaggcacagattcatcggtgcaacgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaaagcccttgacttcggttgagggcttttgctatattggccttgtcgaaacgaaaccactaaggagattcaccatgactaacctgactaaagttaccgcgacatacttcatttcttctggcgctaaaaacgctatgtacactctgcgtgtagagcgtcgtggaggtggattcacttctgataactatatctgcaacctgtctactgacccagataaagcggaagcgaaagcgcgtgaatacttcgatcgcatggtggatcgtctgaaccagaccgatactttccagatggtgttccagggcttcgcagatttcgatctgttcgaacgtcgcggcaaactgtctgtacaagataccgaaaatctggaactgctggaacaaggcatcatgccgatcggtaagcgtaaaggtgaagtgattgctgatatgccgatgtatacgattctgtggtgggctgatcagtgcaaagaaaacggcaacgatagcccagtatttcaggctatttgctcttactgcatgggcgtagcgctggagaaggattacatcgctaaacgtgaagagatccgcgcagaatgggaagcagagcgccaggcgaagatcgcagcagcgcagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacctaaacttcacaacgaatacaaagaagttaaacaaacaatcgttcagcgagtaaaggtattataatgacatacgaagaaatgcttaatgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataaccacgacgaacttgacctgatcttagtcatagataatcacccactgggtgttcgtccatacatctatcacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaagcccgatgacgaaagtaaaagatttcatcaatcgggctttgagtagtttgaaactgaaattatcatcgaatcctgcctaaaattctagcggcctgattgcacacgatcattaacttcgtatcggcgacttcgggcttctgtatataccattccattagaattgatcctgaatagtagttttcgagattgaagtaaggacaactaaaggtatatgctaccggaacaaggtcttttgttggaagatacgggctggcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatctccatcgtcggcacgtctataacgcttgaagatgttttccagactgaaaataagtcatcccacttataccatgttacgaacataatgaaaatagtgacgataagaaccaatttaatgaataactgtttccatgttttgaccgccatgatgaacgatattacccgttcaagcaccgccaatttatcttgtaatagcgccatatttaatcctcaagttcggggatgccgaccccgaacatatttaggaatttacttaacgttgagtgaccagaccggatcgtgtttggcctacacgggcgttcaaatagtcataccacgcgttatgttgggcagaagcaatctgatattggcgatatccatcctgtatacgaccgttattgtcaaagtcaaacacaccgccgtcatccatcgtaagtcttaggttaacagcaggaccgttttgaatggtaattacgctaatctcattgctgaattgtgcagaaacacaagtaccgaatgcgttgccgttaaaactaccaccaactgcgccgtgaccggaaggtttcgaatatggtgaataccaaccaaccccccactgaccacgataacgggcgttgttatagtaacgctcatacaccgtaaagttgatgttatatacggattgtcccgccattcgagacatataaaacggtgttccgattcgaaccgcgttacccgcagcagacatccaccgttgccctgtttctgtgaccgcagacgaaccgatccagccaggaactcctacaatagccataaaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggcaataccttctcaacgtcctgagcgatcagaccggattcgcgatggtatacgatatcatcagcatcttttgattgcttatcgtagatataacctttaagctgttcaatcttgcttaatgaatctttcaattcaaccaaattagatttcagtcgaatatcggaacgaatatacacatcgttggcgtttacgttaccttcaacatacagaccacggttcatatacagatccgaagtacgcaactgtaaggtcgtattcagtcggtagttgtgtaccgatacgttatcatcagcaccaccaaacccgaagtatgcgccgctgttacctgccaaagtaatcagcaaataacacgattggttagtcgctgtgttattcagaagtaatgctggcccgttaacaccctgaacctgtaactgtttatagttagcagttgcaccagtagtccatcgcataatacgctggctatttgcataggcgttgagaataccgtcaccttcctgtttgaaacctgtatcgttatcacccagagaaataccagtcgtacccaatccgtttggcgtaccacaaccaataccgtttgtttcgaccgttccgttgaagtttaccgcgttgccaaagttaacagaaccgttaatgttcgcgccgtttcctatagaaacaataccagtagtcaagctgatagtaatcgggcgtaaactgttccatgttccataaggatcgccggagttggtgatcaaggtatagtagttaccaccatcatttcggtgtattaccccgtagtttccttgtaccgcgcggaactgtccaccagaaccagacgtagcgctttgaacttcgttacggaatcgagcataacccgcagtagaaatctgcaattcttcctgtccgtctgtagaacctgttgccagtctccacacaccaccctgaacagtttcatgccagattgtgtccgcgttaccgcctcggaactgacgcaaatagtttttcccgccctgtccaacagtaggcaagaaatattgcgctggcgtaccctggggaacatcattataatatgatggaacgtttacgttaaaacctaatttggtgttaatatacgttacaccagtaccacggaaataatggttatatcgtccgttgctgtctttatagcctaagtgggtaacaccatcaccaaccccgtttccatcaccgtttgtagttactcgaagtattgcagtgtttgctccttgagtagcataatcagtttcaacggaagcacggttattgaatatacccataccgttaaacgtagcctgtccaggaacggttagatggttagcgagaactaaagttccatcagaagcaaaacgagttgcatacgcaccaccaccagtacgaacataaacgttcttccctgtatcaacgtagaccaaacccagttcattacctccagcatcctggaaatataagtttctgtttccatcgcctttgatagacatttgcgtaccaaagatcgtaccgcttacaacagtttgcatcccgatgttgaattgcgtccctgttaaactaacaagaccattatcacccagcatttgcaattcagcgcgaatggtcccagcagcaccagttgtcgtgtttggtgcgccaaaagcacggatataataagcaccacccacccgcagggcgttgggtacaaatcagatcaacaaggtttgcccccaagtttggatctgacgttggtgacgcggtttttgaatgtataacaaatgtgcgtgtttctgcgctaggaaacccgtttgttactgggttattgtctgtgcgagttgcaacgagataaggttctgttgccctaaccattgcgatcctgtatggtaatttcaattcagttgcagaaccttgtaattccaaagttccttgcattgtatcaccagctttcttcacctgtgcatcgtttgttacgttgcctaatccgatttctgcctttgttggcttatcgttttcggtgtagactttaaagcctttatatgtgattgtgtttccagaagggagtaaaggcaaattagcctgactccagatagtattaccgccaacggtagtacccgcttttaaatctgccattattaagatcctcaaatgcttttatgatatttataaaaagaaaaagccccgaagggcttttaattagcgggatttgagttccctgacttcctcgcggagttctttaatcgcgttgacaagcaaggcaataacagcagaagacgaaacagttaagatctcgttctgttcaccatcaacgcctttcttaacagcttccggtaatacttcttgcagttgttgtgcgactaaaccagcctcacgggtagtttcttcacccccgatatgatttgctttgtcgtacaccataccatcaagtaaatcaactttatccaatgcattttcaatcttactgaaattacttttcagtctttcatcagaacgaatatacacatcgttaaagctaccattaccgttcattatcatttgaatgccggatgaagggttgcgttcaaaataaaccagatatgacgatgaatccgacagttctatacggtttccgcgagtagcatcaccagcatggaagatatacatatcgcgagggtttgcaccactgcgaataaattcaacgcgtccgttgccgctaccgtttaatgttaaatttccattgtcaatataactgcttgactggctgatacgtccgttgactgataacgtatgtcccatcgagacattaccagtatcattatttatatacaaaggacgtaggttattataacttccccatgcatcacctgagtttgttaacatgaaataggtgttaccaccgtcatttcggataaagaatccacggttattgtatgcaatacgcaatccgttggctgagttggaaataatatcaccataagatacaaactcaccagagttatcaaaataccattgacgatctaccgatccagtacggtaatggactgtaaacctgttggtgtttaccaacgtacccatagaccacgcaccgccagcctgagaataatattgcttaataataggccagtattcagatgtcgatgtagtgttaatattctggaaaatcggagcttttgcagtgctttgagaagcccaagaacctctaccttcccccgatgcatcaaaataaccgcctgtttggttgatggttcctgttaccgtgcctcctgtatttttcaagaacagtgcatcgatccatcctgaaaacccgcttttgttgatatacacgttcc

SEQ ID NO: 140 - DNA, 178321 bp, Unknown
  source: /note="Description of Unknown: KP2-5-1 Bacteriophage Sequence"
caaagggaacgctgtagagttgttcctgaaacgaaaagtacacttgattcatgggtgtaactgttattgcaacatgggcgcgggtattgctaaagaagtgaagcacaaaatccctggtgcgttcaaaattgatgcactgactatgaaaggcgatcagcggaagttaggcactaactccatctacatgacggaagaaggtcagattgtcttcaatgcatacactcagtttaaattctggggtactggcccacaagtggattatgatgcaatccggtcatgctttgtgagcgcagtagaacgcgccagggcgtttcctgagaaattgcctatcattacccctcttatcggtgcggggcttgctgggggcgattggctgcgtattagcgccattattgacgagtgtacgggagattacccgatcatcgtcgttcacttcgatccatcggttgatccacgtaaggcggatttatcatgattgatcctatcaaagcaggtcgggcgatcaagaaagcgaacaaacggatcgccgcaatcaaaggacaacgcgccgcactggtgaaaacctgtgaagcgctggcgcagtccatgaaagcgaacaaaatcaacatcacacagcgtaaaacggtggttgacattctttgtcttgttgatgaaggactggataaagaaatgggcgaactgaaaagcaaaatcaacatgtggtatcttgatatccataaagcacaagatagcgaaatgggcggttataatcatgactgacaaaatcaaagctaaagcaatgaaggtgattgcgacatacggaacactccgttggtgtaacgcgcaggtgtgcgggtgtatgggttgtgcaaatcataccatgacgaaagaagagtatgatattgctatccagatgccggaaatcaaagagcatcttgcgcgacgtaacaaaaaactcatgggtaacgggtggtttacaattggctaacgcacacattatagaaaaagttcgttgtcgggattgtcatttccctttgatttgcgtcatgaacattgacaaacccccttacgacgagtgggattggtggatatactgttcaaacaaaacatgcaaaaaccatgaaggtgagggtaaattccagaatcatattaagtttgtggagcgtgtcaatggctaaactgtattatcactatgcatccatgaacgctggaaagagtgcgcgactattgacggacgcgcacaattacaaagaacgcggtatgcgtgttgtaatctataagccagcaatcgacacccgcacatcaaacacagtgagttcgcgtatcgggctgaacgaaaagtgtgaattgattgcgcctgatatggatctgttctgggacattcagcgccggaataaaattgcttgcatcttcgttgacgaggcgcaattcctttcgaagaaaaacgttttcgatctgtgtcgcgttgttgatgaactcgaaatccctgtaatggcttacggtctgcgtactgatttccagttgaatctgttcgagggttcttactggttgctggcctgggcagacgagatccgagaactgcggggaatgtgtcactgtgggcgtaaagcaactacggttgcacgtatcgacgcacaaggcaacttcgtaaccgaaggggagcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcttctatcgaacagatcgaagagacaaaagcattttcacagtattatgcacagcacggggaaagtcctgatggtattcgttggtactcaaccaactggaaacacaaatcaggttgcgcatatatccgattcgataaaaacctgaatcgtgacggtaacaaagctcatggtgatatctccgcgatgctttcgatcgcagtcaaaaagattgattcgaaagtacgcgctaaaatgcgtcaggagttacgccggatgaaagctggcgtgattggatgggatgaaaatatcgagaacgcaaataagatccgcgcttttgagcgtagcttatgctggtatgagataacttgatgtatttttagactaattttacataaggggcgaatcgccccttttttgctataaatatatacaggaacggatctattgttgatccgtgtgtacgtagagaaatgtttatgaacattaaacgcatatcacaagcgatgatgtttggattgttaatcttgtctcctgcatcacatgctgatcgaaatactgtcgtcccgaaagagttcgactattacatcaatgcagcgctacaggtctatcttgacacaatccctcccagtgtaaataccagtgaattgttctataactatatggaacgaaaatggcagcaaaaacaatgccgcactgaaccagaatgtaaacacctgggctatagggtggcaaacgaatttgctactattcatcgttcgtaagggatgaaagatgcaaacatttaacgaagtaacagatcgtgataactcaagcaaagtagatgcctttatcggtatgtgtctgatgtctgtaacatacatgcatagcgcacactttgcgaccggatcgtattctcaacataaagcgtttgagagtttttacgaagatatgcaggatttggttgataaattcaccgaaattcatattggtatcactggtcgatataaacccgtattaaaaacagaaaatgtgcttgacacggtggtgtatctccgtaaaatagcaaccgaagccgacacaatctatgattcagtagatagttcattgaagaacattctggacgagatcaaaggcttgtgctatcaaacgatttacaagctgacaaaactttcttaaaaagagtttgacacgcgaaaaagtgatgatagaataactatcgaattgaaacataaacccaatggaaataatgatgaacttaaacactatcgtaaacaacccaaagaaaaccactctgatcgctctgggcgtaatcgctgcactgtggctggttccgaactcgtacactatcgttcaggatggtacggtaaaaactcaaaccttcatgggtaaagtttcaccgaagcctgttctgcctggcttccacctggtaaacccactggctgatttcgaggtattcaacaccaaagacatcgcaatgaagtttgacaaattgcaggttccgtcccaggataaattcaaatccactgtggatatgaccgtgatgttgcagttcgatggtaacaaagccccgatcaaccgtatcaacgcgggtaatcaggatcaggcgcttgataagtacgtgaccgaaaaacttctgtctaccgtccgtgagttcggtaaatctgtaccgaaagcacaggatctgtataacgcagaagttcaaagccagctacagatcgcaattcagcaggaagttgaagagtatgcccgtccttacggttacaccgtgaaacaggtattcttgcaggacatcgacctgccggaagcgattaagaaacaggttgaaaacacgaaaattcgtgaagaacaggtgaacgcagaaaaagcagaactggcacgtaaagagcaaatcgctcaacaggcagttgttcaggcaattgccgataaagaagcccgtagcaatgctgcacaggctaacgagcgtgatgctgatgcccgtctgtatgcggctaagaaagaagccgaagcgaacgccgtgttgcagcgtaccattacaccagaaatgattcgctggaaagaacttgacgttcagatgaaacgcgcagagaaataccagggcggtgttccacataccgtaatgggtgcgggttacgatggacaagtgattttcgattctcgtaaataaggttttaaagcccccactctgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcgaagaagcaaagatcgtttacatccttctgggttcagcatatgcttaccctaacgttttaaaccctctgacagcgcgtgagcgtcaaacgatgatcttctcatggttaaacgctaacttcccgatcgaagatgttgttcgtgttcagtttgaacatattccagattatctttacaacgaagagaaatggaaaacctctgttcgtactgctatcagggaaaccaaaggcgacaaaatcgctatctacggttacgaaaaagatgcgggttcatactggcttaaagcgttcggatggacacacgtacctgttgatcctgttcaggttgacggcaaggatctatcagcaaccgatctgcgtccgattatcttcaaccacaaaaacggatgggataagaaactgttgcgctttgttcctcaagcaaccgtcgattatatcgacaaatggatgatggaagacacgttctggcgtttattctacgaatatgagaaatgggaaagcgaattggagaaattcaaaaactacccataccccgacgcgctgaactgctgcacgggtgatagtgtggttgtgtgtaacaatcacctgctggtaattcgtcgtaagttcgcaccaggtaaagacgcgttagcccttcctggtggacacaaaaacgcaaatgaaacgttcctggattgtgcaatccgcgaactgctcgaagaggtacgaatcaaggttcctgaaaaggttattcgtggttcaatccgtaattcgatgctgttcgatcatccgaaacgttccgtatacttctcaaaaccgactgtggcgcagtacatcaagttagaacctaacaatgatggaagtctgccccgtattatgggcggttctgacgatgcgttagacgcgttctggatgcctatgcacgaagtcaaacaaaatcgtggtgagttcttcgatgaccactatcagattatcgtagcgtttacgggactctgataaaagatgaaaaaagcccttgcgttcgcgtgagggcttttgttatattaggggcatcgaaacgaaggaggtaattatgagcaagaaatcagaagtagccgaaatcagaaaactcgatgatggtaaaatcgcggtacgttggaaaggcaatcgcaagttcaatgtgattgaagatcccgaagtcgctgctttcctggtgttcatgattacccagaaagatacattcgttcctgatccaaacaatataaggctggctgattgatgaaacacccttactgtttagtaacccgtcctatctgcgcgggtggtttacctgtcaactgctggcagttgattcaaacaggtgacgcgttcctgaataagcgcggtgataaagtgttcgtctatggcgtggattccatcgaaaatgaaacgatggtgatcaccgacgagaaaacaaaagaaaaatatacgttgacttctgatcacgattgccgtaactttaacgtgtactggaaatctaatgaagactttgaaggaattaaatcatgaaagtagcaacccttagcgggatcactgatgtaaaatgtcgtatggcgctggaacctggtaatcgtgttcacattgcgatgtcgggtattccgggtcaaatgcaattcacgctgcaatctgttgcccgtgataagaacgatatggtttacgtgttcgtcactgaaccatcacgatacaaaacaagttcaacgctgatcctgaaaatgggaaccgctgatccagcaatgttgattgcgggaaccgtagaatctgtccgagtgacacaaatcctgttgaaaggcgcggaatgtaccccagacggtaacggcaaactgtcctatgaagggactaaacgccaaagtgttgatcgtcctgttgtagttggtgacatcttcacgtcagaacgccgtgaataccacgttgaatacatcgcacaagatggttctctggtttgtcgcatgtactcccgtaagagcgcagacgataacaaatacatgggattgactatcattgatggacgtgatgcgatcctgctggattccctgaatgttaaaattaagtttgcatactcatgattcacacaattagcgttattatgggtgatgtcgtaaacatcaacggacacgattactacgtagcggaaatcaatacaaagggtaatcgtgagatcctggaactggacatcgtaaggccgtccgaagggcaatcccttacaatcgaagtagttcataacacgaacacaggggaagacgtagtgaagccagttctggcacgtcttccggtgttctactgtgaaaagtcaaaacgttggaaaatgaaatgatagatttaactgatgtgaaagtgggtgataccctttttgatcctggtattcgtcgatacagtcatcacaacaccccacgaccgcgcaccctgcatgtgatcaaggttgcccgtcaatatctgtatgcgtcggaagatccgaatattaccgatatcaaagatttccgtgttgagcgactggatcgaaaaactggtagcgctaatgactggaataaccatacacagggttatcacagcgaagacgaatacaaagaacatttgtaccgtgtcgaacttactgataaaatcaaagacgcgttcggtcgtggacatgtaacgcgtgtaccaaatatcactaccgctgaactgcgcggtatcgcaaaaaccctgggggttgaattttgaaaactgtaatggaaaccgtgttcggttctcacctgtacggactgaacacaccgacaagcgacaaagactataaagggatctttctcccgcacccgcgcgatattctcctggggaaagccccgaagactattgacaccagcacaggcgataaaagctctaaaaacaccgtagacgacgttgaccgtcagttgtatagtctgactaagttcattagtcttgcgtgtgatggtgataccgtagcgctcgatatgcttcacgcttcggatgacaagctgatcgctaactctgaaatctggcagtatatccgcgctaaccgctggcgtttttacaccactgaactaactggcttgttcggttatgttcgtaagcaagccgcgaaatatggcgtgaagggttcccgactggctgcactgcgcgaagttgtcgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgtaagtctgtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaagctggcggcgtaccgttcgcaaccgtacaggaaaaactggaagaagtcatgggtgaagtcgaacgccttgcagcgatttcaacatatccgaaagaagttgatcgcgaattctggaacgatttcatcgaacgcgtatacagcgatcatgttgtggggtattacaaatgatgtatcctaaattgtccggcgctgaaattgatgttctgtataaactttacggatacgcaactaaagtgctagacttagatttcgatgacgtacccagcaaatcagggcgtgatgccctgattcaaaaaggttacgctcgaagggtaacgggttatcacgataattcgaaagcatggttgctgattaccccactggggattgacgcataccgacacggtattaaaacggagtggcactaatgactgatgttattttgaacgttaaagatgttgtactgggcgataccaaaaacccagacgcggttacactggaacaggctgttgttcagatcatgcgcgatagcctccgactggaagttactgaacgtaccgaaagcaattacacgggcgggattgatggtcgccagttgtacgaagatagcaaacacgttaatgtaaccctatgggcggacattgatgaaaactcatacaaaattgacgagattgattttgacgtatgaaaataattgacctctgcgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtaccggatcatgatatcctgctggcggggttcccgtgtcaggcgttcagtaaagccggattgaaactgggattcgatgatgtacgcggtacggtgttcttcgaaatcctccgcattatacacgctaaaaagccccgtgtgctgttttttgagaacgtgcctgaactgctaacccatgacaaggggaagacgttcagaacgatttacgggcttctggaggccgaaggatacaacgtattctatcaacgcctgaacacaaaggatttcggactaccacaaagacgggaacgcgtgtttattgtctgcttcctggatgatgtattcttttcatttcctgttcccccgcgtacacctacacgcgtaggcgacatcctcgaagatgctgatgattcattcaccctctcagataacgcatggaaaggctttagagagcgtaaggaacgaaataaggcaaacggtaagggtttcggttatcaggccgtcacaagcgattctgcgcacactgggacgataacagcgcagtattacaaagacggtgttcaatgtctggtattgcaggacgggaagaaccccagacgattaaccccgcgtgaatgtttccgcttgcagggcttcccagattcgtttattattccatcgagtaagaaacaggcatacaaacaagcgggtaactccgtttctgtccctgtcatcgaggcgatagccaaacaaatcaaaaaggttctgtcatgacaaatgattacagaaaacgcgcgggtattgctgaacaagagaatgcccgattgcgtgaagaactcaaccgccgtccaaaatatgaatggtttgttgaacaagttcgaaaggcattgaaacaagcagacaccgtgcctccacaaaggttgatcccacaaatacgacaactgaaagaagcatccgaacaaaggaaaaagaatatgagaaatcaacccgatatcccgatcgataccgttgttgaatggcattacaaccactgggataatgatgaatggtctgccagccagggcgtattgaagtaccagaaaggcaacttcatcctgatcgaactcgaaggtaagccaaccgtgctggacggtaaagatttggtaatgcgtccgtacaaagaaagaccggaaacaaaattcttcaaaaaagtgtttgcatccggtagttgatagtggtatcgtagctttaccgaaacaaaggagacacaaaatggctaacatgactaaagcgttattccagaagaaagtaaaagcggttaaagaacttgggttcactccggctttgatgactaatggcaaaactctgatcattcgcttcgtgaatgcttacgatgaagttgtgtgggaaaccgtttgtgtcgcctcttgttatgacgttttgaacagacaagagaagaaatatcttgcatggtttaacgaagtgtaatatattggccttgttgaaacgaaactgaaaaggaacataccatgacttttaatgacctgtttaacggatgtactggcgctggtgcgaaattcaatctcctgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgctttcgcagagtctatccgtggtgtgttcggacactgattaatcaagccccgaaaggggcttttttcgtgaggaagttattatgatctatactgttgaatgtcttgttgattgtgagcctggtaatctgatttgcgcatcggatactattctggactgtatcgacgcagtgaacaatcacgaaaccttcccgtatgttgccgatgatctcgaattcatcgcatggaaagacggtaagaaagttgcggttgctgtattggtggggaacagagtaggcgatacaataggcgctaacggttatgaaccgaaccctgtgacctacgaagaagttattggtaaaatggtgatcgaatgaaaaataaaaacgccgaacgcggggagaataccaacgaaatgttcttcattcgttgcaatcgtaagcccctcaaacgcgggtatgacgacatcgacgaagccctgagcaagtttaacgaaatcatccgttcatccgtctaccgtagcggggaacatcctggcgacctgtgggaactggtagcaaaagatccttacagtaacatcgtcctgaaatccgaaacaaagggtaaagtatcatgaaaatttatactgttgaaagtttaagcgaagattactatacatttagtgatttggtcggttctaccgtatcgctggaacgtgcgattgaaatggctaaaccttttgactgggtgagtatcactgaatgcgacggctttactggcgaacgtctgcgcatagtaacactgagcaacgaaaaagccattgcgaacgcaaccaaagaaaacttacaatttgaggatgtaaaatgaaaatccgttctggttttgtgagcaatagttcatcaagtagtttcatcgtccggttcccgaaagatccgactaatatcgacaacctgcgcgaaatgatgggcgattgcgtccctgattgtggttactacgatccgccgttgacagcggaagaagtggtcaatcacgttcatcgtgacttaggcggtcatctgggtaatagctttgaatcgttctacgacgataagcgctatgactgggaaaccgaagaaaacgcggaaacccgctaccgttcaaaccctcaaatcgcgcttgcgtatgacgggcgagactggtacgatctggacacagaagagaaagacgctctgatcaaaatgtggttgtatgaagaatacaacacgaagttcggcaatcaggacggcgtgtttatctttgaattcacgtactccgatgaatgcggcccgatcggaactcaactggaacatggaaacatcttccgtaaccttgaacacacatcaaagagtcatcactgatggataataaactgaaaacagaagtttgtgttgttatgcctcgctatgcattaggggagtcgatcccctttagccaggatcgccccgcaccgtttgatgtattttctttgcgaaaatatcttgaacgatttgaactgaacgagtatactctccaaatcgttcgggtatggaatccggtaatgtatgcgcttgcgtttgacgttgctgaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaatcacaaatatcgaattcaaaaacgctgtatcgaagccaaccccgacaaaccacgttttcgtgtgtgacgtatccggttcaatgtacaacgaactgcctaagatccgtaaacacctgaaagcaaacctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctacgggttgtactggctttgttgagccgttgaatctggctgcggaaatcgctaccgatctgcaatctgaaaacggcaacctgaacagcctgatcttcctgacagacggttatgataactgctggcgtaccgatgatattctgaaagcgtgtgcggttctgccactgactttcaacagtatcgcgttcctggaatacggttattatgtaaaccgtcctctgctggaaaaaatggcagaagcaaccaacgcattgcacaaattcgttgaaggtttcgacgcatacgaaccagcatttaacgaaatcatcaccgcgcagacttccgcgcgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgttcactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtccgaacatttccatcaacacggatctggaagggtatgtgactatcccagaaagcaaacagaaagaattcggtctgccggaaaaagtcgaaactaagcaggtgcgtaacttcaccatcgttaaagatggtatcgtgaacgttaaagttctgccgctggaaaccgatattccgacactgaaaaaccttcgtgcttctggcctgactatcaagccgctggaaaaaatcggtgatgatcgtatgtcggttctggtagactttacctctctgcctctggttaaccgtggcatgactcgcgggttaagcggtaaagagttcgtgactgataacgtgcgtctggaaatcctgaaaggccgtcagaaggttatgaagttcttccgtgacaacgcgatcggactgcgcaacgcagaagggctgaaacagcgctttggtgaggctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaaacgtgacgaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcccatgcatggttcgcggatctggacttcgaagaaaccaaagtttctatcgctgcaaaagatattcttccgaaagaagataatattccatccgatttctggaaagtctgggaaaccacatcattcgaatgtgaaatcgtcctggaagaaaaagaagtcaaaatctaacaatgaccgcccccgaaagggggcatattgaggaaaataatatgtcacgtaacgtattctggggtgaagttgtaaaaggcgatatcctgtatctgtccgaaccacaagcctatcgtgaaaacaacgaaaagaaccacgcatacgcgcctatgctgccggatttcgtggttgttgatgatgtatttgtcggtgaaaatggctggcagatcgatttagtcggattcccatacaaaaagggtgcaatccttctcgaactggaagatcatcatttcttcgcccatgttggcaacatcgaagatcatggtgatttcgatatcgaagatatccgcgaaaaaccgtatgtattcagcaactactacaaggtcggcggacacctgcgtagtgataacaaaactgttctgtatctggatggtattctgtctgggatgcataatttcagcattgagaagccaggcaacagcgcagaactctaccgcttgtttggaaagtacgatcgccagaatggtaaactgttaccgtcagaaatggcttatatcatcaatcgtctgatcatgggacttcacaaaacattcctggttcactatgatggtgatgtagaacaggcgatgactactgtgattgacatcctgaaagcaaaatctcgtgaaatggataccctgccaaaatgacattattcttcatcattgcgttaggtgtgtttattctgggcgctacgattacattcatggcgttcgataaacgcgaatatcaactggctatcatcgggcttatagtagcttgtatcccgctggtgttgtcatacaacctgtatcatgagaaaatcgcagataacgcgaaatacgaggcaaggcgatgaagatccgttctgggttcgtgagcaatagctcaagcagtagtttcattatcgggataggacttgtccgccctggtaaagaacaggaagttgcaaagatttacggtgagtcaaacattgaatcgctgatggatatgatcaccgaaattcatcatcgtccgcgctggggtgttcctcaagtacatgatgacggtacaatcacactggaagcgttcggatgtaatagcgtcgaaataacccgcatctgggacaagctgaaagaactgaatctggatgatgttaaaatcgttcacttcaatgagtgcggcgacgaaccggaatacgacgaggaaaccggaagttataactatgactggtatgacgacgcggacgcattcgggccggaactcgaaaagaaatacaatctcctgagagataaccgcgaactgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatgcttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttgcctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatgttcgggcaatcatcgaccggatcgaccgttatgaagtagggaattacacggaacaaaccagacgcactacatacggaaagattacgagtatgctggaacaaaccaaacaattcgacggagccaacatcgaattgattgatgatctgctaaaaaggatcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaaccgatcttgatgcaacatgtaaagcattgaattctatagggattaatttcactctctataataaattcagttaatccaaaaaagcccttgcgttcgcgtgagggctttgttatattacacatatcgaaacggaacagccaaaaggaacgagaacatgaaagctaaaatggtgaagttcgtaaaagactggagaaaaggcgcagtaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctggatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcgggggtcgtgaagtcgaatgtggtaatttcatgcaagcacttgcgcagttcattgatactgcgatcactcagattgaaaaacagggctgcatcgaacgccgttacgcgaacaagatcggaatgattgaatattccaacttctgcttcgaagtcgaagaagtgcgttacgacactatggacgaagtatatgaatatgtgcttcgtggtgaggaagtgattaagtcctacaacgggacgaaggttatcaataaccgctctttcatcaccccgttcgaattgcgatatcaacagctaatgggctggatcgtgatggaataagaaaagcccctttcggggctttttgttatgaggatgatagctggagtttgattctttctacttcttccggttcatcaatgatgctgtagtaaatcgtcacggtgattgcgttttcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgctcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggtaactcttcctttccggtgcggtgtggttcgactgaaatcttgatctcattgccgtacagcttttcttcgtattcatccaccatgatatgatgacgattgagcacaaacttaatcagttccccgcattcagggcatttgatttggagatctacagtctctttgttgatactgtcgaacagagccataatgtaaacataatcgcgctgatgcttgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaacaggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggatacattcaaggaataattgttcactgttgttacgatgtttcgggaatttgaatcccagagtaagcgaatcatcaagggcatattcattttgcaaaacgtaatcagttacatgcatgaatgcttctgattgtccgctgcttcctttgattcggatcttgattgcgttcttaccgaacgatacacaatacaccttagtgaaaatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgcaccttcgataagtgattgtttgaatccgtcccaaccttctttatctgcttcaacaagccagcctgttttataagcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgagacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacaccaacgatgctcaaccccatattatacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatctattaaagtatcgcggatactcccgatcgtgctgtcgagaatgcgtgatgctggactggttgcgaatacaacactaaacaagttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccgaacgtggaatgagggaaccgcaaactgtcgcctgtctggaagtcacgaataaaccacacaggaggcgatttaataacttcaacgttcgatacgaagtcaacaatctgatccccgatgctgccgttgaaatcgcttgctgtcgtctggtttgttgatggtgcaaaaacgtttgcaaccttcgaagcgctggaattatacgcttgtttaaccagtccggctaattctgctggagtaccgcccgaagtagtaccataacccagcaccgtgaacaggtaatagattttaatcagttccagcaggtcataacggctttcgataacgaatgtattgtaatacatctttgtgcgcttatcagagccttgaaacgctgctttagtaccgatgtcgattgcttccctacggtctgccagaataccaccagaaacggattctacagcgccccagataacgtttgataccgcacgggataaacctttagcaacaatactatcggttgcatcctgataacggtgtgagttcacttcgttatcgttcaggcttcgcggtaaaagtatttgacaaatggggttaagtgtacccatagtacgggtattcaaaacctgtttgtatcgaacgttcccagtgttagcactaaggatctgttgcgcgttctgtgctgcctgacgtaatgagcggtagttgtctttactgcctggtgcaagtccacccgtgaaatcatatgctgtgaacagcaagccgttattatacaggcttgatgcattataagcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttgtactgaatgctgaaccgtgttgtttactgttttgttgttgacctgaacgctgttaggcgttgtaggctgaacaggggctttcactgcttccggttgcttgtcaatacttgcactcgtttccggtactgtggtgatcttttcctgccagcgggagatcatatcacgatagcggtctttgtcgtcctcattcagcttgttcgaattgtttttctcttcaagcgattctatgagtttttccattacctttttatcgttgcccgtcagattgtctttgttcaggatttcatcaccctgatcgaattcattatccgctttaggtttcgctttcgcttgcgcggcttcgatctgtttggtttcgtccacgcgcttacggttagcggtattctctttatcaacctcagcctgtaacagtgcggggttttcctgcaatgctttcagttctttcttcttctcttcggtgatcttttcttcaatagccacacgatcgcgcatctgttccaattgcttagacaatgctttctgtgcgtctgtttgctgtccgaaactatatgagaatgcgccctgggtagccttaacctgttcgacaaccttagaacgtgcctcaaccactttatcattctgatcctggatctcctgctgtttcagcagaatcagatcatcgggatcaatttcaagaccgtatttttgtttgtcgcgcagtgctgatactttcattccgcgtccggcgttggtaatcgtttcagatccggtatattcacccagagcgtaaatcagattaccgataccttccgtgattgcggttttgatggtatcgcccagaaccttaaacggttcaaggaacaagtttttcagcgattcgcccaaattactcatatcgaagttttgcagaccttcgttgattttctcagcaagggttttgatattcccgaagtatgaaccaaacaaatctttcgaggcttcaccctctgcaagaatatcctggaaccacttctgaacaaccttactcagtacgtcgatcgcaaatacgatactaccgataatcagagtccattttgcaaacttcgccagcgcttcgagagaataaccgataaagcgagccagaagaccggatgtattatccttgattgcacccagcaaagacaatactttcttgctgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgctgatcctgttcgtattgttcctggaagccagcgaatttctctttgaaacgatcctcaaaggatttcacactgtctttgatgtccagtgtattcagcgcggtttcaagggtgttatcattgatatcctttaactcacgcattgaatctttatctaacgttgcctggatcttacgaacagtcggttgcgcctgtggttttggtggattctgcatccggcgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgccttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgataacccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagaaaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataacgatatgaagttgatcacgccgcatatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcacgaaaggtgaatacattacccataaggataacactaccctgttaggggatgcaagtttctttagtttctcgatgacggataaaaaactgtatagtgatatccttgcgagtaccgatattgaaaacgcatggatcaccatgaacagaaacgcggtatatgagaacaacttccagaacccagacaaacagggtcaaccgttccaggctgtgaagtgtcagacgttatccagctatgaaaaacgtattcggtttgatatcaatcagggtcgaatggatgttaaagtgggggcattgattgaggtgttaggggatgaatattcagggaagtatctgatcgttgaatgtatccgcgatgtatcaaaagatttccacctgcaaacattggaatgtgtacaggtggcagcggctacgaatgacaccagcaaaaccagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcgaacagttcatcttcggtgtaatccttgtttttgtccagatcgagaatgacgcattgccaggtgtcttcatcactggtttgctgcatcatcaccagcgcggcgtttttgaaccccagattatgagcaagcatttcatgaacgaattcgcgatcgtcgtcttcataacggatttcttgcccttcccaacggatcaggcggatagttttacttggttctgatttcataatttattcctgctcatgatttcacgcaaacgcttcgtcggttctggtggattcttaatgatttcctgaatctgattccagacttcttccgaaacttctttcctttccatgataacaatattcgggttatcacagcattttccaaccataacacaacgcccacaattaaggcagattgtgtccggtatcgttggagcattatcaaggaagcgaccgaaatcaatatctttcagcgcttccgcaacccgtgcttcaacggcttctttactcatatcaaccatttttcgcctcgttcatccaatcgcggaatttccacaatttgttctgtgctgcgatgtagctttcttcacggaaattagaagcgcaatagattagagtcgggaactgaacttcgttattgcttggcttctcgtcaaacacatacacctgaatgttgttgcgagttaaacgcggtgcgttcatgccagcaatcagagccagaaaatccgctttcttagttaagtgagccattgacataatcttttcctctttccgtgttgtttcgatgtgggtaatgtatcactacactacccaggaagcaagcattattttcatttttcttctttgaagcaaagttctacttcaacgttgactaaacagattgcgatatcccatgaatctgcaactgggtcatatactgctttgtcttcgtctgcaacaggcagagcaacaacccaaccatcaacaacacgtttaacccgaagtctttcgaataatgctaccgcttcgcccaaagactcaccaccattcgccagcttttcaaaacgcgcacggtctgccaggttgattactttgccttcgagttctttagtgatttgcatgggatgttccttttgtctgtttcgtttcgatgtgtgtaatatacaaaaagcccctcacatatgcaaggggcttctttagcaaaaagtgctatttaaaacagatcagcgaagataacgtgaatgtcatccggttcggtcttatcgcgtcgaatcttcttgatgattggcaggaagaaactgaactcaggttcgcccttcttacgcgttttcgatttctggagtccgtcaacttccatttcgacgatagcgccgatatagtcatctttgttcgccataatgtattcgcgatccagttcaccacgttcttctaacgggatgtacacgcggttaataccgtcttcatcgtatcggtagtccgtatcagtcagaccggaacctgtgttcgttctggcttctcctgataagtcctcaaccacaaacccgccaaccttatgaggttctttggtgtgttcgtacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcatagttctgcaccaggatagaagggatcagcttaaccgatgttacaccagagccagccagcgcaccttccagtatagagaaacgatcgcaatatggttgaacactcggagcatcgccatagtatacttcatacggtacgatatcccagacaacataaacgatattgcgctgttcttcgtcgctgatagtgcctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgttcgaaggaacgacagcagttttttcagcagggacataaatcagttctccatcaagtacaacatcataacccagataatcacgaatctttttcagatccttgtccagattcaccaaaccttcatactcatttcccgcgcgggttgctttgcggatctgattctctaacagatcggacatacaacgcgcaccatcggctttaagctgcgagaaagcagggaagcgaatacgttttaaggctttctcgctaaacggcgtagcgaggcattgaggctgttctggaatgagtttcttccatacgcggttcggtaacgttgtacccgcaccacattccagatcgcggttaatgatacggcgaagaacttcgcgatcattctcgttcaccgatgatacgatatccagcagacgatcacgggctgcattgcccgtatattttcgcgttgccaaatcagacatcaaatccgcgatagcattcgatagcggggttgtgcctggcttaccgtccacctgcggaaacttcttaatgtgaaacataatctgtttcgtgtacgtaatgcggaaaatctcttttagcagatcattacctgcattacgtttcaggatcgcttccttctctgagattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatgacattcgtttaagtttaccgcaagatcatcaacgaagcaaaccagacgattaccatatttggctttcgcttccaggtagcggtgtactttggtttcaccatgcccgacaaccatcacttctttgaatgcggaagggaacagcgtgttcaggtttgcaatacggttaaggcttgctgtaggagtggttcccagcgccgtgacagccacgaaatcatatttggctttcagacggttgatcacaatcaacgcatcgtcatacgcgcttagatagcgaataaacgaactgttattgtattcttccatgaggattttagccagttggtgatcacacccaaagatttcggtcatatcacggaacttttcatccgtaaccatatccagcgcgatatcggtcggcatgttgtgtttagacaaaaagaacgggaggccgctttgccattttacggcgatcccgtcaatgtcggtaagaataactggtttcaagatttaacctcataacgatcaaagaaaagggtactcttaaacgcttcaatatccgcaaggaatttgtcacgctcgaatgtacgataataatcaaattcgatacacagcatatcatcgttcgtaacactgataccagtgatatcttgatgatatttctttgcctgttgtagaacgaaaggatcgagatccgaacagtcgaaataaattacgtaactcattatcaacccttgtacatataaacagcgtcgaagcctggaacatccatttcgactttatcgaacacaatatctttcagcttgcatttttcaacgtagctgttgatcacgttaatgttgttcgcgccgatggtaacgtaatacacacccgctttgtagataacacccataatcagggtagaactcaaagcaccctgtgcgtggagtaatgccagcgggttaatcgcgcctttgaacaggaacgcgcattctactctttcatcataatctttcatagtaactctcagtcaaaaaatagtgcgaatattaaccatataccgaagaaaggccagaataacacgatcagcgggaaaatggtatgttttaaaagcaaagtttttggtgtgtgatatccgttatgacttacaccaaagcaccaggaaaaacgtgcggcgcagtatacaccaacaacgaggtatagaatgataccgatgacaatcaaggctatcatagtagatcccgtaatcgggttaaatttcggacaaactcacgttcagtgagtaccgtttcattcatcttattctttcccattgaatgagtcaaggtactttttccggttgcagccagcgcacggcggaacccgtcattcaggaaaagagcattgtacgcgttttcaatcaggatttgatatgcttctgattcacggtgaattggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtgaacggatgcggggcgaagttgctcaatgcgcatgatggatactgactacctgatccgatgtccatcatcaccccacgaagttaacgagtaatgcagaaaccatacaacccagagcaaaaccaaaagcaatcaaagccagttcactattctgtttcattttcggcttccttcttcccttcctggcgagcgcgtttgcgtccagcacgtaccagagaatcatagtatggacgtttacgatcgatgttgtcagtgcggtatgctttaccgaaatgactcgttttgaatccgtaatacttcacgctttaacctcgtaaggcttatggagtccacgcgccggatcataacggtcatatgttgtcccgttggttgatgccatgatagagacatcctggcgacggttccagttcaacagagcaagaacgatacgatctgccgcttcaataaaatactttttcattagaaacctaccttccatactttttcgaatttgtcgaatattgcaccgatacttttcagatacgcggttgcgtcgtcttcggaatttgtgtacatcgcgaaggagtatcccccaaattcacgacacactgatagcggtttgatgctggtaatgttttggttatatacccgcatcttatcgatcattgcttcggtaatttgatgctcatgatattcgagaatatatttcatttgattgtatacccgtatttgttggtttctgcattcaatgcaatagccagcttattcagatccccaatatcaccctcaaggtctaaatcaatgctgtcaatcttcgcatcattataaagatcagtacccgcgtatgcatcaatttctacgattttcacgttgtgttctcgaatgagattcattgatgcttctgggatacgacgcatttcgaactgaaacgttcttacttcgataccttcacgcatcacgctctctccagacgggttgttacttcacggttatagatccgcgcatactggcgaatgtcttcgttatcgctggtgttcttcgcgatatatgcatcatcttcggtttcgaatgatgcggggttgcgatcgtcgtttgacagatacagtttaccgaagatatctttctttacagtctgtaccccaacaaacatcacaaaatctttttctgtgttaatggaactcatgattatttcccgaaaaggtggcggtcttgggggtttgcatcccattctttttcccagctactacgctcgcgatctttatagacaacctgaaccgatgcatttttaagttcttcgatctctttgtcgcggcgacgtaacgcggtgatcagttcgacaatgaggtgttttgcatagcgatcttcgctgttactcatgaaccccattactttctgttctaattctttggtactcatgttaagccctcaaaccaaagctacgttttttgatgacggtgacattatgaacacctctgttattgcaagtgctggttttcagagtttctgctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcagtttcgtttcgatggggctatattctcacagcccccagattaggtcaacaactttttagaatttcgcctgaacgtcagagatatcgtcggcgtattctacttcaccgtttttgtgctcgatccggtaagagtagcccattcttttcatttccgcgtctgggtcagagaaagcgatttccttaacttctgcaaccacaacaccattatcaactactacgaaatgttttgctgcgtcgattgggtttaatttaatcattttctcgttccttttctctgtttcgtttcgatgtgtgtactttaccacactcacgattcagtgcaagcattattttgcataaaaacgaaaaaagccgctacctttcggcaacggcttgatttttaatacttttcttctggctggaacaccgcacgacacgcccacatagaggcttctttcagtcggtctttcgccttttggatttgatggatacgttcaagcatcgcatcgagttcttcggtagtgaatgaatcggtatctgataccgcgtaatcacttgaatactcttcatccagttctttgaagatttcacccagggcaacttctgcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggacacacggatcgttaactgcgggtatttttctggatgcttcacagcatcttccagagtttcacggcgcaacacgtttacgtttaagtgttgtccaccttccactttaacagtgggttgaaattcaatatcgacttcacgttttgcgaatggagcaacgcgagctttaccgatcactgaatccatttcgagggttttggataccaccacacgaacatcattaccttcttccaggtagattgtgccagtgtgtaaaccttctaaaatctgatatgctttcattgtattacctttctacgacataataacgcaacgggttgatatggaacgccagcattgcacgatccagcccgttagggtcagttacttcctgtttcagtttccacccgcaatacacgcgtaagcagaactgaacctttccgactttaagccacggtttgaagacataaagcccccatgccgaatcattccacatcaacagataaccgtgacgcgaaggatcggaaccaccttctgttttcgggttgcccttccaggcgaagtctgactgtgcttcacgccctaagacgtgataagcgaagttgtacgccttgttacgccacaaccagcctacacgttgcgcatacacacccagatcgcctaagtgataccggatgttagcccaacgccggatatgtccaccatcaccatcgatcgggttgtcgaatgtttccatccaacggaaccctttaggtaagtgtccggtttcttcactatagaacggaaccacgaaaggagccagcagaatagccagaacaccagaaagaatatcaaggggaaccagtacaagccagcttgcgtattttaaaaagcgcatgtgcttctccagaaaaaaggctatccgaagatagcctgttgattaacgaactgctttgatatacttatacgcttctgcgaattcttcgtacagagcttcgttacagaacggaataccttctgctttaaatccaccagtaataagatactggatgaagaataccgaagcatccatagaaaccaactgatgattagtaggttcaatatcagttcgacgaacgatattcacgatagaccagtcgaataaacggtgactgtgttcacgcttgctattcacctgcggcgatgcaaagaaaccatcaacagaatacgcatcgaacgctttacggaattcgttatcgaaatctgggatttcctcggtaaacagtttcatcactttaccgttgatttcctgttcatttgatgaagcgatgatttcgcgaattttcggggttaattcaaacagcttttgaagacctttcatatttttctcttttaaatttcgtatgctgcatctatgcaagattgtattagtgcgtcgggcgaattctcgataattggtgcaatttcaccacatacatctgctgcataaggatcgtcatcaacataacattcacggaattttaatttatatcggtagtcatttttacataaccccgctttccattcgttgaatgtcatgccgtaccgctctttgaattgcgctggcgtaatctctttgaacgtatggattgttttgcctaacttagagtcatacaccgtcttttcacgaattctcatatagatctcacattgtttagtgggctggaagtttctttacttcaccccgcattccggggaacctattaccggataccaacagagcctatcccgtgggatatggttgcatattccgaaccatttaacggcattgcgctacgcacccgaattggagcaggtgaagggactcgaaccctcaacaatctggatggaaaccagatattctaccaattgaactacacctgcaaattttttagaactgtttgcgatagatttcgcgaaccagcggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaattgatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacgcagccatatttctgcaagcgtgaaatccattcatcattaccacgatcgtatttatcgagataatacaccgatgtaatcgccccgctagcaacataccattcgatatgtttcgcgcagttagggcaaggcgatgcagttgtgtaaagtgctgcgtctttgagtataacacctcttgtgtgcgcactcaatagcgctttcatttctgcatgaatttcgttatcgtttgaccatgctgaatgttcaggacgatcaaccgatttcagtttaccgtcatcattcaccatatgattgttgcatgagttgcaacgacaatcaaggtcaaccgtattattttcgccccacgcgacggcacgaccaccaatcgcgataatagcacctacacgattcgaaatacattgagaacgttgactccgatcgattgctctcagcatattcattactttgaatttcattaacggtcatccatatatttcagaatgtctttgatgaaatcgttatcagggttgacgatgtgatacgtagtacctgaacgtgtcaccacttcaacaaacgatttgttcgccggaatcgcgtattcaacaaccggacttgttgcaatgtcctgttgaggatcgttatcaaccaacccaaacacacaaccataacgaagcatcgttggttcagtacagaaccatgcctgatgaatctttctgattttgtcgctcataatacccccgcccatgttacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacacgggataccgttcattcgccacatcccgactggtgtatccctgtcgtccactgcaagaacaggataatacttatcgagaatcttttcaacaagaatttgctcttttacgtggaaatcgtgacgatgatcaccttcttcgcgcatgtagataccatcgctcaggtcaacatcatatccgatcaggcttgcagcggtatcatgtgcgcactgtacagtaccctcacgcccagacacaacaacacaggcatagccagcggccttatacatcctgaacagttcttgaacaggagggttaggcggatcgttgataactttcgtgaagtcatacgggctacgttgtccgactttggttaatgtcccgtcaacgtcgaagataacgcatttcggtttgctcggatctgcatagctcatagctggaacccagccacggagtttacggtactgttcgaacatcgcccagacacgggaaacaggtagagcattcacaccgcgtttgtggtttcgtttcaggagttctacaatatccgcatccatccattcaatatggaaatccgcgttgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgataaccagtgagatcaccgccagcacagtaaagggttttgcggatatcgtcacgggaaacagtcagagtgttccccagttgacgcgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatgggtttccgtcataaggcatgacaaggtattttttaccgtcaatctctcggacttctgcaaccactttccatttcacattcaccggattcaccttagcggggagtgtaggcaaaatcttttctgggggcttttccgcacacccaaccaacagaacgcccagaacaagggctaacgttgcaattttcatttgtcgtactccgccatatactcttcgaaggacttattgatcttgatttcgatcagtcctggttttttaaacagcagatctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagcgtgattgtcatgtacaaaagccctgccaaagacagggctacaatgacaggccacaccaaagaagttaactttggaaaggctggtaatgtcatttatattcttccggtataaactgttcgtagttcttcgccattaatgcaacgatgttatcgaccagcttttgcttatcagtatcatcgaaataacgcatcataggcccgaagataatacgaccgtcaggggttaagtcagcgctcagggcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcgatgaaggtttacgtaccagttggttttcgctttcacaaaacctttatcagttttgatcacgtaaccctcgaaaccttctttcgtgtaggcttcggtaatgaacgcatccagatcggtgacttcgattttctcgcgctcaaccaggaacggacgtaatacaccatctgcgaagatgtcctgataatcgacgtattcgcccgtgtcgttattacggatgttcaggatcaccactgctggttcctgatagccaattacgatacggtttgttggtgcgacgtattccatgttgactgtgaaaccatcgttaaccagttcggtcaggcgatcgaacaatgctcggttagtctggatcacgctcatagcgtccatagcctgttcagattgaacggatgctttagacttaacgcccagatagccggaatcacagaaggtggagatcagggaaccatcttccttaatcatcacatccactacggtttcaccaatcgtcacaggagaggctttcagtgcttcccatgcctttacctcggcatagttgaaaaacttctccatagggcgactgacgagttttacgggggtatccccatccatcgcaaacatgataccgcgacattccagcgcaccaggttttaaccagtcggaatagctcgccatgcgatagttaaagatgcgcacgttggtttgcatcacagttttttgatcaatgaagtagaagcattcgctttcgttacacagtttcatcaactggtcaaagagggttttctgatttttggttagctttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcaaaatattactggggtttgcttccctccagtatttcgaattgcggtatgtgtctaaccgcttccacaaatcacgacattttccaacatacactatccgaccgtcgatttcaataaaatacacacaatgccggaattctccacatttaacaaaactccggtctatccttttgtctgaacccagacgcaaaggaaatattacaccaaatgttacatcgtccattatatatccaacttattcacctttccggtcaacacattgacgcagtgagcaatataatcaccgtggcacggtagaggtttgcgtgtacatcctaacctcttcccgtccaatgctttcagttcgtcgattgtgatcacgccagttcgaatcaagttttggaaatacgggatgaagttcattatgttttcagcccgtgttcccttgtagaagggattgccgaatttcgtacctctctgaatatcgacatcccagctacctttatacttgtttacgacgcgacaatcaagcgtatttttgtcgccattttgcataggcttcgtcgctgatctcggtgttgaggttgccaaccaggtaagaactcacttctacttcctgtggggctacctgtacgttgtcagacttcaaccatttgttcatccacggatacgggttcggcgttggtttaaatggagactgcaagccaaccgcgcgcatacgctgatctgtcaggtgttcgatataggcgatcgtacttttcagggatacgccgtctacatcaccgatagagaaaaggtgttcagcccattctttttcctgttcatatacttccaggaaaatctttgtcgcttcctcttcgtactggtaagcgatttccgccatttctgggtcatctttacccatctgccagagtcggatcttgctttgagtgcctttctggtgaagtgcttcatcacgggcaatcagacgcatgatcttcgcgttaccttccatcttgccttgttcggcaaagttgaacgtgaaggtaaacgacacgtagaagcggatcgcttccagagcattgacagcgtgcatacacagatacagagcaaccttgcatttacgcatttgctctttgcgtttcttctcgtactctgcgatcgattcgtctgggtatccgtgggacgttaacatttcgattttgagcacaatgtttttcagttcatgacattctgcgatcagatcatcgtagtattttgtcatggaagccgaacgtttcatgatcgcttcgttgcgcagaattttatcgaactctttcgacggatcgatgtgtaggttacgctgaatgtgcgtatagctgcggctatgaattgtttcactgaacgcccatgtttcgatccacgtttccattgagacatcggaagcgatagggaggaacgccaggttcgggccgcgtccctgaatggtatccagcagggtttgatattgcaggtttgaatcgaaaatgattttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccatcgcgggtgttgtggtagtacagcgttttgataccgaaatagtttgcatacagcagatcttcaaggatgatttcagatttcactttaccatctgggaagttagccggatcatagtttgtgtttgcagagatagcttgatcgacaaacttctgcataaccgctacgtgcgacagataacctttgtttccacgttttgccattgtccagagataatcatagaagtcaatctgattattctggtttggtactacctgattgaatgaaccttctttcgaagatttcacactcacagggccgcgcggaggttcaatcccgttggttgagttacttacctgcgagctactttcacaaggcattaaagcagaaagcgttgagttacgcaagccatgttttttgatttcaccgcgtaaccattcccaatcgcagttatacacaggtgatgccagttcatcaacgtttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcgcaatagttgcttgccagccaggatgcatagttggtgataccaacgcccagagaacgacgctgtttggctttcagagccgccgcaacagggtagttctggtaatccaacaggttatccagtgcgcgtactgcgatgcgtgtaagggctgggaattcgcttatatcggcattatcgagaacgatcgccataagcgtacacagtccaatttcgccagccagtttatcatcgtcatccagtggtgaagttgggatcgcgatttcacaacacaggttcgacatacgaaccggaacagagaaactaccctgctggtttacgtgatgactgttgaaaatgtatttgcgtccggtctgtgcgcgttcctgaacaagcaactggaacagatctaccgctttaatacgtttcttgcgtaccgttgggtctttttccagactggtatacagttcttcgaactcactctgatccgcttgatagaatgcgtcatagaggcgatcattcgcaacgtcagggctgaacagggtgatgtaatcgttattgattaaacgcttatacatcaaatcgttaagctgtacgccatagtccaggtgacgaatacggttttcttcaacgccacggttatttttcagaaccagcaggttttcaacttcaagatgccagatcggataatacagggttgctgcaccaccacgaacaccaccctgtgaacaggatttaaccgccgtctgaatgtgtttccagaacgggataacgcctgtatggactgcttcaccaccacggatttttgaacccatagcgcgaatgtgtcctgcgttgacaccgatacccgcacgttgagagatatacttcacgatcgcggacgtaacagcgttcagagaacccagagaatcacccgattcgattacaacacaactggagaactgacgcgtaggagtacgcacacccgccataataggcgtaggtaatgacagtttacgatccgaaatcgcgttatagaagtcaaccacatgactgattttatcagcgtgtttttcgtcctgatgcagacacattgcgatcagcatgaatgcatactgtggtgtttcgtagatgtcaccggacgtgcgatcctgcaacagatatttcccgatcaactgctgaacgccagcgtaagagaattcaaaatctttatcgtgattgatttttgattccagataatcaatctcagcaggagtccattttgtcaggatttctttatcgtattttccagcctcaaccagcttagtgatgtgttcgtagaacggaatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccaccagtccaaaccagatcgcccacttcatacccgcaaatatcagcgataatatgcgtcaggagagcgtaggaggcgatattgaacggcaaccctaagaagacatcaactgaacgctgataccactgtagagacagtttaccgttgattacgacgaactggaagaaacagtgacacggacgcaaagccatatcatccagatccatcgggttccaggcagaaacgatgatcccgcgatcgtctggtgtggttttcagttgttcgatgatttttgcaatctggtcaacaccataaaaagaaccttcctcaccaaacgagcgccattgatgcccatagatcggccccagataaccatgtgtataacccagcgctttagcctgattttcgtagttatcgtcccagatcgtccgcttatcgctatcttcaccccacgtcattttacgcagtgtttccacgttggtagaaccggacaggaaccactgtaattcatgtttacacggtttgaagaatagctgtttgctggtagtcgctgggaaaccttctgcgaggttccaacgtgcttgcatcccgaagatgcgcagtgtaccaacaccagtacgatcggttgattcagtaccgtgtgttagaacggtgttgacgatatcaagatattgtttcattttatgcctttttcgtatgtcggtcgacgataatttttctaacgcgttcgtttgattcgatttcttggactttgaaatcagtcagttcatatttcagaaccgcttcacagaattcaggaaccgtgaacgaaacatcacgtttaaaagctggcgcattgaaagtgtgatgtccgtaaatgtgcgtcacaaccacttcatcaaccagtgtattattgattgcttccagaagcaaccccttaccgccaatgagacacacatcacgatctggatgcgttgctttcatcacgtcgattgcagcagacaacccgccgccgtggatgacgtaatcagcaacatcgccttttttggttttgaggaaactaccagaaccagacagaacgcagtgaattcgtcctggcaatttaccaggaagagaagtaaaagtgttcgcacccatgatcaggacgctatctgcggtttctgctttgaagttctgtaaatcctctttgcagtgtccccacggtaaaccctgttcataaccgaaagcatagtccatttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatattcaatccgttaacatgagcgttaatgattttggattccagatcgaacaccatcacatctaacggactccattcaaccgaatgaagtttttcgcgggttaacagggttgtgtgttttggtagtttcattggggtacagtttgccataaccattgttccattttacgtaaatcttcctctaacggagtgaacccaaaggattcttcgatcacaccgtcttcccatacatcaatttccagaatttccgttaccggagggtttgacatcacatgatcacgacatgcagccatagcggtcataatggaatttgttactgtcagggtattgccctgaaccgatacctgaataatcatactttcacccattctttatctttagtccatgcggttttcaaggtaaaacgctggcggtaatgcatacccaaacttgggggatgcagcgaattgataccttcgacggcgatccgcattgcttcgaacttctcgcgatcaataaactgccctggtagaactggcattctcacacagtcccattcgtaagtatcgctgatctctttactggcattaaccagaatttcagcaatgtcaaaatctgtaggtgcgaaccatcccagattgataaacacgcgtttttgcgtaccttctttcaggttttcaaagtgcgcccatgttggacaactcatagtattttcctcataaaaaagggaactgcttttcaacagttcccattatagcataatcagttagtgtttcaagcgccaaagagcgattgcttcatcaactgcttttttaatttcttccggcgtgtctttgcgtccggctttaaccagggcagagagcatagaacgaatggttgcattcatctgtgacttctcacgatccatctgtgcctgatgcgccttatcaaccgctggggcttctttcttcgctgcctgtggtttcgtaggctgtgcgcctaactcgtccttagcttgcgtttcagtgcgtttctgttcggcttctttcttcacatgaggtgctgagaatttaccagccttgaagttatcacgcataccttccaggatcttacgggctgtgtaccagtcagcaacaccacgaagttgtttcagggtatcaaccagcaaaccgatacttgcgcctttgctatcctcgtcaatgtcgatatctttcaaccattcaacatgtttctgaccggagtgcatgaaatcaaagctgctgaaactccagaaacctttacggttgctgatctcgcgtttgaagtggaaagtcaaacccgcgccgttatcaaactcaccgtagttactgcggaatgttgcccccgcttgtttcagtgcgttgaaatagtcatctttattgatgcgattaacggtgcgttttggtttctcttccggcgctggcgctgctgcttgctgtgcggtacgtttaacaaaagatgctgaacgatgccccgctgcaaactctgcgttcatccggtcgattaccgctgcgatgccgcttgcgtctggttttactttctgcatttctttgaaagtgtcgatgatcatatccagacatgcaccgtcttcatcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttaggcggttgacaagagaaagagaagtcaaagaacgcatcaccagaagtgaaacgataggttgcgtgaacagtatgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcgtgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacaccgaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgatggttttgtgaaccgtccaaccttagacatgatgatgtggcggtcgaagtcctgcggatcaagatcctggtgactgattacaataacgttaccatctacagaatccagcagggatttaatcgcgaatgaaccctctttatcaagtggtccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaacagatccagataatatgctatctgtttgttgaagtacggaatataacgcttaacgatgctcgctttaacgccggaatctttcaacatatccgtaacaataccacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttggcaacttcgttttgcagagtacctttcagggcttcatatttggttttcagggcattgagtgcgcgttgctgttgcagcaagtcattcatgatcccttgtaactcgtcctgtttggttttgatcagggttaaacgttgtgtacccgctttgatgttctctgcgatctccgccatacgctcaggagtgggtttaatcgcttgcttacaggccggacactcaccgcctttctgatacatcacctccagctttttaaactgttctacagtcattgagagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgtttaacttgtccatttcactgatgacggacagagacagcaaatcttcaaccagtttccggcgttcgggggttttcagttccatgaatggagtgtagcccgctgtaccaagaacgataacctgtttgaagcccacaaggttgatgttcagcatagattcaagctgtgcctgataatcacctgctgtggagtcttccggcaacttctcgccgttcttccagatctcgaacaccttcggcttttgtccgcgcacaactttgtacgagtctttcccgtattcaatttccagttcaaccaggcatttctttttgttgacgctgttcaccaactgcccgacttttagatcgcggaatgacttaccgaacagggcataggttaaagcctcgatcagtgtcgatttaccgccaccgtttttccccgtgatcagggttttctttgctgtatcaaattccagttcgatcggggtgttcccgaccgacagaatattttgatacttaatttttttgaagtttagtttcatttaaaatccgttcacataattcagtgatcatttgaacaactgatgaatcaatactatatgatagagtatcgtcgtccagtgtatcaagcatgaatattgaccatgttcgtgatgaatgccatgcacccttcatgatggtcaaacaaactgcgctggtttcccctgcttcgtcggatgtggaaatgatgtgtttcattcccaacatacgcaacaggtgagaatatcggggattcgccccgaaatattcatcataacggctatgcacttgacacctccgcgtatagttcgctgatcagcttattcacttcctctttttcatcgtcggtgatctgcatgttggcgatatactcagtgataaggccacgaacggttttgatttcaaagtcggtatcgacatccgaatctgtttgaactttgtctatgatgttgatttcataggcaatttcttcaattttggtttggaactttgcaagcccctgatcaatttcgctaacaataagacgcaccgcacagttgcggaactgttcgagatcaacatctttctgtgctggatacatgatccggcgatggtgacacacagggttagcgatgaaagtcaattcaggcttgcccgtgaacacatagaatccgcgtgtttcgtcttcgtcgtttgcgctcatagtcagaggcgtaccgatataaaacacgttatcaccctcgttagcgtggtgatagtgtccagagtaaacacgatcgtacttcttcaagaaatcaggttccagcccatgatcggctttgctgttcttgtagaaatagtaaccagacagttcgaagtgtcccaaacaaaagttagctttcgattgtttgatgtagtcaaaaatacgctggctgttttcctgacaaatccacgggatcaggtcaatcgaatttccgccacctaaatcaaccgtggtcggttcgtcgatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcctgttcaatgcgtgtacccttgatggagtccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgtggtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatgttcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttaaactggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggcgagtaccctgaaattgttctagcctttgatgataacaagtattggcgcagaagtaaagcctggtactacaaaaagaaacgaaaaatggaacaagaagcatcggattgggactgggatcgcctgaatggtttccttcacccgacatacgatgaaatccgtgctaatttaccgtacaaaggtatccgtgttgacttcgcagaagccgatgacgtgatcggtgtggtgacgcgtaaagcggtatccgaaggtaaacgtgtcctgatcgtttctgctgatggtgactttgcagcccttcaaaaatatcagggtgtgcgtcagtggtcgccaacccaaaagaaatgggttacaccgaaatatggttcacctcgtaacgatttgcgcatgaagatcatcaagggcgataaaaaagatagtatcgcttgcattaaaatgcgaaatgactatattgttacgaaggttgaaggagaacgcgccccacaaatcagggctgctgaactcgaagcctggctggaagcggacgatccgaccgtgggtatgcccgaagagtgggcgatccgttacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaacccagacatcgctaaagcggttaaagaactgatcaaagaagcgtcgaacgtgaaaacccagatcgaacacttccagggttctttcaaagacatcaaatccaaagcgaaaacggattatggtatcgacggtaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcatcgacaagattagcgacgaagccattaaaaacaatctgctgcgtccttctgtggctaaagaccacgcgacgacgcaaacactggatgatttcatgtgaaatttaaaaccccgtttgacagttcagacgctaattcccgtttgaaaccgatcgcggtatacaaactgtatctggtgatgaaaaatcactttgctgggaagtatgacgcgatcaagtacaaatgggaaataaagatcactgaaaaagcgttcgaaaagagaagagataagtattttttcaaaaagttagccgaaaggtttacattcaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctcaacggtgtttcagtatagcgtcaaatcatcaacctcgtatatcagcaagctcgtactttctggggtgatttcttatgaatcattcttgatcctcgactcgtttttagacatcataaataaacacgatgaaatcgcaacggatttcgtctggaatgaatttagcaaaaaactaaacgcatacagaaaattagttgaaatcagtaacgaagaaatcgtaaaataccgaaacttaatgaaacaaaccttaattaacttaaacgagaaataacatatgtcattctttaaacgtcaagatccaaccaaactgcaagaacaagtcgccgctctgaaaggttcatccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccgtctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtaacctgtccgtttggtggcgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccattccaacggtgctaaagaatctggtggcgtaagtcaactgaacgtaggcggaagcgtaccggaagatgataatacacctccgtttgacctggaaggtggttccggtgatgacgacctggataaactgctggatctgtaatgcttacgggggcgaaagcccccaattttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcacagaatccaaaagcaaagaattccttgacaatgcggcggatcgcgttgtagaatccctgattaacggcacttttgcctaattgaaaactataggttgaatatgaaattctctaaacaaacgatcgacatcctgaaaaacttctcccagatcaacccatctgtaatgctgaaaaagggttcgttcattatgacgaaatccattaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtagaagtgggcgattacgaaggtgataacatgttcaacttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctctatgacgcagaagaaaggcggtaaaatcattctgattgacgaattcgatcgccctggcatggcagaagcacagaagcacatgcgtagctttatcgaagcgtacagcaagaacgttactgttatcatcaccgcgaacaacatcaacgggattcaccctgcgctgatctcccgttgtccggtagtcaagttcggttccccgtcgaaggaagaacgcgttgaactgatgaagcaaatgatcaaacgctgtttcggtatcctcgaaatcgaaaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaactgctggatgcggtatacccgatcgtcaccaacgaatctaaggttgcactcattcaggcagtaggcgaaaacaacgcacagtacgggctggcggtgaacaaagagattcacctgcaatacctgttcatgggcttaatgcttaccctcgcgtgggaggcttaaaaatgtcactggctgcttttctcgatgaagaagaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatccctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgccacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttgtacaccacttgtgaggactaaattatgaaaattcgtattgaagaaatccttaactctctcaaaaaagaagaccacttgattacccgtctgcatcgcgacgaaatcgatctgtctctgacctgcaatctctcggatctgcgcacgtacaattacgcgcagaactacttccctaatttctatacccgtatcatgaatgaatatacaatgctggtgaatcagttgaattcgcttgagggacacgaaaaacttcgtgaatctgcacagcgttcacttgatctgatcaagctggctggggtatcattcctgtcacgattaaacacggagaaagaaaaccgtaatgaatgaattttatctatccgttgagcaaatgggcgatcacatctacgagcgcttcattggctctgagggacgcgaacaggttcgcaaaacaaaatatgcgcctacaatgtttcaacacgctatggcgggtgtagactcgccatatcgcgacatttacggcaagacctgcatcaaaaagaaattcgaaagcatcaaagaagcaaaaaactggatgcagcgaatgaaagatgtaggcatggaagcgctaggcatggatgatttcaggctggcgtatatctccgatgcctacagaaaggaaatcgaatacgatcgcgacaagatccgcattgcttcacttgatatcgaagttaccgcgcctgaattccctgatccacgcgaagcaaaatacgctatcgacgcaatcacccactatgacagcgttgaagataaattctttgtgtacgatcttgtcgagggtggtttagatgaatgggtagcgtcaaaagttgataccgaaaacgagatcagcgaagaagacttgaagaaaattgtttaccgttcattccagaccgaaaagtcgctgatgtcggcttatatcaaagactggaaagagcggacacctgttattgttacgggatggaactcaaacaagttcgatatcgcgtatatcatcacccgttacctgaatatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccaacttacgctctgggcgcgatcgctgagttcgaaacaggtaaaagcaaagttgattacgaaggttcgctgtctgaactgcgtcaagcggatcaccagaaatacatcacgtataacatcgttgacgttatccgcgtgttggatatcgacggtaaacgcaactttatcgaactggttctgtctgtagcatactacgcgaaaatcaatttccctggggttatgtcaccgcttaaaacgtgggacgcaatcatttacaactctctgcgtgaagagaagaaagtaatcccagaaaacaaacgccatactaaaacgccgtatgatggtgcatacgttaaagatcctgttgtcgctccataccgttacattgtatcgttcgacttgaccagtctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaagacgtggaaaaaacgaatgatggcgggtgagcgaaatctcgaactgattaagcacgaactcgaacacctgacagacgcgcacaaccaaatgatcaaccctgatttcgagttctacgaagatttcggtgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagtgcgatcaccatgttcgggcagttggctattcagtggattgagcgtaaggttaacgaataccttaacgaactgtgcaacaccacggattacgcatacgtgcgttactgtgacaccgactccatttatgtttgtatggacaacgtgatcgcgaaagtcggcggtgaaaataagttcagggataacaaccattgggttgacttcctggataagttcagtaaagaacgcatggaacctatcattgataagggctaccgcgaactgtgcgagtacatgaacaacgtcgaacacctgatgtttatggatcgcgaaatcatttctggaccacctctgggatcgaaaggtctgggtagtttctggacggctaagaaacgatatgcggctaacgtatgggactccgaaggaacccgctacgagaaacctaaattaaagatcatgggaatggaaacccagcgaagtagtacaccgacagcggttaaaaagttcttgaaagaagcgatccgtcgcatcctgcaagaaggtgaagaatccttacacgaacacttcaaagtatttgaagaagagtataaggcgcttgactaccgcgaaatagctggtgtatcatctgctaataatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactacggcggattatttgaaaaacatgtgattagcccgttgcaaaacatcacggaagcatgtaaaattgattacgaaaaacgcgcatccctgaacactctgtttggtgatgactggtaagacctgacggggcagaaatgccccatttatataaatttgtgaggaaaatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaactcgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctatgattcagagaaaggcgtaactaagtcttacctgaaatcaatgggcgttgaccccgatcgtgtggtgtatactcgtatcacgacagttgagcaacttcgaaatgacgttgtaagccagcttaacgcgctggaacgcggcgacaaagtgatcattttcgtggactctgtaggcaacaccgcgagtaaaaaagaactggctgatgccctgtctgacaacgacaaacaggacatgacccgcgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacagcaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagactccaacgaaaggctggcgcggtcgtgcgttcctgaacacggaaacgggcgaacttgaactggaagaaaagaaatggcgtgaatcggaaaccaactcgatcgagttctggaaacctctgttcactcaccaaccattccttgatgcgattcaggataagtaccgtattcctgacaaagagatcactgacggggcagcactcgaagatctttattctgacgatgaagtagaaccgtcaaataaatttgatctcgatgacgatatccctgatgatgtggatatgtcagaagagtaataaacaactgggggctttgcccccttttaataggtgaatcatggacattgaacaaaaaacaaaaaacattcttgatgaagcaatgcaggacgttattcaagaactgttgatcaacgatgaaaacgatgttgcacacttagtgtacatccataaggtgtattgggataacggcctgaaagtcgaattcagtacgccggacgaagacaaagaaaaactgattccgctggttcacgatgcaatctacgcgcagatcaagcctaatctcccaaagcctgaaaagaccttatgggcggcgttgaaagtaaagctgtataatttctttcagatgttcgctaatctggtttaagaggtaataatgatcgtcgaaacaatattttcaaatctggtttttaatggtacgtattttgttcaggcgtggccccatttacgccgtgaatatttcgaagggaacgcgcagattctctttgatttgatggataagcacgtacaggaattcaacagcattccttcacaaactgctttagaagtagctctggacaaaaagagcctgagtgatgtagtctacgaagataccaaaaagatgatccgcagcatgaaaaatgcgccggaagatctggaatggttgatgaaagaaacggaaacctattgtcgtgacaaggcaatgtatcgcgctctgtcccgtgcaattgagatccaggcgaatgctgaaaaacctgctggcgaacgcaacaacaaaattcctggcgttggggcaatccctgacatcatgacggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggggcggaacgtggtacactgaacatcttaatggctggtgttaacgttggtaaatctctggggctttgttctctcgctgctgattacctgcaatcaggtaaaaacgtcctgtatatcagtatggaaatggctgaacacgtttgttctaaacgtattgacgctaacctgcttgatgtgccactggacgatatcgacaacgggaacatcacctatgcggactataagaaccgtatggaacgcctcaaacagtcgaaggtcgggcgtttaatcgttaagcaatacccaacagcaggggcgaacgctaaccactttaaagcgctgattaaagagcttaaattgaagaagggtttcgtacctgatgtgattattgttgactacctggggatctgtgcttctacccgtgtacgcggggcggaaaatacatacatcctggttaaagcgattgccgaagaacttcgtggtttggctgttgaaacaaataccgtaatgtggactggtgcgcagactacccgcgccgcgtgggatgcttctgatatcagcatgggcgacgttgccgaatctgctggtcttccggctaccgctgactttatgttagctgtgatcgagactgacgagttagctgatcagggcttgcagttgttcaagcagatcaaatcccgttacggcgataagaaccactttaaccacttcaaactcgaagtgcgtaagggtaatcaacgctggatggataccgacaacagcgatatcgggttcaaatctgattataaaggtcgtcagatgccgaaaactgttgaagaagcacaaggtgctatggtaaaacaagctgagactaaccgaagcaataagttagccgaaattgcaaatagtacagacattcaattttaacggggcttcggccccctccaaaggtatagtgaaatgaaaaagattctcgttattgtattcctgatcctcctgtctctgaaactggcagcaatcggggttatggcaaatgcttcctggtggcttgtatttgcgcctctgatcgtgatcggtgtggttaagctggctttctgggtgctgtttgtggtggcaatggcaaatgtattccctaaactgactctctggattgcaaaaaacgcaaaataatcctgattaggggttgacgggagttatgattgtgataatatgactcccgtagacaacaaaaactgattaggagataccaaatgaacgtactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagtgttgatttcctctggggcttcctcccaatcgacccagaattcaaactctgctgtaacgaagttcaggccaaaaacgttcttcggtatttaatcaacaaagcataaaaattaagccccgaaaggggcttttttgtatctataggtattgcaatccttctcgaaaggtgataccttattctaaacaaacaaaggaggacatcatgaaacttgcaatcgcttttatcttactggttctaaacgcacttatgggctttccgttcccgtggttggtgcttctggctatcccgtttgcctggaacctgttcagaatcggtttagcgggttgtgttggtgtcctgatgcttatcatcggcgctatcggtggcaaagacgcttttatcggtgttctgaaagccatgaaagagggcgttaaagaagggttagtgaaatgagtgatttattagatatgattcttccagacgaagaacaggagttcgaaagcccgtatcgttcagaatggatcgtatcggttgacgacaaaggctatgttgatatcatgcgctggcctaatattcatcctggctatctggacgaaggtatcaatgcggaagtgctgggtatgcctgaacaggttgaagatcctgctggggtgtataagtggatttgtagcccgtgggaaacccgcgactgggaaagcaatattgttgatgattggggctttgatgtggtagaatctacccctctgttcttattaccggaaaaagccaatggcgaagttaacgaaagcggaaaccaaacaacacaacaagataatggatctggtggagtctgataaggcgctaacctacgacgaaaagttattcattatcgaaaacttccatgaaggtgcatttacgaataactctgaactgggcgcgttctttaccccgatcggacttgctcgcgatttcactattgatgcttgtaccagtggaagcgttgttgacctgtgtgcgggtattggtgggctatcgttcgcgatgcttcatatgatgatgtacgccaaaccgcgtgaaatcgtctgtgtcgagttaaaccatacatactataagttgggtaagcgtatcgtaccggaagcgacctggattaacgcagacgcgttaacgacggagtttgatactctgtttgatatggcgatcagcaatcctcctttcggcaagataaagacatccaattttaagggtaagtatacgggcgcggaatttgaatataaagtgattgaacgtgcttcacagattgcccgtgcgggtacgttcattctcccgcagatgtccgcgaattttcgttactctggacggcgttatttccaacaggacgaatcaacgacaacatcgaaatgcaaaaagtttctcgatgaaactggccttgaaatgcaaccaggttgcggcattgataccggatactatctggaagaatggaaaggcgtgaaaccgatgtgtgaagttgtctgtatggaattccccgaaccggagccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaagacgaaggaagaactggaagcatattccccattccatcgctctgtaaggcacatcaagcgccgtttaaacgcggttccttatatgtctgggttcatgaaccttacgagcgcgtatgactcgttacggagccgctggaacctgaccgagcaagaacatgaagagatcatgatgaacctcccagaacttcgcgaaagactcaacgaagaaatggttgcaggtgattcaggcggaagtgtggataatattgcttcgggtgtgactacaggcgcgatcacgaacaaagggccgaaggttctgggttctacacgtccgcataaacgcaaacgtaaaatcatgaagagtgaagaatgaaaccattaccgccattgaattatcggatctgggttactgcgaacaattacacctggtttcctatccgtatcaagtacatgagcgacacagcgatcgtgtacacgaacgaaagaaaaacatcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggggaattcagtatccattcccgttgtccgatttgtggcgactccatgaaggataagcacaaaaaacgtttctggatattcccgtcaaaacgaggcacacacatgatgtgtggttgttttaactgcaactacagcaagccgttttctgtgtttctgaaagactattacccggatgattacacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccgcgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggttcttgacaatgaagcgagacaccctgatactactcaccgccttttaaaattgattgaggctggcgaaaaggttgtgttgtgggacaaatgcccgtggccgtcaaaagatatcaacgaaatgataaaaacggacggcgcaactaaacttgaaatcatgcagtatttgaaagataatactgtttctggactcacggcgaaacttcggtttaagtcgtggaacaaatcaccgaaaaaatgagattgatatgactgataaaactcctgtgtttaatagctgtgcgcacctggttaaagccgatgatctggaaatggtagaaggtttctaccgcaatgcattacagaacggaattgacccgctgcaaaagatgctggacttgcaaaaccatgcacaacaaagcctgtctgataccctgaattgggttccacgtccgaacgaactgaaaacgtgcggtgagatcctggactggctgaaactgcaagatgatgcgatcgcagacgaaacccgcgaactttacaccgctctgggcggtatgtcacgcggtgcaaaagcggcttccggtgtctggaaaccgtggaaagcaaatcaccaggaactgcgtagccaggtattcgcagaaatgaaagaagaagacaagctggaaatcctgtttgaactgattgaccagtggcacttcttcatgtgtaagttcctcgcgctgggactggatgcggaaaccatctacaagctgtatgctctgaaacaggcggaaaacctgcgtcgttgggctaacaactactaatggaactcaccgcgctacatgccgtatttgctttgtcttatatcgtctgcgcggtgataacgtatctcttcggatggtgcgttttccacgttaacggtgttgacagaaaagccgctttgatagtattatcattgctatgggttataggttttttctacgtcatctatgaggggcgaaaatgattgacaaatactatatcattgttacgaaagacaaagacggctttactattccacacgttgaaaacgggaaaacgccggaactgtttgcatcaccgcaacttgcaaaggataagttagactttatccgcaagtgctacgaaagcaaactcaactacgtaccggacgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagcgacgatcagaagtccgcgcatgatcgcgtgatccataacatccagaacgccattcatacaactattacgggtggccctggtgttggtaaaacaacactggttaagtttgtctttaacactctgaaagggttggggattagcggtatttggttaactgccccaacacaccaggcgaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcaagggctgtacgtgatggtaagatgctgaaaccgatgtctgtcggtgatctgggtgtgttccaacatgctaacgctgttgacttcctccgtcagtatttccgccgtgtcaaaacgccggatgacttgatcgagaaccgcatgttcgcttacactaacgacaacgtggacaagctgaacgcaacgatccgtaaacacctgtacaaaacaacagaacctttcattctcgatgaagtgatcgtgatgcaggaaccgttagttcaggaaatgcggttgaacgggcaaatcttcaccgagattgtttataacaacaacgaaaaaatccgagtcttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcctacgttgcgagcacttataagcgcatcaagcaacaaacaggctataaagccccgtggcattcgttctgggcgattaaaaacaagttccaggatgttaagcctcttccggtttgcacgtaccacaaatcgcaggggagcacgtatgaccatgcgtatatgtacacgcgcgatgcgtatgcgttcgcagattacgatctgtgtaagcagttaatctatgtgggcgtaacccgcgcacgttacaccgttgattatgtataaggggctttgccccttttgaggttattatgaaattgactatccttgtaaaagacattccccgaattcttgaagcactcgataaaattcgagaaaaagatccacatgcggtcaatgtgttcgggatgtatagcgcagcagatccgcaagaagttattcaccgtttgcgcttcattgaaaaatctaacgatattctgtattctccgaacggaccaagttattcatggagtcctattgcaaaagaagtcgaactgacttatgatgaatatggcgttatcgtgctgatccttcgaatggcacgaaacattcgtgaagataaagacatatggacattaatatcatgaaaaaagatatatctatccagatcccacgcctccacgcggaagcgattgcagatctaattttcaaaacccctgttcaagaacttccgcatttcatcgatcgcgatgtgttggacgaattcacagaagctgttgaaaacgcgaaccgtctggaaaaggcaatttatcattccggtctgcgtcagttcggtatgatgactttgcaaagcaaagagtttgaaacttttgatatcaacccagaagttgcgcttacgctggcgtacttcatggaagattataagcggagaacttcatgagtcatttacccgtagattacgtatgggattatgaaacggttggcccttccccgaatgggaaggtgatcgaactctcatacgttccatttgttgacgatccccacaacccgccaacgttcgcggaactggttgcacgggggcgcaagtacaaatttgatttgcgcaaccagcctgatcgtattgctgatcagggaacaatcgcctggtggaaacaacaaagcgaagaagcccgtcaaatcctgaaaccgtcgccggaagatctggaactgtatgcaggacacagacaattctttgaagacctgaaagcggacggtgtgagccgttggcaatcactcgattatgttcgtggtcctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtaggtaaaactgtacatgcaaaaacactgaacgaagcgaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgcaaaaccgttagcaatgcaagctatatccttccggggatggttctgaaattgcctcagttagtcgaattatgataaaaagcccttgcattcgtgcaagggctttgttattttgtagggactgaaacaaaagaggataaaacatgtttggtgatttgaaagaaggtttgaacattttaatcggattcgcgatcattggtgtgattgcttgtgtgtccggtgcggtgtggttgtcttatcaggcgatcgtgtggttgggcgaatggcttcacattctggcacagtaaggggatattatgcgtttatgtttagttggtgtaggtttcggtcgtgcgttaactcaagggttaatcgactcaatccgctggattcaaccaagcgttgaactgtattcattacctaaccggatcgaatactctgatccaacaccgtacaaaatgaaaccttatcaagcgccacgcgttaaccgtgcgttacaccgtcaatctgtgaacaggggcaaataatgagcacagcaattccacttatagtaatttttgtgttggttgtgctgtttgtcatcttcaaagcaatcgaccaatccatagcaagagaatggtttagcgactactacacgaagaaagcgtttataaaacattttcgaatggaagcagtgtgtacccacgtatacacggagctaaaccaggttagattctcattctcacagaagggaaccgattatgacatcacggtatctctttccaaagcaaaagagctttacgatatcacccaaaacgggggaatccgtagaacacttaaatcattaaaatagcactttttgttaaactagcctcttgcaatgcaggaggcttttttgtatattacacacatcgaaacgaaacagacaaaaggaacgcatcatgaaaaacttagaagccaaagtagttaaagtcctggttaagaacgggttcaatgaaaaagacgcagtagcgatggttgaaaagaatctgaatgatgcgttgaaagttagaccagaagcaaaacctgctaaactcgcagaggtgattgtatgcatcatgtaaaagtaagcatcaaggatatcacggttggtgacaccgtgatccacgaagggaaaatgaagactgtcgggaaaaacgatatcaagcgcgatcctttgtttggtgtcctcctgtttggtgatagtttcaacctggggagaacttttatcgagagggttattttcccgaaatggtatcaagggaaacgggtttaacaaatagcactttttgctaaagacttaacgggatagctttgatatagttatcccatcgaaacgaaacggaaggagagttatcatgatgcagaacggttctttaatcaaaggtcacggcaaattcctgattcagcagatcaacgacaacaaaggcatcatcgcctattgcgaagagaagatgaacagcgatatcgcagcatgggaaaagaaagagtatgcagcagtgaaaaaagccgcagaaaaatcccttgctaaagcagaagaaaatctggctaacctggagaactacgcatgaactacaaaactttcgtgattaccgtcaaaactaaaaatggcgaagactgcttcttgtatcaggcaaaagacgagaaagaagctaaagcaggtgtattgaagttcatcaaacgtgatgcattgagcaacatttgtgaacaaccaaaataatgcttgcaatcctgaacgcataatagtatattacacacatcgaaacgaaacacacttaggagattttaccatgtatacttttgacgaactgaaagccgcagcacagcctttactggacgcgatgcacaaaggtcgtaacactggcatgtggttcagcgattacactgaaactgtgttcgttctggaaaaaggccgtaagtatcaccgtatcgtgcaggatacccgcaacaaagaaacgggtgaaatgttcaatcagcgttcagttgctggcttcatcgacaatgacggaaatatcttgaaagccgctggctggaaagcacctgctaagggtattcgtggtaacatcttcaacaacccagagaacgcgatcgaccggagtggatacgttcgctatcttcgctaaaatcggggcttcgtcccctttggaaattaaaatgaaactatcagcaaccgccagttggtcaatcttcggactgatagccgcaggggttttattcttcgcatggcaatcaagagatccgaacaaagcggcgtatgaagccgcacaacgagtagtagaacaggatgcagaagcacaacacgaagcaatgctacaacagcgtcgtgatatgggctttgtggagactgtgagttacacaaacgcttttggtgatgtcactacgcgctctgtaaacgtcttagggcgcacgaaagggacaatgctcaccatcagacgggaaggaaccggaaagctcgtagacgtgtgtttcagtgcgattacggacgattccaaacgcgaactattcgccccgtatttttctacgcctgtatatgctaaatttgacggcggagaaacaaaagagtttagcgcaagcagaggaagtaccgaagatttcctgtgtattacttccccgcaacgcttccttttcaatatggatcgtgctagtgttatgcaagtccagttagtattcctggatcattactccaaagtgccagaagtgcatgaatggaacctgaaaacatataatgaggttgtgaataaatgagcagacgcccaaagaacagcaaaaccgaaatgttcgcaacgtttgatgtaaacggaaagagcattgagggtaaaccatgcacgaactcaaagtttatgcatatcgccggattgcctggtatgagtgttaaaacttcttactgttgtcactacaacgaagaaaccacctctgtttatttgggcgaagaactcatggctgaacgcgtcatgcaatgcgtgcatttccctggcgaacgtccagaagtgaactgttttattgttggttatcataaaggtattgtaaatgagcaagtataaaattggtgatatgtacgccccgaaatctattttaatggctgtgtgtcaaatggcatcagaagccgatccgattcgtcgtatgtatgatgcgttgcgtaagaacccgatggacttcaattcaccacgccggatcagtatggtgtatgaagaaacagggattctttatcttgaaggtattcccgttcctatcaagttcaacgatatgaaagggcttttcaatccggtatgggttgcaccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgcgttggatgtgatttacctgaaactgggtactacccacgggacaacagaaatcgcgcaagtgatcaataaactgcttgataagaaattagataagtggtactctacttgtagttaatcaattacgaggatcggatcatgttggtttatcgcgttgaattgaaagcgtctatattatccaaatatgatggatggtgtaagcaattaggcccgtacacgggttgtgttggtgatgaagacgatctctatgagtatcttgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatctgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaattcccgaagatgtccagcatcgcgagccgtgacgaaccgaaagattgtgattgcgggggcgaggcgaaacgaacggttgataagccgcagatggtgaaagacggtttcccgtacaacaagtaaaccccgaaaggggttttctttttcatagaaccctatataatgcctgagaactaataaagaggtgaatatgagtttagatttcttaatggacgataacgagccgcagaaagcaccagaagccccgacaaagggcgctaaggtggatgaatcattctgcttgagcgatcgcgatcacattcgcaaacgtccgaacatgtacgtgggttcagtgaacaaagaagcccatgaacgttttatcatgggtaaattccgcaaagtggaatacgttgaagggttggtgaaaatcatcaacgaaatcctggataactccatcgacgaagcgatccgaactgatttcaaatttgcgaacaaaatcgaagtcaagattgatcacaatctggttactatttcggacaacgggcgcggtattccacaagatgacgtgagaacgccagaagggaagattgttcctaaacctgttgcagcctggacaatggctaaatccggttctaacttcgatgacgaaaaccgtgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctattttcggtgtggacggtatcgacgaagagacaaaggaagtcatcaaagatcgccttatggcgcttgcagtggctttccctgccgttaaattcacatataacggtgatatcctcccgaacaaattcgcgatgtatggcgcgatgtacggtgataaaacgattacccagacaaacaacaaaatcagtttcatcctggcgagcacagaagacggtttcaaacagaaatccttcgttaacggattggatacgaaaaacggcggtgttcatgttgacaccatgatcgacggtatctattccgaactcgaaccgatgatcaagaaaacacacgctatcgagatcccgaaagcccgtgtaaaagaatgcttgactttggttgtgtttttgcataacttcaatgcaccagcttttgatagtcagacgaaagaaaaactgactaacaccgctggggagttcaacaaccacgccggactgaactacaaaaagatcgcgaaacagattatggatacttctgaaataatcactccgatcattgagtccgctctgattcgcaaacaggcagcagaagccgcagccattaccaaagcgaagaagaaagcgaaaaaggcgaaggttgcaaaacatgttccggcatcagggatcgacactgacggggtagaaaccactttgtttctgaccgagggcgattccgctgtagggcagtttatcgagtgcagaaacgaagagacacaaggcgcatttccgctacgtggcaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgacgggggcgatattctcaccctactgattgcgttctttagtcgctggcctgagttgttcgagaagaaaaagatccgttatatccgcacaccgattatcattgcgaaagtcggtaaagatgaaaaatggttctactcccttgaagatttcgcaccgttccgcgataaagcgaaagaggtacgatatatcaaagggctgggttctttacgcaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtacaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgttacattaaatgtaagctgtctccgctgttcaaggctatctacatggatgaagatttgacaatcccgcatgaagatcctgaacacgtaccgccagcctattacctgccaatcattccgatggtactggttaacgggttcagcgggatcgcgaaagcatacgctaccaacattccaccacacgatccgatttcggttctgaatggatgtgttagttacctgaacgggaaagatttcacactggatctgaaatacccgcatttcaaaggtgacattgaaaacggtacgatgtatggcaagtatgaactccagggtaaaactaaactggtgatcacagagattccggtcaagtatgatcgcgtgaaatatatttctattctggataagctggaagagaaagggtatatcgtaagctataaggatctatcgaaagaagatttccgctacgagatcaccctcaaacgcgagtatgcaaacgggcttacccctgagaagatcctgaaagatttcggattgattgagaactcaaacccaaacatcaacgttatctttaacgggaaactgcattcatacgagcgtcctgaaacgttgctgaaagacttcgttgatatccgtattggtgtttaccaacagcgtattgataaacgcatccaggagactaaggaagcgttagataaagcgctggcgaaggttgacttcatcgaccagatgatcgcacagcctgacgcattgaaggggcttagtcgcagcgaagcggttaaacttgtctctacgtggacgggttgcgagaaccacgccgaaatcctggttgcgatgaacatctatcatctaaccacggatgaacgtcaaaagctggaagacgaagcgaacgaactgcgtaagcaactgaaatactgggaagaaacgaccccgaaaactgaatatctcaatgatttgaaagaactttcgaagaaattgaaataatttacaaaaagcctcttgcattgcgggaggcttttttgttatagtgtcctcactgattggggaggatataaaatgttcaaaactcgtagcgatatggaaataaccatctgggccaaaagcatcatggcgaagcatggcttatctcattggtctttcaaaatcaacggacgtttcaagcgtactctgggacaatgcaattacagtcgcaagtcaattgaattgagccgttctcacgttaaggaagatatctacgagaacgttttagatactctcatgcacgaaattgcacatgctctgaccgaaggggctggacacgggatcgtatggcagcgtaaagctatcgagttgggcgcacagcctacaccatgcaaaagccgtatccgtgagaaatcagtaattcaggaaagcgaaaaagacatatacgcgtttttcctgaaaactccgaacggtgaagtttatcagtgcaatatgaccgaaaagatgtacaatgagatccaggaaggtaaacgcaacattgcaaacatctacatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgagtatgggcttgatcaaaagcctatgaaatattcatgtgataacatcatcttcaacaccaagtgagatataaacaatgaaattgcgtcagttagcaccacaaaccattcacactacgggcttcgataaaggcgaacgcacgaagtttaaaatggctaccagtgcgaaaacatacaaaatcatgtcatcaaccatctacaaatacaagatccgcgcaatcattcgcgaaatctccagtaacgccattgatggtcatatggtagcgggtaacatgaacccgttcgatgttcagttaccaactgttctcgatccgcgtttcatcgtccgtgattacggcacagggttaagtgactggatggttaaagaggtgtttgcaacctatttcgaatccaccaaaaccgacaccgacgaactgatcggggcgctgggactgggtagtaaatccccgttctgctacaccgaaacattcactatcgaatccatccaggacggcgttaaacgtgcgtacacggcttatatggataatggtgaacctttcgttgaccaaatctacgaaaccgaaacagacgaacctaacggcgttcaaatcaccgttccggttaaagtcgaagatatcgcagaatgggaacgtgaagcggcgcgtgtttatgaaccgtttacgggtatccgtccgcgctttatcggtgttcaggttgatgtaaactggcaaccgaaagaagcagacgatcgcgggatcatccgttataagtccatcaactattcaggcgtatacgcgcgtatgggtaacatttgttatccaatcgatctggatatgttcgaaaactcgctgttctactgctaccgtaacagcaattacgcatatattctggatttccctctgggatcgctggacttcatgccgtcgcgtgaagagttgagccttgataaagtcacgaagaaagtgattacggatcgactggataaaatcaacaaacgctttgatgaagagttgatggaacagtataaaaagcagaagacaacccgcgataaactcgtatggttcaataatctgcctagcttgttacagacattcgtaacccgtgataaccgtttccgtgtgggtaaagaatcgctggctgaaattctgacgcgtatcaaaagccctgatacagcaaccggaaaatatgtgtggggcttctgggctaacccatatgacgggaaagattgcgtattcgaacgtgtgggttctggtcgccgttatgagaagtataaagcggaaaccaccaaacgccaggacgttatgcgcatgatccaaccgtggcgacagaagaaactgttcatcgttgaaaatgataacgaagcgcgttcactccgcccgtatctgatcggttactgcatgatgaacggttcggatcgtatcagtttcgtaactgccgatcgtaaaagtgactctgtgcgtcagttgattgaaactggctatttcgatgaatctgagatcgttacactgaaaaccagtgaattgaccaaagaattcgaaacgtacaccgaagatcgcaagcgctggaaagcaacgcgtgaatcatcttctggtgattctgaaccacgtccgaaaacgcctacggcatatcattacttccttgatgatcagggtaacttacagaaaaacgatctgttcctgacaaaagcacagttcgtgaaactggatgaaatgtacgctatgcgcctctacgggattgatgaatatagccgactggacggagaagcaccgaactatacactgggtagcatcgccagcagtatgatgaccctgttgaaagttaccggactgaaaggcgtgatggttctgcgaaactccctgtggagccgcattcctgatagcaacatgaaatgtcttgatgactatctggtacagcgttttgccgacgcggtgaaaaagatgaagcctgactggtatccagcctggatttcgtctaaacatggtagcgaggttcgaacccttcgcgattatctggaggtgactcttgatcgcatggtgaaaaaccgctataatccagaattgtatttgttgcttgattatcttgatggtaagtttacctacgatactatcgagaacaaaaacaaatcgaaaaatgtggtgcgcaatccgttacttcgtgaaatgtcggtgaagcattacaaaatgctgaaagatatgaaagaacgtgttgataccgcctttgatttgtttgaagaacgcaaccctgcattggtgtatgtgttgcgcaattcgtcttactctttaggccgtaccatgattacggacgataagatcaagacgaacctgattaaccttatacggtggaaataatgagaaacgttaagatccttgatgatgtacaaaagaaagctgtctatgagggctttctgaccagcgcgaacaaaaccgcactggctaaacaatttggtgtaagcgtccgaaccatcgggcgcgttattaccgaacaacattctaagtataatacggaagcatcgaaaccacttccacaaacagatgtcaaatctaaaatgattggttctgaatcgttcattactctggtactggacggcaagatcatcacagcggattcgtcacaccctaacttcgaaaaagcacatgctttaatggttaagggcgacatcgagggagttgctaccctgttggacacaacgcaagcgttgaagatttacagcaaaggcaacattaaaatcatcgggcataaagtcctgtacaaagatatcgtgtttgacagcggtatcacacaacgtatcgttcgcgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataattcccctggtgttgtggttgaaatgccacgtaaccaggtagacgagaataaaaaccgaacctgttcatgcggtttgcatgttgccgcaaaatcgtacctgcctcactatggcggaggacgcgggaaagttattcaggtcaaggttaatcctcgcgatgttgtagcaatcccgacagattacgacaacgctaagatgcgtgtatgccgttatcaggtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccattaaaaccgccaaagaactctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctctttggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgcgcatgatcagaagcaggtcgaacaggtagcagcagaccgcaaagcagcggaagaagaacatcagcgtaagctggctgaactggctaccaaagaaagcgatcacaccgcaagcgcaacccgcgccggacgtatcgcggataagatccgcaaactgctggattaattcgaggggcgaaagccccttaaatatttctttttgaggggctttaaatgaacaatctggtagcaaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacgggcattatgtgaacggatgcaacaacaccccagaacaggatcacgctgtcaatatcgttaacctcatgttagggccgcgtacagacgacaacctgaaatgggcgagcgaatccaacgttcctcatgagtatgtcgggatgtattatcagtgcaacgttgacgataaagcgccactgataccggaaaaacagattgatttagtagttcgaacaggtttcttcttatgagttcacaaattctgttcagcaaagaagatccattaggcacagattcatcggtgcaacgcttattctggcacatggattatacaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaaagcccttgacttcggttgagggcttttgctatattggccttgtcgaaacgaaaccactaaggagattcaccatgactaacctgactaaagttaccgcgacatacttcatttcttctggcgctaaaaacgctatgtacactctgcgtgtagagcgtcgtggaggtggattcacttctgataactatatctgcaacctgtctactgacccagataaagcggaagcgaaagcgcgtgaatacttcgatcgcatggtggatcgtctgaaccagaccgatactttccagatggtgttccagggcttcgcagatttcgatctgttcgaacgtcgcggcaaactgtctgtacaagataccgaaaatctggaactgctggaacaaggcatcatgccgatcggtaagcgtaaaggtgaagtgattgctgatatgccgatgtatacgattctgtggtgggctgatcagtgcaaagaaaacggcaacgatagcccagtatttcaggctatttgctcttactgcatgggcgtagcgctggagaaggattacatcgctaaacgtgaagagatccgcgcagaatgggaagcagagcgccaggcgaagatcgcagcagcgcagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgcttcaaagcgacacctaaacttcacaacgaatacaaagaagttaaacaaacaatcgttcagcgagtaaaggtattataatgacatacgaagaaatgcttaatgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataaccacgacgaacttgacctgatcttagtcatagataatcacccactgggtgttcgtccatacatctatcacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgataggtaatgttggatactggaacgatgaatatgttccgacaccttacgaactcatgcgcgtatgggacatatacgataaaagcccgatgacgaaagtaaaagatttcatcaatcgggctttgagtagtttgaaactgaaattatcatcgaatcctgcctaaaattctagcggcctgattgcacacgatcattaacttcgtatcggcgacttcgggcttctgtatataccattccattagaattgatcctgaatagtagttttcgagattgaagtaaggacaactaaaggtatatgctaccggaacaaggtcttttgttggaagatacgggctggcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatctccatcgtcggcacgtctataacgcttgaagatgttttccagactgaaaataagtcatcccacttataccatgttacgaacataatgaaaatagtgacgataagaaccaatttaatgaataactgtttccatgttttgaccgccatgatgaacgatattacccgttcaagcaccgccaatttatcttgtaatagcgccatatttaatcctcaagttcggggatgccgaccccgaacatatttaggaatttacttaacgttgagtgaccagaccggatcgtgtttggcctacacgggcgttcaaatagtcataccacgcgttatgttgggcagaagcaatctgatattggcgatatccatcctgtatacgaccgttattgtcaaagtcaaacacaccgccgtcatccatcgtaagtcttaggttaacagcaggaccgttttgaatggtaattacgctaatctcattgctgaattgtgcagaaacacaagtaccgaatgcgttgccgttaaaactaccaccaactgcgccgtgaccggaaggtttcgaatatggtgaataccaaccaaccccccactgaccacgataacgggcgttgttatagtaacgctcatacaccgtaaagttgatgttatatacggattgtcccgccattcgagacatataaaacggtgttccgattcgaaccgcgttacccgcagcagacatccaccgttgccctgtttcagtgaccgcagacgaaccgatccagccaggaactcctacaatagccataaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggcaataccttctcaacatcctgagcgatcagaccggattcgcgatggtatacgatatcatcagcatcttttgattgcttatcgtagatataacctttaagctgttcaatcttgcttaatgaatctttcagttcaactaaattcgatttcagtcgaatatcggaacgaatatacacatcgttggcgtttacgttaccttcaacatacagaccacggttcatatacagatccgaagcacgcaactgtaaggtcgtattcagtcggtagttgtgtaccgatacgttatcatcagcaccaccaaacccgaagtatgcgccgttgttacctgccaaagtaatcagcaaataacatgattggttagtcgctgtgttattcagaagtaatgctggtccgttaacaccctgaacctgtaactgtttatagttagcagttgcgccagtagtccatcgcataatacgctggctatttgcataggcgttgagaataccgtcaccttcctgtttgaaacctgtatcgttatcacccagagaaataccagtcgtacccaatccgtttgcagtaccacaacccagaccgtttgtttcgaccgtgccgttgaagtttaccgcgttaccaaagttaacagaaccgttgatgtttgcaccgtttgctatagaaacaacgccattcgagttactgatagtaaacggacgtagaccactccatgttccatactgatcgccggatgcagtaagtaagaaatatgtacttccaccatcatttcgaatgatgaaaccatagtttcctcctacggcgcggaattgtccgccagtaccataagtattactctgtatctcttgacggaatcgagcataacccgcagtagaaattgctaattcttcctgtccgtcagttgaacctgttgccagtcgatatacgccaccctgaacagtttcatgccagatcgtatccgcattaccgcctcggaactggcgcaaatagtttttcccgccctgtccaacagtaggtaagaaatattgcgctggtgtgccctgtggaacttcgttataatacgatggtacgtttacgttaagacctgatttggtgttaatatacgttgcgccagtaccacggaaataatggttatatcttccgttaccatctttatagcctaagtgggtaacaccatcaccaaccccgtttccatccccgtttgtagttactcgaagtattgctgtgtttattccttgagtagcataatcagtttcaacggaagcacggttattgaatacacccagaccattaaacgtagcctgtccaggaacggttagatggttagcgagaactaaagttccatcagaagcaaaacgagttgcatacgcaccaccaccagtacgaacataaacgttcttccctgtatcaacgtagaccaaacccagttcattacctccagcatcctggaaatataagtttctgtttccatcgcctttgatagacatttgcgtaccaaagatcgtaccgcttacaacagtttgcatcccgatgttgaattgcgtccctgttaaactaacaagaccattatcacccagcatttgcaattcagcgcgaatggtcccagcagcaccagttgtcgtgtttggtgcgccaaaagcacggatataataagcaccaccacccgcagggcgttgggtacaaatcagatcaacaaggtttgcccccaagtttggatctgacgttggtgacgcggtttttgaatgtataacaaatgtgcgtgtttctgcgctaggaaacccgtttgttactgggttattgtctgtgcgagttgcaacgagataaggttctgttgccctaaccattgcgatcctgtatggtaatttcaattcagttgcagaaccttgtaattccaaagttccttgcattgtatcaccagctttcttcacctgtgcatcgtttgttacgttgcctaatccgatttctgcctttgttggcttatcgttttcggtgtagactttaaagcctttatatgtgattgtgtttccagaagggagtaaaggcaaattagcctgactccagatagtattaccgccaacggtagtacccgcttttaaatctgccattattaagatcctcaaatgcttttatgatatttataaaaagaaaaagccccgaagggcttttaattagcgggatttgagttccctgacttcctcgcggagttctttaatcgcgttgacaagcaaggcaataacagcagaagacgaaacagttaagatctcgttctgttcaccatcaacgcctttcttaacagcttccggtaatacttcttgcagttgttgtgcgactaaaccagcctcacgggtagtttcttcacccccgatatgatttgctttgtcgtacaccataccatcaagtaaatcaactttatccaatgcattttcaatcttactgaaattacttttcagtctttcatcagaacgaatatacacatcgttaaagctaccattaccgttcattatcatttgaatgccggatgaagggttgcgttcaaaataaaccagatatgacgatgaatccgacagttctatacggtttccgcgagtagcatcaccagcatggaagatatacatatcgcgagggtttgcaccactgcgaataaattcaacgcgtccgttgccgctaccgtttaatgttaaatttccattgtcaatataactgcttgactggctgatacgtccgttgactgataacgtatgtcccatcgagacattaccagtatcattatttatatacaaaggacgtaggttattataacttccccatgcatcacctgagtttgttaacatgaaataggtgttaccaccgtcatttcggataaagaatccacggttattgtatgcaatacgcaatccgttggctgagttggaaataatatcaccataagatacaaactcaccagagttatcaaaataccattgacgatctaccgatccagtacggtaatggactgtaaacctgttggtgtttaccaacgtacccatagaccacgcaccgccagcctgagaataatattgcttaataataggccagtattcagatgtcgatgtagtgttaatattctggaaaatcggagcttttgcagtgctttgagaagcccaagaacctctaccttcccccgatgcatcaaaataaccgcctgtttggttgatggttcctgttaccgtgcctcctgtatttttcaagaacagtgcatcgatccatcctgaaaacccgcttttgttgatatacacgttcccgtcattagccagaataccaccgccgggtgttttaagtggttgagatatgtttgccagtgttagaacaccagtcatcgcatcaccggatttattgactgcccctacttccgccggagtcggaggaagcgaagtatcataaattcttctccatccattagcatcacccgcactataagaccatgcaccaggagaacccgtcgcagcacgaatccatgttgatgttatatcatagtaagtctgaaccagagaaacaccactattcagagtacggcgatatgtggcaacctgaccgtaatatgttgtgtttccatatggaccgtccgttacgttaccaccgaccgacagaacatcgttcttttcagtaaccgcagcagccccgaaactgtttccagacataccgcgaggaatacccgtgatataacgttcatcatggttagcccagtttgacggagttactgtattcgcagtaatcgcgccactaactgccattgatgtagcattcgttaagccgaggttagaagtcccgattacacggaaagatccttgctcaactgttacctgttgggtttgtgaatccagactcaacagcgtattttgagtaccatttttaaaggcacggatgtatattttattacctccgtctgtgcgagcgttcacgttaattgcacccgctaactgtccgccagaaataccgttgtatgcgttaatgtccatcaacccagattccgcaccaggaaccgaagtaatatcagggcgacggaaaacaaccaccggagcagcagcacttcgagtgatcccgaccgactggttagattgaatagtgtttgcggtcaacagaacgcctactgtcacgttttgactaaacgtagtattcttcgcaacagtaccgccgttaatcgtcgatagtgcgtttatatcctccgctgttggacgatcgttttcggtgtatactctccagcctttatacgttaattgtccaccagagggcaatagaggaaggttagaagcactccagatacccgcaccacccagcgttgtacctaatttcaaatcagccataaaaatttctcctgtaatgactgtatttatgaaaaaggggctttcgcccctttaacgcacaattgacagattaacgtctttagcggacatcgaacctgtgcttgtgttgtttggataacgatataaaccgaaatcaaacataacagcaccagcaggaataaccccttcgtttttgtagaatgaatatacgttcgggatcgtgccaacatcacgcatgttaattccagagatatacgtattgtttgcatcccagaactgcattacgatgtacgcgcccttactatttgcgattgctgttgcatcacgtttcatttggcattgcatacggatcgtatcaccaggttttattccataactgcttagtgatgctttcgttaccgccgcttgctgggtagcagtccattctttgaactggtactccgctgtattggtagaagtatattcagtcggatcagaaacaatataatcaagttcagcaaagttatgcgaactaattttcttgtcactgataaccccaacaggcgaaacaggcagagaaagcaattgttcaatcgggtttacggttccagcatcagtgacttcggaaagtgtttgcatcctaataccgttgacaccgatagccgccccgtttctgttcacctcttcgcgagggactttacagaattggatatttcggcatcgggcctgacctgtggtaactgttgacggataatgataagcagaaacacccaaacgagttatatcagcattatctggaatagtgtaatatcccgataccgaatgccatgtatccgcagcaagtccagttgttctaagaactgttgatgatatccactgtccagacgcaatatgagtaaaggcatacagataacattctgcccccgcattacgtgcagcctgatcgatatagatgtccgcagtgattttgaaaatatcattacgagaaacatcactcccaacgttccaaaccccgtatgctttgaatggataaccattaccgctatacgtttgaggatcatccagcattctttcaggaataccagttaccccgatatcactaaattcatcaaacacaacttcaacaaaactcgttgtattgtctttcaaccccgtaccagaaccaccgacaaagttttccatgcaaatctttttcatcgttgatgaatagatagctgaataggatgaacggtgagaatagttggttgtggtgatcgggatattaaagaaccgagtttcgggccacgcaacagaaccaattttcctcattgtcgctaaaaagttatcatcacttctgatcgcatcgaaagtataaaaacacacaattctgttcgctggaagtgaattcaggtagtctttaatcgcattcccgttcgtagcaggatcaccatacatatcaaatgatttgtaatccaataatgctaaagttgttccatcaatgactgccaggttaattccgcgagcaacttgtgtccgcctgttaataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgctgggtttgcgaagattttcacgttaccgattttgatatagttacgtacaaccagagtatcgacggttgaacccgctaccgctaccgccccgatttctgccggagtcggtttacgacccgcatgatagatcaggtttccgttgatcatcgctttgttgtaatcggtgatattgatgttgaactcagtcaataccttatcgtcaatgccagttaagcgcattttctggacgttcccagagaaatcacctgcctgaacatgtgccgtaccgctcacactggtaaagcgtccacccgtaccgtttacgctaactgacagcgcaccagtcatagtatcacccgctacgttgacataggtactgtcaagatgctgggtaaagtttcgggtgttgatcacggttgcagtggttgtgccgccgtcattactgattgttacaccgttccaaccattagttgcagcggttcgtaattgtaccgtaggcgttgctgtacttgcaacaaacaaatcacccgccgtgttgatgttagccagggctttaccattcagacgaatgttcgtaccggaatacgccattgtgccgttaccgacatcacctactgtcagaacgtcaaccagatccgttgtacccgtcgccaggcgatacgtgcttgcctgaacagtttcatgccagatcgtatccgccacaccaccacggaaggtacgaagcaagtttttggttcccgcagcctcaccactcagaacagtatttgcataaacagtgtttgctttcgcagactgattaatgttattgttcgtggttacggtgttgttaaccgttaccgcagcgttagccgtcagtgttccgttagtggttacgttaccaacgaagttgcttgtaccgttaaacgtgttatttccagttaccgtctggtttgcatcacgacgcatccagcttgcagcaaccacaccgcccagactcaaactattctgtgccgttgccattttcggtaagaagttttgcagagcaaagttcagaccgcgaggcgatacagcatagaaatcttcgagataatcgtcaacggcctgagtagaaccaaccagattatcaccgatgaaagtgtttgattgggtagtgataaacaccgcaccgcgtcgagttgtcgtcgcaccccacgccggatcagtaccgttcaagaactgcatggtagccggagtaattgctaggttagtagcagtacccgcacccgcttccgcgttagtcgcacaacgaataataccttcggcggtatccgtcgctttcttcgcttgcagtttcttaggcgtaatgaacacggtatccagaagacccgcatcagtttcaccctgagtcgcaacacgtaaagtaccgcgctgtgtttcagtagcagacgcaatccccaggttaatcgttgtccagatagtgccggactgagttaaaccgtcatcggtagcaaccgcaacatgacttgtaacgtcgaagaactctttcagcttaaccggaacaaccgccttattcgttaccgtacctgctgcaacttccgcagtggtagcgagggcaataataccatcaagtgattcagtcgctttacgatcgttcagcttcttaggcgttacagcacggagatcatcagttcccgtgtttgtttctgtctgggttgcgatctcaatcaatccgatacgcgtttcagtagacgttttacgatgcagcatttcaggagttactacgatcggcattgaagcagatcccgcagcagcaccagttaccacttcgttttcagtcgccagaacaaccagaccttttgacttttcggtcgccgtcttctcgttcaatgatttcggggtgatcagatcaacaccgttattgaagttgtagacgttcgtaccagcatccccacgtaaagccccctccgctgtcgtagcgcccgttgtaacgagtttcccgatacctgctagggtttcggtcgcgcggcgtgtgtcgagctttttaggcgtgattgcggtagtgtcatcagtaccagcgtttgtttctgcctgagttgcgatttccagcaccccacgacgatcttctgttgctgatcgttcgttcagctttttaggcgtcacgatcacgtcatcaaggaaggttgctgtcgtgttctggttaacttccgcagttgttgccaggcgagcgataccacgacgcgtttcagtagcggttttattcgccagtgtacgcggggttactgccagttcatcagacggcgtatcttcatggttcttgtttacttctgcctgtgtagccagcgcaatcacacccagacgagaacgatttgttggatcgacacgttcaatgatcgggcgatactgtgcaactacccattctttcgttgctttcagatatgacagttccatatatggaagatagtcagtatcggcgttgaaagtcagagtgtcaacactgaaccagtcatcaggcggataatccttacgctgtgggaactgcatcatgtttttgttggtgcggatcttttcaccggaaccatctttaactttgatcgtacagttctgcgttttccccatcatgtacatactgatatacacgcgatcaccttcggcaacatcttgcggaagagtcagcgttacattacgtacagttggtgggttgccagcaatcggagtgatgaacacgtaatcgttcggcaacatgttcaggtcatcactgatacgacgcagacgaacgcgctgatcaccgtcataaacaacccaacggttattagcctgatcgaacataaagataccataaccggaacgctgtgaagtcacagaggttacgttattgatgccgtcatagctgatcgtgtgtccgctaccaggataaacttgcagagtcgcaacgttcaccgaagcaaggcgatccagatcgtaagttgtgattgagtcaccatcgtttgcgtagcgaggcaactgcaacgtaattttacccgttccactgttacggaatgttaccatacccgcttgcatttggaaagcggttaaaccagtcgcattaacaaactgcgaatcacggttatcacgcatttcagcaacacgccataagttgccgttaaaaataaacgcaacggtcatatatgggtgagtcagtcgataagagcttgactgaatatcacgtaaacggatctgacgggtgtttgaacgcactaacaggttgttaacccctgcaagaccaccaccatctttaatagtgataatatcaccctcaacaggggcatctggcagaatataggtcagttcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttatatggcgtaaaagcgtttttctctttgtccgtcatttggaaaagggtttgaaatgatttgcgttgccttttcgtttgaactgcttctgtggtttcgataatggcatcgggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagtccagaggacaccgcaaccgctcggagcatttgacgcagccagggtaacgggttgtaactgaataatgctaccacgttagtatagctcgaatagaagttcaacccgtgcgagttgtacgggatttcctgcccctcgctaaacttcgatctgtatgtgttggtgcaatagatgaactgttcgccccctaaaagcgcctccacgcgttttttaatctgggtgtatactgtcgtcccagattgagagagatcgcccgtataacgcgaataatccccctctgcgagcacatgtattttaatgcgcttcgtgtttttatattgcttaaagtcaaccagcgtttgaagcggtgaatctttgaactcaacatcatgaaacgtttgtaggatcttccctgtaatcgtatctttgatgttggatgaagcaatagttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagcccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatgtatagagaaaaatccttatacaaatcaaagtcatcaatgtttttgagtgctgcatgagtgataaagatcacatcataatctttgacaacctcacgcagcgcatcgttattggttcttttggttcggtgatccgtgtccacaatcaccgctcgtttcccttttacctggttgatgtagtagtcataagactgttttgataacatcatggaaatcgaagcgatgattgctttttcgcccgtttgattaatatggttcagaatcgcctttgttttaccgcttgacggaacacattcaatcgtattaaagatcatttattcttagcgtatttcttctggtatttctttattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcagggaattgatctttaatctgcttatgaagacgatcttcgagcgcgtccaggtgagtaggagtgatgatcgcggtgttatcgcgttcaacgaatttctccatgtattccattgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatacacccgtaacagttatgaagactttcgggaattccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccactgaaaacatgttgcaaggcgaaacgcagcatcgcatcagatttacgtactggcatcggtgcgatgctcaacgtttccaggttagccccgaatgatggatcgatgcggagatcacgcagaggattttcctgtacagagcgatacgtgaatttagggatatccatcaggcacagatccgaaccagtgacaccagcggaaacctcttccggtgtagcgatacgcataacgttttcagcctctacacctttacccagattaacttcttctggttcttctggggtgaattcaccatcttccggcgttacttccttgaaccatttccatagtgatgcagggagttcatattcgtagccaccgtccatgataaatgcgcggtcttcaaactcaccgatcgaggtgcgatcaatcgtcacgtaacctttttcacggatgatgtttgcgatacctgttttccaggttttctctgcaaagatttcaggggatacggttaaaccgtaagtttttccagcgaataattccatgattacctcaaataaaaaaggggatgccgtaagcacccccgaattatattacttacttgccagcaatgcaagttttgcggcggcttcacgaactgcgcgagctttctgcgcaacaacttcgatcgctttctggtgttctgccagtgcgtcttctactgccagtgcagcttcgatgatctctttattgcgttgctgtgcagcaacatcaacggcctgaactgctggagcgtttgccggagctttaccagtaccgagttcacggaagaacttacgctcacgatgcatgatatacgggagagtacgatcttgtgtgatagatgcatcaccgtcgccgtcaacagactcaagcaccataataccgttgttatttttgatgtgttgcacaatgcgtttgttcgcggtatgagagcgcaggaaaccagcttcatctaccagaacatacggacgaccagcaacgaaatgtgtaggcatagcttcaaccgttgctggttgtggtgcagcaggttttgcaactggttcagttaccggagcgaggttaacaccaccatccagttcagaatccagatccggtttcgctggtgcaggtgcaacagacggtttgcctactggttttggctttttagcgcgttttggcgctggggctttagccggagcaacttctgtgaagtatttcgcttcccatgcacgaagggtgttcatagcgacacctgctggagcattgaaggtgtagcgatcaccgttacggcttgtgatgtttacaacaccgttcagcaattggtggatctgttttgattgaacactgttcgcaatgtttttgccgttgtcagtgaaaccttcgacatcaaccagcttgtaatctttaccagtttcgaagcgggtttctttggttctcaccgtccacggatgtgaaccgcttcctttggtgatgtttttcagtgggatcgaccacttccagcaatagtcacgggcttctttacgggttttgaaattcagaatcatgatattatctctcaattgggttaaatttatgctacgtggatatcttaacagaactaccaaccaggtcaagcgatatttttaatttcgatggaattctttttgaactcaatcattcgctgattatccgaaccgcgaaacggtttcttagtcggtagatccttttcgtaccgtccatcgatcagaacatcaatgaatggtaacagcttagagcgttctgtatcgccctgtaaggcttcgagggtgtaacccgtccaaacccacacatctttatcagggaacgtcgcacggacgcgctggagcagttttaagagcgtcggatgattggtgcggtaaaacggatcgccgcctgtaagcgtcaacccgtccacatggggatttgaaaggagtttaatcaactcgttttcagtctcttcggtgtatggtgtaccgttgcggggattccatgttgatttgttgtagcaaccttcgcatttatgattgcagccagtcacgaacaacactacacggattcctttaccgttaaccacatccatgttatagatgcggtcaaagttcatcagcctttcgcctctgggaacagacgggctttgatcgcttcgtcgataatttgcgggaattcattattcacgcgcttaacgatttcctgacgaaccgttacttcgaggtttttggttacgcgagcaataaacgcttcttcgtccgctttgaggtttccggttgcatcgttgattgcttccagcttgattgaatccagcaggtcggcgcactgttttttaacgtttgtcgtgatcagttctttgatctggcggataccgcctgaattgatatcgaaaacattgctgtatgcgtaacgtttctgaatgtaatcagcaaactctttatgcacaatcttttcgatttcgtgattggctggcatcatcaaattgacgtgcttgatcaccatgttttcgatttcttcggttacgcgcttaccgataacgctgtcaacaacgttcttgatgacagcggcttgcagatccattcgcgcttgtgttccttctgggaacaggttgttcagcgcctgtgtgtctaatttcagttgaatcattttatagtgcctttcttctcaaggatcagttctttgatccgttccacgattacggcgtattcccagttggctaacttctgggtatcacaccactgttgaaaatccttcattgcttttacgtgaccttctttccagtaagtcaccgcgatttcgttacaaagattttcagtagcagtatttttgattttcatgatttagcccctatagtttgttgtctacaggggcatattataacatcattcgtcgtccgtcaactcttttttgaatccgacataataagcatcagatccattccatgtggaggcgttaacgctacccaacagaacacgacaaggcatattgttatgcgcagactctacaacctgggatactgaatccagcggattgctaccggatacccagcggagaagatgacgatcatcactgttaatcggatcgacgaattcaaaacgaataccgctttcaatcagttcatgtagaagaaagttaatcgctttgcactgcgttttgttaatcagcataaatcacctaccagatctttatcaattttggtgtatgtgagcgccggatcatacttctccagcacgttctttttgcacgaatggatgaacttttccatcgcacgggctttcatcaacactttgaaatcttcgccaaagcattgtttgattgtgggaattgcacgagccgctttgtcacaatcaatgatcagtttgtactcgccttgtgtcgtgacaaccaccattgagatcagaacacaaccatcaaatcctttttcattgattttatggaagttcagcttatccgtagtgcttgccaggttcgcataacgatccccgcgaatgttacccggagaactataccgcgaaacgttgattgaaggaatacgaatatcttcaacgatatcacatgacgcaacagcttcaacgaaatcaagaattctggtcgctttgatgacgtgcgccttaaacgaaccgacttctaactcatattcatctttccagcctgaatagtagtcaaccgcagggctaatcgctttcatgagcgcttcgggaatgtcaatgtgccatagctgttctgcgtactgtttgcgccagtctggataagttttacgtgctggtttgaatgcactgttgccgtcttcgaacatcatttcacttttcctctctttttcgtaaatgtcgtacacacttcttcgttcgtaagcgtcttttaggttgctgtttactatactatcatgcgtcagttcttcgcaatactttttatcccattcagaacacgcatgttcaaccatttcctgaaaaacgcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacatagcaaaaaaggggctttcgccccttcctcttatttcgcgttcagggagtcgatgtaagcgctaacgtcagcggaggttacggaagcggcatttttgccacccagcaacacatcaatcttcgtcacgatggtatcgacgcttacggaagtgtggcctacagcggcgatcacgtcttccggtacagtcagacccagactttcggtttgcttgttcagttcgatgatctccaggttgattttgacatcagccagtttgcgatccagttcgacgacagagagatcaatctctttgttcatcccttccagttcttcgatcttcgtctgtaagccctgccagatgttacggtgttgcagcgccagcacgtaatgactgttggacacttcctgccccgccgccagcagttttttgatctctgattctttaccagtgtgaaggtttttgtgttcggtaactttctttttcagcttcgcgatttcctgaacagcagaaacgcgagtatgttgcagacggtcgatctctttgatcaggatacgtgcagcactgcgccatgcttcttctggggaagtgttttgttcgattgcagtttcaactttaccagtcacgaacgatacgagtttcttgaacataattttgccttatttgatttcgaattgattggtgaaccattcaggggctttaacaactttcccctctctgatataaccgattttacatagttcgttggttaagtcaagtctttttccacccgccatgtaaaattttaatctgcttactgggatcaccggacggataacgtcgcgatagccgaaatgcgcactacgtaccactatagagagcatacgcaagcggttgatgcaaccagtatacgaacgcccagtagcgcgggagaagtcctccagcgtaacgccaggggcaatagcacctatcagatcaagataatccttttcaacccagaaccgcccgacagaacatttcgatacaccctcagccatttttgcgtttgggtgtttctcgtcttcgcgcttcttcttgtcctcaaggaacttattgaaccgaatttcttcgagtctgttttctctttctacccgtgcgcgtacacgggagggaaacagagtatcaaggattttcccgatcatatcgttggctttccgtttggtagtttcagatcgaaaggaacattcacaggccggacggtttctaattggagatattgttccatccccacacgcttaccacctactttgttataacggatgttctttccgtcatagcctacagcctgtgaaatgtagtagtgtttagtttcgcgtaaacactccatccattcttgtgttccggttttgttgcgtacccgcgcctttaatggaaacatcattcaccccgtagaactttcagttcaccagacaaacgctgtagattggcggttgcagtatcgtaacgtttttcggtctgtttcagggtagtttcccgcgccttacgcaagaatttttccagatcacctggtttcgtcaccagcttaccatctacgtaaattcgtcccagcaggtgagaacaatccagcagttgttgtgcgtcggctttttcaacagcaggtttaatcgcgacaaactttttaaagaatccgcgatcctcgttatcaaacagatacgaatcttcggaataccatgttgtgccattggcatcaacgatcccactaacacctttccggttgcagtgcgttaccttgataggaaacacgacagatgatagttgattaggcgacagaggactaccacgcaaagctaaattgcggtacaccgtcccaaaactttcttcgtcacgaaattcaaaataatcttttgtccagtacatcatttttcaatacctcatagtttcggtatgtgcaatataacaaaagcccctcactttcgcaaggggctttttgattaattttgatgcttagttcggtgcatcatttctttgttcttaccgtcgttgaacccacggacagcaggagcacccaaataaccgcatgtacggcgagtgacgctcattttagccggatcgtgattaccgcagtgcttacagtggaaaccttcttctgtaggcgtgaactcgtcatcagagccacatacaaagcacttatcgaccggaaggttagttccgaagtagtccagtttttccatcgcataatcccagactttttccagggcttgcaggttgtttttcatatcagggaattcaacgtaactgatatgacccgcagtagcgatataatgataatcggcttcatagtcaattttctcgaacggtgttaccttgcggtcaacgtccaggtggaaactgtttgtgtaccagcctttatccgtgacacctttgacgcttccgaacttctcaaagtccagcttacagaagcgatggcagagagattccgctggggttgaatacaggctgaaaccatatcctgttttcttcttccatgcttcggttgccgcgcgaaggtactcaatgatcaatctgccgatattctgggagccgatacgatcgaatgggtgttggcctgagccaaacatcaacagcgtttcatgcagtccgatataacccagactgatagagctacgcccatttttgaacagttccagaatttcatcatccggtttcagtcgaacaccaaaagcaccttctgtgtacaggatcggcgcaacactggctttaacaccgcgtaggctttcgatacgagtcatcagggcttcaaaacacagttccagacgttcatcaaggatgcgccagaatgcgtcgtgcgcgtcttcttcttcctgtgcttctgcttcaatagcgatgcgtgggaggttgattgtcaccacacccaggttattacgtccatcaagaatttcattaccgttatcatcatgccacacgctaaggaaactgcgacaacccataggagatacaggaacgctagaaccagtaataacacggttattagctgaactaatgatatctgggtacatgcgtttagaagcgcattccagtgccagttgtttgatgtcatagttgcgatcctctggatcaaggttaattcctttttccatgaacataaccagtttcgggaataccggagtaataccctctttacccaggccgcgaatacggtttttcagaatcgctttctggatcattcgttcacattgggattgaccagtaccgaacgtaattgtaacaaacggggtttgaccgttcgcagtatgcagggtgtttacttcgtattcatatgactgaaacgcgtcgaaaacatccttttcggttttatctattgcatactgaacatcacgagggatttgatactttttggcatctttaaagtgtttatcatatgtcatttgaacatatggagccagcactttatccacgttcgcaaaggttgtcccgccgtactggtgagaggcaatctgtgcggtgatctgcgccataagagcggtagcaacaccgatcgatttaggcggttcaatatccgcgttacccatcttgaaacctttctccagcatacctttcaggtcaaccagacagcagttagtgtaaggggtgaacgggctatagtccagatcgtgatagtggatatcgccggaatcatgtgcttctacgatgtgtttcggaaggatatgattacgggcgaaatgcttcgctacgataccagccagcaaatcgcgctgtgtcgggaatacccttgcgtctttgttcgcgttctcgttggtgatctctttgttggtcagattcaccatgccggagatatctttgaacagcttgcttttctgttcacgggcaatatcgcgttcgtggcgatattcgatgtatgcacgggcgaccgctgggttcgttttcatcagggattcttcaacgagttcctggatacgggcgatcttcattgcgctaccatcacggatctgattgtactgaaccagcatgattgcggcatcagcatcagtcatagtcccgccagctttttctacagcaatacggattttttctttatcgaaatcgacgtttttaccgtcgcgtttttctactttcatttcgttgccttcattaattgctttctatattttgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacaccagaccggatctgctgaatttgtgcttcacaataccttctgtaccgttgcataggttacacagtaggccgcgcacacgtccggcgttttcgccgtctaaagcatggtcatggtcaaggtgatgtttctcgatctcgccctccaggggacgtttacagatagcacaacagcccccttgtttttcaaagagagcttgcttgatagttgggtagtcttttttggtaattcgtttcgtcagcataataacaccattcagtaaggtgtcattatttattacagggtgcggacgtactcacgaagttggtcgaacccgcctacgtgtttcccgtcatggaaaatctgaggcatggtcatccggcgcgtaccaacaagcgcttcgagttcatcgatcaccgcttcgttcagtacaggtttaccgtcttccacggaatccgcaacagacacgaactcatacggatgttttttcgcgtccagcaagcgctttgagttcaggcacggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcatggtgagtcacgttggacagtccgaacatgattccttcgctgtgcagttcatccaggaaagcatataactcacgttcgcgatcttcgttccagaacttgttatacactgcatcggtgatcaggtacggcggatcacagtacacgaaatcattttcacagatatcaatgtcacggaatgaaccactggaaaactcaatgcctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcaaatactcttctttcttgtctttccccaacccctttgatgcaatcaattctcgcaccggagacaggtcaggaagcgttttaagacgctcatacatatcaataagcgtcttatcgtaatcgttgcttagaacgggtttagggacgtttaacgacacactaaggccaccgcaaaaacaatcaatgaaacgcatgtatgaacttctttcggggaacagcttgaagagttcaggcaatagcgattgcttgttacctgtatacgggataacacccaaataactcatagaaaagattccagattgttaacgtatggctgaacacgaagaatagaatcgtgataataattctccatcagttcgaagcctttgaaccgtctgttggttagtatcgacattttcataactgtaccagaaccagagaaaatatcaagaaccaagtccccttcaaccgtccacgttttaatgtgatcttctgccagttgttcaggaaatattgctgggtgtttgaatgcaatctcgtccttcgttgagtgattgcgccctacagcgtaataccagatattacccttaattttatccttaccaacaggtttacgtttcttaccggaacgggctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgatcgcgtacaaggcttgacggaaagatgtacccgtttcactaccgttgatagtcgcgtcacccacaacccacacaaccacaccaccaggcgcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaataattttcacctaatttctcaagcattgcaatagcacggtgttcatcttttttatctttcaacagataagcaattcgaacaacctcttttagtgtcgcgttgtccacctgttccaacttgaacccgtagcccaccaacttacaaaaaagccccttgcgagcgacaaggggctgattgttgtagaagactaccgatccgttatcgttggcgcggatattaaatccttgctcgctcacggataacccctactgtatcggaggtgtttaatacaccgttgtcgtaatacgtaatcatcgcatcacgccacccgtcaggaatctcagtttccagagtatcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggtccgtggatctcgtcgccctggatgattcgaactgaattatgcagaactttgtaacctttgctgtttacggtgtaaccgaagatttcgcccagtttacgcagggtgtacatgatgttatcaatcatatcaccggaatcaggacgaacaaccagagtaccacccgcagcaatgatttgctctttatattcagcgatgcgatctacagcgcctttgtagtcccaggaatcgtacacacaagcgtagaaccctgtaccgaacatttcgatgctgtttttgtatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcatgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcagcaagaacccgcgcaacgaagttaacgccagcggttactacttcatcaaacttaccaccgcgagattcaatatagaacatcgctgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactctttgcacgtaggacaggtgatcatggttcctactttagcggcttttgcaacatcgtacaattgtttgatgtccttctgccgctcggacgtaatgacacgcccgtttacttctttgacaaccgtttcagttcgaatcgaaccatcggaatatttaacaggagttttgacttgcttcggcgcatttgcttgttgcaaaagccttagagtttctcgacgtaaattatgaccacaaaaatcatcatcgtcatcgtcgtagccaccccagctatcaatatattctgcttcactcatgctcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttgggttagtgtcttgtctacgggagctatattaccacactcataactcccgtcaacaagtttttcgaattattttcaccaggtgatgtaataagtcagatcgctatatccgtcacgcttaggatcgctaaaattggtctggatacgacgcgaacccgcgaaggtattgagtaacgcagcttgtcggttgcgctgtgtatcgaaagtaaacccttcttccgccagccattcacccagatccgcatatgctttttcggtacattcctgatccataaccttaccgataaaacgtttcatatcaaaggtatatgattgtttagtcggatatttcaggacatactcggaaatgtctttgcgggatgcttcgaccattttcgcgttgatttcgtcaaccagtttacgcgcacgttctgccagtgtcgggctacgtccacagcggggatcatcttgcgtttcgcgtttgacccactgtgtcccgcttcccgcctgtgcgttcacaccgattccattgatttctaccattatgtttcgccttttttaatgcctcttcaactgagaggcgttcgtaattacgtgattgttcgggagttatcaccagagaaaatccagagtaggaggtttagtgttaatccctaaagtatcgcagacttcatccagaactttttgattccaaagattgaacgttggaaccttatacaatctggcaagccttgcagcgatcgcagtaccacctttaacgcaaaaatctttctctaccgcccagaatagaacaaaatctgtaggtttgtccaggttttcggttaatacctgcattgaattgcgagcgtatcggcgttgtgtccattcgctttggttgtcgaagtgtccagctacctttctcgcttcgtcagcggatttgtacgtgtcgtattctgtatagtcgatgatatccttaccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagttttaaaattcattgttcaggattgcgccccagttctcacgaaccagatttgacgcttcgttagtgaaggttttcttcgccagcgttggattttcgaactgttccaggaaaggtccgtagttacgttcgatttcttccagcgcatcctgtaccgtcagccccatcacgcgaccgaaatctttcgcggtgagattcgcgctgtcaatttttgacagaacatttttcacacggttttcagtcaggtagcaggtgaattcgttcagcttcactttgtctgtttctgacagttcagaaggagcattgaagcggttcgcttgcttgttcttcttctctgtgaacttcgtcgttttgtatttgattgcaacgcgttcaccgttcggcatgaaagcgggttgaacaggcttcatcacaaaaccttctgcgatgttctcaccttcaccatctttcagcgtcatgaagtttttgaactcaggttcaacgccgttctttgcagggatcgcgccggagttcgccaggttaaccaccgaatcaaaggtgataggcagtgtgcggatctcgtcaaacgtaccgtatgccagcagtggagccattttcaagccaacagcaacagcgtaattcgcaacaacgttatcagggaggaactgaccattgacgcggatatcgaatacatagaaatctttttctccgtagtcaacatctttctgtacaccacgccccgcgaattcgccgtatacctggatcaccagttcatcgctatactcaccgcttaactgacgcgcagtagagatcatttcccacatcttacgaacaggttcggagtatttcgcaactacgggttcgcaaccgtagaactgttcagcagggagaatttcaccgctacgttttgccggaatgactttgataccgtccgaagtgatcaggctaaagttagccccgtggatcttttcacgcgctacccacacgccaccagtcaaaccattcatgatcacaccgttaatgaatttaccttcataatggttagtcagagaagaatatttcacaaacataattaacccttgattttcagttgtttttcaatttgatacgcggctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaacggtctgccggagtaagaacatacgggttcactcattagcttcgcccagtcgcttaacgtcagagcaaattgaaggttgcggttacgcgcatcatcgtttttactgttgtatgaacgagcgacacgcagatcgaattcaatttgctttgcacggcggcggtgttctaactcagcaggatcgagtgataccatagtttgaactttttccggttctactggctttggttttgcttcaaccttcaccaaatcctttttgatagtcgaagttatcacgcccgaccagcgattcatcattgaagacatataaaccccttacaccaaacccgcttcctggaacgccagcgccatagcgccgttgattgctttacgtttgttatctggacgcggatcgcgtttagctttggtcttaggtctacgctgttcttcacgatgtttgttgatatacacacgacgcagaacatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacatgaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcataccagcagataacgcggcgatgtcgatgtttttcatcccaccatacacaacatgaaatagtttcatatgcaactaacctcattttcatatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttcacgatggaaatagatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatctccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtaaagaaaacacgatccagatttttctttctgcctttttcagacagagtatcagaatcacaaggaggcaacaacatgctttcgattccggcagcagtacatgatccgtgatagaactcaacgaactctttgcggcagtgaatggtattcatggttatctccttgttttcagagattacagcttatcgctattcgccagacaagtcaacaaattctttttcaacgtcttctttcgttctgaacaggtaatcagtaaggctacctgtcatcaattcgcgagctttagcaactgaacgaatacggcgttcacgttggctttcaatatcaccaattccgtgacctggttcccacccttccaaatccaacatgacgcgcgggtgcatcatcacacgaatatcgtttccatatgaatagctgttatattgcccgaatacaaatcttttgaatttttcgtggtgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgagcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcttatccgtcgaacaattgcactataaacgcactcataaaccgtgtcaataaatacttttaaataaacacctggagttctaagatgaaatcattcaaagactttacgagccttgatgaagcgctgatcaccttcggcggtaaggcttatcctaaatttggtcaggtagttatcctggctggcggtgcgggttctggtaaagggttcaccctcgaaaagctgttaggcatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcatcgacagcgaaatcaagaaatctgacaaaggcggtatgtttgttgttaagtctaactacatcaaagttaaggcaaaaggcaagccgcaaaaatccattgaccagcttgataaagagttagtggctaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggagacccggcgagaatgccggaagaagaattgaaaaaagcgaaacaggctatatcacaaactgacttctacgaaaatctggaaccattacaagagggcatcgacttgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacgacaacatcaccttcactaaccgcatgaagtttaccaccaacgatagaaccatgaccagaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttacgggattcgatgaaatcaacatcggtgtaatcaatatacgcctgtttcagtgtgtcgaattctttcgcgtatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctcttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggcagcatatcggtatcgtcatcaaggataaggtaattcttacatccgaaggtgtcgatccatgctttgatttcatcaccgcgtccagcttgtcggtctgttagattcgtacaggttttcccaataatgcgatacaatccccacgggtagaagatttcccgtagagtatgggttgtgttgccgatcctccatgtagaggaaatgacaatatcacagttcgcatggtttacgatccggcgcaggtgtcgagcacattcaatgtccatatgctcaccaaatttcatgcaccgcatattatttagaacgccgtcgatatcaaggaagatgacgtttccgatctctttaccttctgataagtctttcaggcattcgtgatttaattcagtcatattttacctacaaaaaagggggcgtagccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcgtttgaattgactactttcttcactttaccatcagtccaaacaaacagaactgggtaataagcgtttttcatcatttcgtttttcattttgctttccttcttcactgcgagagccattcccccgccttcgagtacaaatatactttaaacgagggtatgagtcaacaagttttttagcaaaaagtgctaaaacttaaatgtttcgaatcggctatttctggtttcgcgaacacgaacttcaccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcaacgatttccggttcaggggaatcgatcagcagttccggtttttcttcatcttccggtaaagcagcaaccagatccgccagcatgttatcgaaggatttttgtttgttcagcttaacagcaaacacagtcattgcgtaatcagctaacgcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaaccgaggatatcacgcaagaagattttaacaagtgggttagcgaacatccggtttatgacggcgacaaacagatcgatccgtactggtatcaacgcgaatccgtgttccacggtatcaagaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaggacatcgcaaactatcgtttgttcccgaaatcggcaatgctgggtatccgttcaggtacagcgaaaaacagtaatgcactgatttacgtttccacctggcaatcagcggttaaaatgcctgccgaatggttccaacagttcatgtgcttgatggttgatgaatgccacctctcaacaggcatgagcatcaaaaagattatcgacacgatggatcaatgtatcttcaaactgggtttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccaaccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaatcgcggaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgcaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaatttcggaaaccgtttgttccgacacgtacatttattttatttcagtgctgtactattctgaattacaattaactggcctttactcgaaggtatcttaccaatcaccccaccgaaagtaaattctatcggacggcgcaaatgggtacgccacacggtaagcccaagccccacaaggggtacacatctatttactgctataaatctgggcgttcgtcttcgatacaaccgctttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcgggccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacggaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacccagtttaggtaacttaatacctacgatctgactcagcttagatttacctgcaagagcagaccaatcatcacctttgatcaggtgatcggattcgctttctgctgtgtatgggttcacggaaagaccgtaacgcatcagaatagcaactttcggttgcagggatgccggatctacggatactttgattgaacctgcttcatcagcttcggtatacggagcgaagaacagagagcctacgtgatccatatcacccagatcatatttgcaaccagtcagcatataatcgaacgggctgttggtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattgatacaggatacgacccaatgctggagcatccttcgcggtgtatgcggtagtaccgtcaaaaataccatccgtaacgagtccatcgacgttgtaacgtttggaaacggtgatcagtgtttgaataatgtctttgttgacttcttcacttgccacggttcccaggatgtcttcgatcaccccatcagcttcgaactggttcgcttccaaatcctgcatcagttcaaccgtcatttcggttttaaacttacgcgagcgtaccggaatattccagcgatccatctggaaggaggttgacgcgatatcttcgctggtttcatacttagaagtgtcagcggcttcactcaccagacgaattttgctttggaacacagctttcatgatcgcggtgtctttgtcagtatccagagtgttcagggtaatcggtgcgataacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccattagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgaagactgacgcatcaacttgtgaattgtgtagtgtttatcactcatttctttggttcctgaattagagggctttttacctgtatctatttacaccaacaaaaaaggcaacccgtaggttgccttttagtgtaaagtcgattacagacctttaacccagaccttacggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcacgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgacaccagtttcctggaatacgtgcttaacgatagcgccggaagcgatagcaacaccagttgcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcgatcaggttaggaatcgcacggcgaaccataccgattacagcagggccgatgttggtgattgcaccgctggatttaccagaggcaatgttggttgcgtcgtaaccgtggtcacccgcgatctctgcttccgccaggaaaccgccgaaggattcaatgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacagcttctttgttttcagagagccattcctgcgcgatgtggtcgaagtatttattcgcatcttcgtacagtttattttcgatttcgccagctttttcggcaacctgggcttcaaccagttcatcggagcgttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcgttttgcttgactgagattcggtaatcggcttaacgtaagcatctggagcgcttggcccccaaacaacatcaacgcctaccgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccataatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttaactttttcggcctggaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgctcgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgctgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttcccaactacaccttcaacctgtgacatcaacgttaggcgacgttccataatctcaatatctttcacttccgcgtaatatgaatcctgctggaaaatgaaggaaattttgctaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcaccacccccaccgatttgcatacccccatcatcgcgaggcatacggcttaaaggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgtccgttgtatgtatagccatttttaggagcgctatacacgaaaaattcgcgataaccacggaatactttcacgccaccatcgagggtttcagtgatagattcgcggatcagttccatcgaacgcggatcgagttgacgcagttcgcggatacctttgctttcgtctttatgcatgattttatggaagtagatacgggaatccacataccaatcacggaacagacgcgcacccatgttatcaaaatcatagatatttagaacgttatcaaattcttctacgattttgtcctggatcgccttactaaaatctgttttggcaagatccaaagtaatgatatctttgccctgttcattcacgatagcatcgtcaataatttcagaaacagcgttttctacttctgggtaagacatgataccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttatagcctttattcccaccagtccagcgcgaaagtaacctcaaaggttgacacttcgttgttgctgtcccagtccagggtaacttcgcctacgttagtagggaaaagaccgtgaatggtatgttcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgcgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgacgttatacggcttgtggccctaccagttcatcgaaatctgcgcccgtagacgttgctacgaagttcagagtgatgtagttgatagaacgaggcggtttcacgtagatcgttgctacaaactcgttacggtcgattacgtccggcgtgttgttcgtggtgtcgcagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagcaacgctatcagtgtaaacacacaggccagcgatatcacctgccagcggaacccaacggttcacgtcattgtatttatcatactgatatttatagttaccatccaggaagccataacttgaacttacgttcaggttattgtcaaccggagtaccaccactgagtttatatccagtacgccattcaatgatgttatcaaccgctgttgccagtggaatattcaccatcagagagcgcggaggcgacacaaacacagtacaatcctgacgttcatcaccgatagagataacgtgtttctggacggtagacatgatctctacagtttcaccagcacacgcaccagcaatcagcagaggtacatgcagcgcttcacgatcagcgaacatatcccaaccagtcatcagttcatcagcgcctacagtgtcgtttgaggacaaaccaccgccgaactcaaggataccggagaagcctttaggccagttcagggaagtaccgtaaacgtactgagagccaccgttagcgaaaaagtcatccatgaagatgtttacgccgtagatatctttatcggtcttctcagttgacacgatgaaggattcctgtacaatgccaccacgacgcacaacaaaagcgtactggttatcggtctgtggcccgtaggtcattacagaacgaccgctattcttaacggaaaccccagaagggtagcctgaaatcatagcgccagaatcgtaagcagctttggagataatctccacctgaacagttgaacccagttcaccaggatacagagccacgacagacgggatctgatatttctgggtaagagtctggaatgcggttccctgaattgtttcttttgcaatatccaggttcaacagagtgatccctgaatcgctttcgatgccgtcaatcgtaatagacgcagaaacaccggaagactgagaaacaatttcggtagtccagccagtagaaatatctgggtaagtgccaatctgtttagcacgggcaacgattttttcgcttgggatgattaccgcgaggatcttgccgttactgtcaacttcggacactttaccgttttcttctacaacaacgctgttgtattttactttaattacatcgtttacagtgtagttagaaccctgtgatgcgatagttgttttgatctggttgaaaattgcgcttgcgtttttagcggcatctttatcgacaacgcgaaccacacggagatcattaccgtactgcaagaagttaacagcactcatgaaatagtcagcggtcaagttgtctggggaaccaaaatagtttaccatttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtctttctcgcagaattcggcaaatttcatttgagttgtaagccaaccgaaacaagcaagcgacataacgaggtcatcgtgatatccttcttccgcagcccacgaaacgcctttttctgagaaagtacgaaattcgagtattgtctttttgttatttatgatcaatttatctttctcgatcaggtctttcagcgtcgaacatcccatagcttttgatcgcttagtctgtttcatacccagatcgttgtagctgtcacaaataacattctcatattccagttcggaaaacagagatttggcaactgaatgccctgtgctatttagctcaatgtaaatccatgcctcgttatacatattcagataacgtaacaggatatccggcaaaataagatgcgacgttttgtttgagtgatacaccgcaacctgttcaaatggcatcgtcgtaatgtcgatgatatgcattgcatggtaatcctgtccgcgaccttccgctggatcaagtaccgcaacatatttatgcccctctactggacgtttatactgatagaagttcgtttccgtttcatcaatatcaatccatgtgagttttgacaacttccagccagcgatcagggttccactggttcccatgaattccgcgcagtgttcctgcaaaaatgcctctttgctggagccagcgatcatcttcgcagaccacgaataaccgtcatcaaatgtaccgttgtcgccgtctgtatacaatcgctctttaaccgatgtccagatcgccgtgtaaggcacgaaaccggattttccttctatagcagcgttccagatatcatagaagtggttaagcccgttaggtgtcgttgtgataaggattttcgatttacgaccagaagagattactggttgaatcgctaaccacgcatcaacaaagttcgggataaacgcgcattcgtcgatgtagatcatcgcgaaggagttaccacgcactgcatcgggagaagatgcaaacgcaccaattttacatttgttgtcaagttcaatagaacctttgttccattcaacaataccaggctgcaagaagtcgggtagtagttcgatcgcctgtttggtacgatccagaacttccgcagacatcgaggctttgtgagccagcacaccaacatatttatcttcgttgaaacacacgaagtgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcccttttcagcacctggttttgtagtctcttccgtaatctcacgcatttctttgtgaatcttcatcaggccaatgtttgaaacgtttaactgattcatcaggcttgtgaatacctcgacgtggcgaggcgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacgtcaaccagttcaagtttttcgtaaacaaccacatcctccccagactcaacgccgccagggagggaatcaatattcagcaattgctgcaaatctaatttttcatccattctcattccctcggcttaggaggttcatcaccagacgggatcggcttatcgtgcgagtacgtctgaatatattcttcgcccgtgtagtcctgcataggcaaatctaccggatcggcttgactatccacggattcgaagttatctttatctaacgggttcatgttagagaagaaatccgtgtaaacggttctgatttcgcctttaacatcagttacaggcgggtacagataaccctgtaattcaaacatgaatgaccactcaacatgacggcgttgtgatgcttcgccctcgaatgtggtatccggcgcaaccgactggagactgattttgatgtctcggtcaactgtgatttcgttcttatgcagttcggtaatcttgcagttgaaatgcggttgaaaatacggcaaaatctgttctgcgatctggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaacctttatgtatttttcttgatcgccgcgtactcttttaacctgaacgtgattaaaaagcgcccccatcaggacgatataattacgcagcgaactattataccaataaccaaacattttattttcctgtatgggttgttgggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagcccgtcaagatttcggataggttcgagatccagttctgcatcaggttcgatgtggattccttcatttcgctgcaattcaggagccagttcttcacctgtgtagatgaatttcgccaggttgattttgcgttgaggacgatcaccgaactgatagaacggatcggcttctacccacgtaatttcaaacaggctattgtccatagggaaataaaccagatcccccagaacaggaataccaccatcagtttgatgtgcgaacaaacgagggttaattaccagcgtcatttcatcgtttgaactcagaccaaatttactaaagaaatctcgttgtccttcataattggcatatgattcaatatatgcagcaattttccatgacttcgtaaatttggattctcggtcttcgcccaggatcttatcaatattcacgaagtcacgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattattccccctacaccataatgatcggtactgcgtcagacatagaaatcagttcatcgcgcagactttgcagtttggtttccgcttcctggatcagtcgcgtaccatcaggagcaacaccgccaggcaattgcatcccctggaatttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcgcctttgttcacctgcccccatgcgcagaactgaccagtatcatcgttgaaccagtaatcaggcagtggagccagcaggtcttgcattgagcgttgataggacatcatctgggtaaagtagcccatatccgcgccgtatgcgttcataccgtacacactcgatgcacagcgcccacccagagagccaccagtcaaccccatcaggaaatcggtaaaccacggataaaccgctgtaccgtccattgtggtcaatgaacccatgtttgtacgcaacaccttcgtgatcgcgaagatgtgttctttgctcaagtcgaacacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattattcgtaatcatatgatcctcaaaaggggcttgcgccccttgttaaaattatgctaccgtcacagtacattcagcggaggtgatggtcgccggagaagtcgcggaatccgtaacttcaactttgtacacacccgcttctgctactgtagccaggcttgcgccagtttccccagtaacttcaaccgtatctttaaaccatttgtatgtatatggtgttttgccaccagtaacaacaacggctaaatccatattatcgcctgttgtataactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagacttgacgatagaagaaccagtttcaccactcaatacagatccgtctttatgccatacgtaagtgtacggagttttaccaccgctaaacactacttccagagtcaatggatcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttctggatcattacactcggtgaatcagtcccgatatttgcggttcctttcttccactggtacacataaggcagtttaccacctgtaacggtaacagataaagaaatatcatcaccctcgatataatcgttacgaccgaccagattttgagtaaatgacagtggaactttcttcgcttcgtatttgttatccgcttcaacttctgtgatatacggaaccagagcatcagcaacatcctggcgagaggctttattctgttccagatcgtccagacgttgttcaacgttaccaccaccgccagcttcgagagcagcaacacgcgcagtcagatcggaaatcagtttataaatccctgtttctgatcctgtagtattaacgccgatcgcagttttgttatcgcgagccgttttctgaataccatctttgaggaatggatcagaactggttgcatcaccataaacagctttacccatcgcgatattagccgcaacgagtccagttgacgtattacccacaattgcggtaacatcaaccagtgcctggtgatcgtcgcgctgtgtgttttccacattcagcagacggcctttgatgcttgttggctgggagtcagtaccgatatcggtcataacctgcgccatttcaccgcgcagaccatcatcacttgtttcaccaacgatcatattcagatcgctaatgctacgtttcattgtgctgatatcgtaacggatactacctggaacctgtgagttaccaacagcgctttccagaaggattacgcgaggcagaacaccaacaaccggatcattcatctgggtttgcagagtagtaatgttcgtttccgcagtttccatgcgggaatcaatactaccagaaccacctgagcctgtacgcccgatataagtgttgatgtttgacagttcggtattaataccagtgatatcgccaccgataccattcagacgaacatacacagattcgaaagtggctaaatgcttcggccccatttcgttacgcagatcggtaacttcatcggttaaattacctacatctgagtttacccagtcatcttccagcttagtaatacgtgcttcatggatagataccgcctgagcgttagccattaccttgtatttcacgccggagccagtagaggacggatcaacatcaccatcttcgttaaagccaggatatgcacccagttcatctttcaggaaaataatatcttttcgaatggtacgatgtttaggatcggttgacgcatcccatacaccaatttccttttcgatatcctgaattttcagggtgttgtttgctgtagttgcctgtacagcagacatatctactttcagcacgtcaacatcagcgacaactttatccagtttgtcgatcacactatcatcagagatcgccgcgaggttttcagtaatgaggttaacctgatcgataacttcgttgatttttgatgtctgggtagttgtatttgcttctaattgtaccgcgttcttttgaaccagaacaccgcatctgtttaaagaaccctcgttagtggttttggtttttgcaccatcgagagtttcgccgttaacaatccaattgatctgggtttgtgtggtgtccgcagggacaccatcaacaaacgggatctttggtaacgggttaagttttgaaatcatggattaacccctttatcgtactcgaattacgtagttgaccgcaaggtttttcattcgcgtttcatttccgccagtacctaatgctttgctgtaatcgttattcaggtgcataacacgttggtcatttttttccgcgcctttcagttcataaactgcttgactcttaggaagattaccgccgttctggtaaatcatctggagatcatgttcgtgatacgcaaacatatcagcctgatatgtaccaaaaccgcgacctgcatccacaccacgcccaccatcaaagccgcgagctacaagaccgcgcatatcaggcaagttgaaaatatcaccagaaccgccgtatgtataaccaattcgggcaaacagttctgggtttgaattgcggttcattgctcgcccgttacagataaacaagttaccaacatcggcgttaaacgctgcaagcatcatacatccgatcgggatatttgcgtcaacatctgtctttgtctggtatttattgtcagcactaatcgaaccctgatacaatgcaccaccagtaattgcactgtttttgttgctcggtactacgttagcaccagcagacaaagcagtattcgctaatccggtattgatatctgttgttaatttaaccataccgaaagtagagccggaacccttcacagcagcgagtttttgcggggtgatcgctttggtgttatcagtacccgcgtttacttctgcctgggtagcgatacggagtaaacctaaatcactttcgcttgcagtcagacgaataaacgtgtatggtgaaatcgcaaacccatcgcgaatagtacccgcgcgaacttctgcaacagttgctaactgaacaagaccaaacgaactttctgttgcgtttgcctgtaccggaaccagagcagagatcgcttgcttcactttaagcggagtcattgcggtagtgtcatcagtaccggatgttgcctgagcagttgttgacagtttcacagaaccccaaacgttttcttttgcatggcgggtgttaaacacatagttcaacgagcgcggagtaagagaaaccagatcgtttgttactgttactgattctgcatcagttgcgtaacgagtgtaaccccatacggtttgtgatgcatgagggttttgcagacggtattccagcaaagcaggagttacgatcgtctgggtatcagtacccgcatcaatcattgcctgtgtcgcaatagcagcaataccgcgcacaccaggcgcggcattaggcaaaccaacatcagtacgcgcccacggcccaatagcggctaatgcctgttgtacgttcttaaacgtgctaggccattgcgtaccagcaggatcaaatgtcacgtaaacggatttatcgcttacgtggttaattgtattgttcatttgttatcctcatgcaatacgcttgaaataataaatcggaactgctggagtaacagcaaggtcaatttcacctaactttgtccatgtaccgtaaccagatttagcctgtacgtcgattgttcctaccatcgaaattccgtattcagttttattagtaaccggatgcggaactgaatcaataaaacgaacttccagaatttccccgttgagacctttacgagtaaccaaatcgaaatatttttcatcgttgacgaattcaacgaatttgttatagactgtctcacatacggtagaggcgttcgttgtattgtcgaaaacgaacgggaaaccataaacgtgaatagtcgcctgtgtttgatctggatctgggtttgaaaccgtcccatcaaacgtaattgattctacctgttgcaccgcagaaggggggctatcttccgtcatcatgattaccccattgatcgggatctgttgagacaaagaatacaggtcatcaattgctgattgtacgttagggtaatctaccccttttcgaagctgatcgacgtttgcaccaccaatagtacgtttaccaccaatcagcggttctttcgtacccatttcatattgcaaaaagtctgcttcacgggaagggactttcgccccctcccttgttttggaaataaactgagtcatttatgctacccttatccagcggtgaacagtaatataaggcgggagcgtttttagtttatctggagtagtgttcccccgatttacttttaatacatcctcgcggtatttagtgtaacctggccctgttgcatctgggtcaacctgacagccaccaataataatgatcccgttgtcatctttaatcaacaccttatcggttgactgaatttgtggaacgttgatcggtttaatttcataaccacgttcgccaccagtaccaccagaagtgtgagttggttgaccggaaccatccagatcgttattgttcagaccaaaatcgctatccgatgcatcggttgtccaacctgcaaggaacataccttccgcgtaacgtgtccagataccaaagcccatataatcgcctgggttagcatcattatgcgcgttttcgtagattgtcccgattgggtgaataacatcaaagaacgcttgcagatccagaagacgaccgctaaatgtatccgctactttacgcgaggttttctgcgttgggttgttataatcggtatattcgatctgattaaccagcgtcacttcttcttcgttgttcaggtaaatcttatcggtgtgttctttaataccgcctacaccgtcccattccattacagtaccgatatcattgttgaaccagcgaatagttaccacatcacgggattccagaggttgagcaaatttaatgccagtaaccacggagtcaacaaaaatcagactgtaatcctgtccagaaggaacccacgcgccggagttcgcaatacagctatcttcatcataaccttctgcgccctcacaaacaaatgtcgggagatccgcatcgcctgctttaacaagctggcgaccgttcagcagcagttcgaacgagttcgggttaatcaaaattcgcggactgataccaaattcagcattagtgaacgtgcgtttgtttggtagatcaccaacccagatttcaccagggatactaacctgttctgtgtctcccgtgttatatacgcgcatggtatgcgcttcatacgtcgctcgccatgcggcaataccatccagataggtaacgaattgaagcgtgtcaccagcgttacacgggtttttaagacggatatttacaccatccagatctaccagttgtccggcgctcgcaccaggtgaaccgtaatcgctgtttgatgaattaaacccgttcttgtcgtcgatgtacagcaagttaccgcgatagtaaacttccagtgcgcggacgttgtacgagttaccagggccgaacacgttcaggaagtcagtttgtccctgagtcgcgatatacgtttctttcgcaacggttgccagatccgaagttgtgattttgtcaacctgtttgttttcaacatattcccaacgtccaggagaacaataaacaagttcaacgtccatcaggtctttgtacagttctttgtaagtcggtgagcctttgatggtatcaccgcttgcagggacgatacggacgttgtttaccgcccacttaccccatacgtcacgtaagcgaataaccttgttataatcgcttacactgcctttagggaggtttaccgtaatacggttgttgctggtattcagcgcccatgattcaccgaaaataggggtcagcgtaggcgctgtgtgcgttttccacgcacccgctgggtgcgggatactcccgtcacccagtttattatataactcggtaaagttggcgttagtcttttgaccaccacgacgcagataatcacctgcgccgtcatcaaccacgttaccgataagaatttcttgtttcatgctgcgatccctgatttaatggtgtcaaccgctttaatcgagaatttaatgcgatcctcggttttggattgtacgtttgcgtaaacaatatcactcgcaccaacagtgaacgtaagcgtgtacatttcatcttcgctatttttgagaactgcgtattcagttgaatacacgcccttagcgacacggtcaacagacaaaagaatttcagccattttattgactgtgcctgtcatattctccgcgtacacgagaattttcgccccactgaattcactataaccaaataaaggaattgcggtcggtgatgctttcagaatgagtttagtagtatctacaggcattgtttttgaaccaaacattgattcaacagaataatcccatgtagtaacggaaccttctttcttcacacaccagattttaatctgagtatatggagaggtcacgtaaagttgatcctgaacccctttgataccatcaccaacttgcggacggaatacaacaggacgatcaacagaaatactaccgttactatttatgaaatagaacccttcgccgggtttacccgatggaagaacaacagtaattggccctgttgaagtatccatatcatgcaatgaacccagttcgatcgggttgcctgaataataagttcgcggtaatttctggaaatatccggtcgcgtggagtaacattgtacccacaccatcattcgcagtcagtaaacgcacatcaccaaacgcgttgtatacgttggtgatgatttcgttaagtttaacaccgccgtcatacagcgggtcaccagttgacgggttgccgatttgccccacgtcaattaattttttaccagtttgatatgccattatggtttccttagaattcgaaaataatactgacttcttcggtctgatcaggagaacgaataatcggttgacggttttccatgtagatcatttgtcctgagtcaagttcaagctgtcctttcgtgtaatactgccccgttgcttttacttctgggtcggatggttgcgcctttttcaacagcggatttacaataacgctgatttgacggaacccacggttgccaggtaaagaggcttgcgggaagaacagggaatccatatacgcgcggaatcgcattgagtgaaccttcattcggtacaccaaatcgtacatatcaggataccatttgatcacgttatcataaccccaacgaaccggatcttcttcaagttcatcagggaacggaacaacgatatgttcatttgtacagcggttgataacaacatctggtggaattgtatacagatattcccagatatagccgtcgcccatgtcgataccgttcgcttccccgcgcggaggttcgatcgattcgtgggtcggtgtccaaatgccaccaatgcgcacacattcaactttacccgtgatactggagattgaacaagatccaatatcaggaacgtctacaacgcggtataccatccatcctttaccgtagtcagtacggttataaggcgcggagtttacaaccacgatgtcattaatgtaaaagatttttgggtttggatatcgagtatcgccccagtctttacgcggaacgattgcatcaatcatttcgcctggtactttcgtcatcccgatcatatgcgtccacatatcaacgataccatctgtatcatcgttcggataagggggagcgaattcagggtcggattcgttatccgcccattgttcggtacgcccgattgacatataaatcgagttatgatcgggggtgtccccgatcatttcgcgaaagttcatcatgttttccgtgcggaacttaccagttacgaccgcacggtagatgttttgttgagccattatgctacctttctctgagtcggtggattcggatcgcgaggattacccgcgtcgtctttcaatcgtttttccactaagttacggaactgagagtatttaaccgctgaactatcgaacagaggactttgatcaaatcgacgcgcggacggcagtacaccattcagcggtttttcatcaatgtcatattgtggcggaacatcaaacggttgtcccgctttcgggtgcgggtcgtacaatgcttcaccagttacaaggtcaaatgtctggtttccgttaccgtccagacgtgctacgcgatcaggccaatacttcggataaccgctatcgaagcgataatttcgaagaatgtcaatgatcgtttcactatgcgtcatagacaaaccggagttgatgaacaccgttagcatggtgatcccgataaagccaaagcctaccggatgcacgaatcgtaaaacgtcatccttataacgggacgctggcagattcgaacgaattttcatcacgtagtaagaacgcccacggttgaagtagtcgatcgagttgttcgccatttgcttaccacgcacaccacgcagaatagtacctgtgaagttagtcttttcagacttgacaacctgcccttcaaggaagttaccgatcacgttgtgcagcgttaccgaccaacgtaattgaccgtcatcatactggcgttcgatatacgtcacgtttgctctcgctgttggtgtgtaaatcgtccggcctacaatgtcctggttgatatttgttgaatgaaccagaatatcatattccagagtgttcgaactttcgatttctacacttacatcttcgttatacaacagtttgaacaggaatttatagcttgcttcgatgcctttcgttgaatagaaatcactacaacgagattcaaagaaacgaaccacctgatcacgcttcgttttatccaggtagatattacggcggtttacttccgaccacagatattctacgctgttcttctcacgcggatatttgttcctgatcaggttcagcagcttgttatagtaggtgttttcacccagcgaaacgaactgcaaatagtattccccgaacttctcgaaatactgctgttccagatagctttgaggcgcaaagcgcgtaatcatatggcttaaatctgggtcaatcaaaccaggtgacagatccggttgatacggtttttcgcgttcctgctgaataagatcggcaatcaataacgtattgtctggtttccagaaaatcgttaagttatcgcgagcgcggtaactcagttcaaagaacccgatgatttcgcctgaactcttatacagcaacacgccgttcgtatactttgtgaatccggtaaacttaatgttgttaatgtaaatcgtaacatgtccgcgatcccatacctctttgttcacacgaagcgatgacgaaggaccagcactatcggttacaaggctgtaggtgattttcggatacaccaccagaggacggttatcattagtgatccatgtgcgcacagagtcgcggaagaaccagctataattcgcctcgttgtaatattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaacaattcaggatcgggaagtgtgcctggatatttgtagttcgctacggaaataaaaatctccgtgccgttcgttgacatattggtgtattcatgctggatataaaaacgttcttcctcggtgttcccgtacaggcgcacaaaggttttcgtgtcttcttgccattgatacacaccagcagcagcggacggaaccacgttagcgggttttgtaggatcttgcagagcggttttcacttcacccgtaacgagtgcataaagaatcccgttcatcacatccattttcttgacaacgatcttatcatttccagggacaactgtatagcttgctgtatcgaaaatcttttctccgaacgtcggagaactcggatcggtgtcgatcggtgtctgtttcagtgcgatacgacgcacaacgtttttcgcaaccacataaagccagtcatcggaacatgccattgcttctgcatatttcgacacgttaccaggcagtttagcgaatgtgttgtatgagtctacgtcgaaatcaaggccagtctggttccccagtttggcaaacgtaacgtcatcagcagagaatcgcacatcgtccgcagaccagcgaatatccgttgaggtgcgcccgtagaagatacgatcgtaacccagtacataggttgtgtttcggctttggtacgcaatagagcgcgatacagggtttcctacgcggtcgttaaatgctttgtagtaatgccatgtctgccctttgtcgtttgacacctttgccatgttctgaaaacgttcaaacaggtacagcaaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattgaagttaacgtagttctgattgttctttgcgaatttttcgtttatgaatgcatcacttggcgtaaattcacgcattgttgaatatgcgtaggcgttaaggctgaacgtccataattcatctgtataaacccaatcagacggttcaaagcccttgtgcgtaaccatgacgcggaatttataaaaattgtttggctggacatcggaagaaaaccattcattcaaaaaagcgtaacccaactggaaccaggttaaatcttcatctggaatagtaacaccacctgccccgcgagtttctgccatttccacgacatagtaaaaatccatgccgacgctatcccacttcaaataaacgaagttagcagccagtttatcaacgcgcaaactggtaattgacggcgctttaatcattatgtttctccaaatttgcgttacttatatcccatatttagcaaacaaaaaacccctgccggatgacaggggttaaaattattgactgattggattcattgtcaatgttgtatattgaggacggagatcgttttcaaacacaatcagagaaccatcacgggtgaaaatgttctcttccaatggtgtaccagtcagttcgatataagcagcgctgaatcgctcggatggaacgttcaggacacccagatcgaaactaatgaaatcagtgtagtgttccacatagccgacttcgtaatatttattacgatcggtcactccaggatatttatcaaaatcggttcctgtataggctgcgatactgatatcaccgtttttgaatggcccgataacaatttttgcacgtccggttgtggtgttcatatcggttgatgcataacgcacatcatacgaatcaccagcagcgtttgtgtatttgaacccgttcgaaacaacagaacgtgatttcacctggtttaagaagtgaataccagacatcggagcgctgtaatagttatcaagttcacgcaatagctgaatagtcgcagaagaaccaatgatcgacacgtccgcgttatcaacataggttaacattttggacttactgaatgatttgttgaaaatttcaacgttatcagtataatatctgtcaacctcattgattacttgaccacgcaaccattcctctgattcaaccaacttactgatatcatacgttactttgatactttgtacgatgtacagatagttcgggtcaaggatcgacggcgtaatcgtcgcaaggttatacttcgccagatagttttgcatatcctctttttgaacagaggtcaaacgcaaccctgatttcggtttaaccgcgatgaacgcatagccaggtttttctttatcagtaaagcactgaaccgcctgaataacagaaccgaaacggtgagacaagaacgattcataatccgatgcagtaacacaacggcgctgtgtctcacgcatgataggcgcgagttcgcgaatacgttcgatatcttccggttcaccaccaccatcagcgcctacatagtccgctgaattagtcgggttctcaacaatactcgtaatgctaatgtttgtcaacgtatccacgtaaacaaagttttcagcaccgtttgcttcttcgccgttggttgaaatatattcaataacaacggttgaaccgtttgcaggtttcaagcccccgatgtaatcagcagtcagagcaccacccgcgacctgttggctggtttcaccttcaccaaagtaaacttcggtatgtccatcaacagtttcacgcatatagaaaacagttgatgcacccgttgcgtttacgatactttcgtttgtccagtcatcccattgtgcgccgttgacggtaacacgaacctggctacggtcgatgtttggatcacggatcaggatagtcgaaccatcaaagatgacttcggtacggactaaacgcccctgaacgatgttcaacatcgaaacatagttattgtttttgtcacgaacgatcaccacgtcatcggatacgacgaacgggaaactgtttgtttctttcactgtaccgatgaatttcgtaccgcgtggaatacggatcgatgttgggttcagtgggtttttcgcagtgatcaggatcgaagtatttgcagcggtgcgggagtccggcatatagcccaaatcctgagcctgttgaacaacagaactacgcaatgcagcggtacgaataaacgattcgaacagtgcggtgttactcatttgctgaatgtacagtgtacagtatgataacagatccacaagtacgttcatgcgcgagccggagaaatcataatccttgaattcgtcctgacctcggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagttttttgagttcagccattgccatgctgtaggtgtctttcatcccatcttgcagagtagcaatctgtgctttgattccctcatatgcggccttagtcgcattcacagcagcgttagcggcatcaagtgcagcctgataagcagcggttgttgcttccgttacaggttcccacatccagtttaggtactgatcgaacttgcgtttaatcgaatccctttcctgtgtctgtgttttcagggtgttgaatagttcttgcccctgatcatacaatgcggagatctgcgcataggatgcatcaatgaacgctttcactttcgcttgtgcttgctgatacagatccattgctgtaaaccctgggaagttaccgcccagaatcacatcaagaggtttaatctgtcgcatgatgttacggatagccagcaccgcagaccaaagcgggtttggtgtttctggaggcattgaccagatctgcatcatacgcccgtacaaatccaccagagcaacgcaaccgttttggaacatagtcaaacaccagtcaaataacgcgctacaagcgtctacaaggtcgcgagcgccagccttgacatattcaacggtgtagttgtaagaactgcctatagccccgtagattgcgtttatgacgctttcatacgtctgtgcgccggagtcaatcagagcctggaaagaatctttcagggattgaaccgaactatcaccaaacaccagatcgtaaatgttgattgcaacacccaggatcgcaacagtcgggaggaagttattgatcagactccatgccccacccacgatgttaaacgcagagctaatgatctgccggaacaccttcattgcggtttgccatgcttgctgtgacaatgccagagcacccgctgtgatttcttccatcccgatcgaaagcccgtcaaacatcgtcgcgataccagagccgtttttaatcgtacccgtcagcatatcgaaagccagcttgaacgttttacgagtctcgttccacgcggaaagcatagcatcgctgatattcgtatacgggaaccctacggtcgccggaatacagcccaatccagagcgagcagaaaacaatctggcttcactcggtagcgccccatacgttgacgggagagcaggaggaaccggaggaatgctggtatctgcgttcgtgtttactgacatccctgtatatttgcactggtgcgcgggggattcgtcgtgtttcatgtacgcaatacgattaccattccagtagtaatcaatgctggtaaacgcgcctgtagtctggttatatacctgtcggattcgctgatcgcaacgggggccggaagtcagcaagtaaccaccggagttttccaccttgtacatcgcgagttcgccagggttcttgaacagattcgcttttgatagatccgccccgtaccagtcattacccgcgagcttagtagccccgatagatgcgatataggcatcaatatccgcttgactggcgaaatagtaaccaatcttcgtaaccagaatgtcagtagaaacccctggggttccgtctgggttcgtgggtacgtttggagagttcaccaccggaagcggatcgcttttctgcccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaagttttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacggttgcattctgtttaacgttagccattaaattctgattcacgtttacggttgcatctttttcaacggttaattctgcgttgcctttaatcagccccacatattcaccttcaacggtttgatttacattaccgcgaacgaactcggtcacgttaccatcaacggtctgttgaacgttacccatattgtaaatgaacgcatcaccctcgataacaacctgcaaattacccttaacgtttaatttacggccttgcatgacgatttgataatcatcaccaacgattttaacaacacgggttccatcagggcgaatttcttcgtatgatcctgctgggtgaacacggttgtaacgttcaaagcctggtgtatcgtcgaattcctgaatgtgtccagaacgggattcgaataccatgttgtatggatattcagcattgtatgcggatttaggttcctcgaacattacgcgagtatcaccaggaacaaaaggatcttctgggtttgatgcagccaacacaacagcattgtatgcagcactcaatgaacgcccttctggatctggaacctgaacaccgtatgattcaaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttcgattgccatttgacgaggacggtttaacgtcacgtatacttcgcgaacgtttgaagtgttgctgatcccctgccggacttttgccaaatcctgagcaaacagcgttgaaacttcttctgctgtgatcgttccattggttacttctcgaccaactgctttactgatcgcggcgttaatcttcgcagtatcacgggttttttccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccgcgagccagtacgttgacatcgttacctacataacgaggatactcaccaaacgggtcacagaagcctttctgggtgtccggcttctctcggtactcaccagcaaaggttcccagtataacgccgtcctggtgccatttatcgcgccagtaaccgataacgaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccagtagacgaggatcatcgacttcttcgaccaccccctcaaagaaaggggagtatttatttccaccgtatttcataggtttgccttttccatttccttgatataatcgcttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccgggattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaacgaaaataacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgataaaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgctgtatacttatgcggtaaacattgacaaatggaaagccgcgaatgcagcagcaaaacaaaagggctgggagttcaaaatcatcacagaggacacgttgaaacgtgtgttcggatggaaagggcaataaataccctaaacggagggaattatgagttttatttttgagttcgagatcatcgcagaagaagacaaaccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctataagcagcagattgatgatgaaatcgaacgccgtaaagcagaaaccgaagcccgacgcaaacgtaatgactatcgtaaaaaacacgcggttgatatcgtaaacgatttccgcaacagtttgaagaaaatgactgttggtgtaaccgctgcgaaacgtcagaaagattcgaccgattggtttggtgatttcatcaaaaccagcattaagacgcacagggttgcgaaaccagcaacgggtcgcttgtatacgttcatctacgatgcgaaatacaaagacacccttccatactgggatcggttcccgctgatcattttcctgggttcaggacgttcgaaagcgggtaacttggttctgtacgggctgaacttgcactatgcgccaccgcgagcacgtcaagagtttttagaagaactcctgaaacgtggctacggatcaacagatcgactttctaacaaaaccagactgaaaatcaattggaacaacgtgaagggaatgcgcggggctgatcaaatgatcaaagcctacctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaagccccaaccgaaaggaaggggctttatttttacagggtactcacgatttccgcgagttttccaggggttgcgccaggtcgaaccttcatcgcatctttcaggtttttatcaaccatcttttctgcgtctttttcgttaaacccacgtttcaccaacaccgcaataactttttcgcgaatatctttagcggcttcgttcaaatcttctgattcagctagaaccagtttagacagaacatcacctttgtattcctgggtaaaacgtttacccgataccagacgaggcttaccagaggcatctacaaccgtaaacacggcgtattcacctgtttctttggttttggtacgtccggtatacagcaagcacatatcgttacttgggagcttgtacacctttcctttcaccaatgcttcatccagaggcagatcaatttcgaaatcttccgccaactgattatacagatccaggttttcttctgcttctttgtacagagaagcgcctttgaatttcagtggcttgtcgaatttcaggtcatcagcaggatcaccgctgtagaatgaaacagtacctttcgcccagtcaatatacgctgcctgagtcttgccagtggttttacctttcaggcggacaacacctttaccgaagtaagcgagatcgtgggagtccggcgcatacacatcgtaatcagcaccatgtgcaaaatgcaggaaaccaatctgaccttttgcagcgttaccacggtcaaccagatcaacggtcttagcaaattttttgttctgaacagattcagaaagtagttctttgaatgatttcatgttttcaatctcttttgaaagtataggtatagtatacctatttattgaatagatcaactaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtcttgatctaaatatctataaaatggagatcatcatgaatacaactgctatgatcctgaaccagatttcacctactaacttcatgttagatattcctgacaatgattatgtaaaagggttgaaactacaggttcagggtgttacactacctgctatcaacattccaattacggatgtcccactgaacccaatgattcgagggaagatcccaggatctgcaatggagttcgatccactgactattcgttttgctgttgatgaagaactgcgatcgtatcttggggtttacctttggatgctcggtactgtcgattttaacaccttcgattccgtgcgttggagtgaaccacaacaggcaatggctttgcatatcctggataactcgcagtcaaaaactgtagcgacatttcgcttctatggcgcttggccctccaacctcggagagcttgagcttatgtataccaatgattcggatgaagccgtatcctgtatgacgatgttcaacttcgctcacatggaaattgagatcgacggacgggtgatcgtgcctactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcacgataacacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgccgtttgatgcaggtgttcgggactgatattgtttgtaaaatagatccgtctatctggacttcaattgcgcttcaaaaaatgttgaaatcctacgcggatcactttatcattaccgatgtgcgtcaaccgcatgaatataaatacctgagcaagttcgggactcgctttgtgttccttgaacgtgaaactggtattgaagataatcattcaacggagcaagggttgacacctggcttgagtgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccaaatttgcagtcttctggaaatcgacggttcgcagggtgtatcccctgatgccctggtcggcgcgatcaaagcacttctgccagcaacagcagaaaccgctggcgacgatgaagcgattgatgcatcaaaagcataattaacgcttaggcgtttaaccactgggggcgaaagcccctttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgcccgactggttgacgtggagaagtgggaaacgaaatacggtaatacgatcgtgggtgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaaccgctggatctggataagaaagtcgaagacatcacggagcacatcgaacatcgcggcgataagtgggttatactgaaccatgatcgcacgaaagaacttggtgaatatgattcgaaagaggcagcggaaaaacgtctgcgtcagatcgaatactttaaacataatgggtgatttatgaacagagcacgattgatgtattttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcgatctacagtgaaattcttaatagtctcgctaaacattattcgtgtaacgttctgtattacgcggtgaaagcgaaaaacgaaggtatgcaggaagtcattgcatatcgccggatcaatggcaaagtgtttgcctgtgcgttcaccgtccagatgttcgaaaacatggatgattcggttgctcacgaaaaaccagtgattgctgtacgattccgaaccgttatccctgagtacacgttgagcctgaacacgcgaaacgcgatccatgtgaactacatcgcacccaaaatcaagttcgagtatgacggctacagacgcgttatgtcacgcctggatcgcctgattgcttcaaaagattgtccgcctcaactacacatgttgaaaaatatttgaaaaaagcccttgcattcgtgcaggggcttttgttatattaggggtgtcgaaacaaaggaggcaatcatgaaactttactggctggtgttctcaaacgggtttgtaatgaaaggcactgttcactgtgcgaaaacttattgcaaatggaatgaatgctctttccgtatcctaagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggcttgttcctctctttcatcaaaaaattttttaagtgagaaatatactatgcgctcaaatgtaccgaaaaacctgtataccgttattgatgctggttcgattcgtattgctgatgtaatggcactggtcgaacgcttcgatcgttcaacaacgctggggcaactgctgagtatggttaaatcccagtacccacacaaatgcccgaaatgcgagggtaaagggttcgaagtcaaacgtgttaacacgtatccttctggcttaccggattctggctgggttgatcagatggaagacttcaatgttacttgtgatatctgtaacgggcaaggcttcactaaagaacgccttatcgcaaaacctgtcaaagtggaatatgtacccgcatgaaaaacaaaatctatgctcatatgtctgagcacacaacggttcgtgttatcttggtagatgggccaatcgctcaagtagaaaccaacgataaacctttctcgttgcctttacaaaccagtgtcggtactttcgatgaagttatcgaagaattgacaaaacacgccattgtttatctgtgggaagcgcaaagttatccatacccaactcctacaagtccggcgtcagaagataacgtaaaaattcgttggggatatattgaatgaaaattaccgatctcgtaaaagcggctaatgcgctggtgacaagcgaacattacgccaactactgcgagcaataccctgttcccctggaacgcgcaattactcaatccggttatgacggtatcagtaccgtaaccgttgaaaacctgaaaacgttcatcgtgtttgctaacacgttctggatgtacttacccgataatatcggaattcgccagcctacattcttcacgctgtgtatgttctgcgaaacctatctcccagaatgcgaggattacgaagaacattatggggaataagatatcaatgggtaacaaagtatccctgatgcagtttgataaaaagctggggtttgcattctctcacggattcgccccagacgcggaaaccatgtttaaaatggcttttggcatcgatccggctaccctcgatcaagaggtgttgtcagacatcaacaaaactggtacgctgtattatgcccgtctgccaaatccagaaaacggcattcagtaccaatcgactctcgaaaaactcaaaactgaactgaaagaaataggtgaattatgacttctacagctattcaacaacaaaccattgatcatgatgctgaattcgcgcaactgatcaaagaacataacgcttttgcggcttctcgcgtcaatgaagaaagcgaacagacccgccgatccctctgggttgccatttaccgcgaagtgttcagcgagaaatccgctaacaaacacactcaggcagttgatgcagcagataaagcgctggcagcatacgatcgtaagttcggagcacagtaatggaacggtctgctggtattctcttcctgaataacggcagcgttttaatgggccacgcaaccgaaacgcctcattgggacatcccaaaggggcatatcgaaaaaggcgaagaacctattcacgctgcgatccgtgagtgcttcgaagaaactggagttcttgttgaaccgcacgaactggaaagcctcggaagactggattataccagtaaaaaagagatttacttattcgtgtataaaggcaataattaccccgaagccgataaatgcttctgtgcgtcaacgttcgtgaagaacgggcgaaccatcacagaaatggacggtttcaaatatgttccgtatagccagatccgcgatcatgcgcgtaagactatgggacatcttctatctaaacttgtgggatatacatcatgaaagcaacaacttttcaaatctgtcaaatgatccttctggctaccgcaacccgcgccgctgaacctatcgcgtatcagtcatggggtgattcattcaccgtgaaaaatattcgcgatctgcctggacgcctttacgcttcccctgatttcgaacccgtcgatccgaatgatttgacgctggaagaaatgaaaaatctgggcttccgtaagtggagcgacgattcaaacatgatgctgatccctctgtatctgttgccatacctgaaagacggtttccgcgctatcagtatcagcggtgaagaatttgaatttagcactggtgaatcagataacgatcatcgtatggggctgctgtctttcggggcattgcctaaatgagtcacgttgatttcaacaccttatctcaattggggctggtatggaaaatcaataaagatatcctgcatcccctggggctggcgttgacgcgtgatcctgaaactggcgtatcaatcggtgcgctggtttccgatgatggtgtctggtcgttcagcgaaaaatcagactttgaaaacatcgcaaagttgaataaactttatgctttacaggccgaaggaaagctgttagagttcttacaacaaaacgtgaaagagtgattatattatgaatggtgaacgtgtaattgtcattggcaagtcgaagcataaagctaacgcgaagggtgatcacttgatcatcaacaccgatcgcggtgactggtacggcgcaacgcaagtaacgagtggttatgcaaccatcgttgaaaaagatgcagttcgtcccgcaaccgctgctgatcctggttactatggaacccgcgaagagttcgaaagtgaaaaggatcaggagatcgcagaactgaaaaccaaagttcacaacgcgcgggtgtatgcggtgatttgccttaccgttgcggctatcaatactggtttgttgggttgggtggtgaatcatgtctaaagatgatattccggttcataaccgacttcgggaactccgaacttttcgtagtcgcgatcatgcgatcatggttgggagttatctcaactggtggaagcataatgatctggatctgaatccatcttatcagcgcccctacgtgtggacgcagaaagaacaagatgcgtttctgactaccttaatgacggggttcccttgtggtgtcatcgcgatcgcggttgatagccagttcaatgaaactcactgggtagaagtcatcgacggtaaacaacgcctgacgacgattatcaaattttacgaaggtgaaattggtcttcctatgccggacggttcccgtttattctggcatgaactaccccgacacgaacagcgaacctttgaaaatatgtcattacctgcactggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaacattgattcagtagaaccaaatcagtttatcatcggtaaagaagatcatgaactgttacaagcggttaaaaacttgctgacgtatgctcatatccgcgtaccgaatggcgataacgcaaaactggaaatcgcatgtgctggttacggttacaccgctaccgctgataaaatcattagctattccgcatcaagaacccgtgaactggttcattaccgcgataaattgagtgaagaaatccatcaaactcaggtaattgtagatcagttgccaacaaatttcgaataacttgaaaaaagcccttgcagaaatgcaggggctttgttatattacacacatcgaaacgaaacagagaaaggaaaacatcatgaacatgaacaaaaacattgccgctgtagttggttgtgaagtttctaacgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacggatcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccttcatgacaaccaggcgcaaagggatcaggaacgcgcgatcaacattgaaacggctaaactccttacccagatgttccgtaagtttcctagcaaattcccatgcaattctatgcattcaagtaactgtatcagcgtagaactggctgataagcgttgtatcagggttaacctggcttacgggttatccgaagacggatataacctggtgatgggctggacatcaatgatcggtaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatttaagcatccagggaaatcaggaatatggtttcaggggcaaagagtataaacgcgcattctcatatggtgttccatatggcgacagccctacacagattaaaagctgggaagaggatctcggaaaatatctcgaaactgtagatccgcaaactattctggatctggttgatgacctgtcattggcgctgcgagataagcaaaaagcagaaaatgaagccgcgcactggaaagcaaatcacgaatgcgaagtatcccgcgcccgtgtcctcaaagagcgccctgatatgcctctggagcgcgtcaacgcatacaaccgtatggttgagttagaagaggaaaacaaagccttaaaacagcgtatagcgagcctggaggatgtcaatcaaacccgcatgatgttgcagatgattcagggtatggtgattgatacccaaaacatgaaccgcgaacaactgcgctactggcaaacacatttccgcaatcctaacgggtggtaatatgttcggacgaaaacgagaatgtaaacatgttgctaccggatggatgcggggaactccttacgcctggatgcatcattccgtaaccgatgggatcgggcgtatacatggcgatatgtatgcaacatgcgacaagtgcggggagaagtttttgatgtgtaagatacacgttgaccaacgcgatccgtgagctggcaaaacatccgatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaatgcagaaaaactggaaaaagttgaagatgcattacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactccataaccctgatctgttattgtacacacatcgaaacgaaggaggatatcatggaaatcatctacaaaagccggaactacaaaaaagaagatgttgcagcggtttacatcaagtaccggaacgtgaaatgtgagtacagcggggcatggggttatgaaatcgttgttgaagaagtcaacgccgacaacaaaaccatttgcagtttcaccactaataccgatagccctctgttcactactgaacagcttgaacaggcttatgaactgcgcaaccaggcttttaacgcggtacgtatcaaatgagattccgtccttatatcgaattccttcgcggtatcagtgagatcctgaaccgcgaaatcaaacccagtccgttagccgttgagctttaccgactggatgcaacccccgaagatgcagcgaaagattacggagatcagttataatgttaacttttgaagagtacaaagcacagcgtgatcagttaagcaactggtacagagagatcggcgcggagttaagcgcttaccctaaaaacgaaatgggtatgacgatcgaatcaatccgcaatacgccggaatacaaagcgaaacgtgctttgtgcaacaaggttttccaacagcttcgcacccttaacgggaagtacattaaactgtacaaaaaagaactggctgacgaacgtaaactgaaacggagtgtaaaatgatgcagcacgaaatcaaaacagagattgacaaacgtactttcctggaaaagaataaaacggtaacgctgatgcattactccaccaaaaacggttcgagtgagttctggcgcgttaacattgacagcaaagagaaacaccagtcgataccgttcgacaatgaaagccttgctcgcgctgtcttccaatcccatgttaaattttgagaattatattatgaaaactgtcgatatcgttaccagcatcaaagcgccgtccctgttcatctatcaacacggcaatatgcgcttcgctcgctcgaagttctacaactataatttcaacgttgatactggtgaattcgctcgctggggttcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggcttactcaatgcgcactcggtgctgatgcacaggggcaaacaaaccccgatatgttcgatatgatggcgtatgcgcgttctaaaggcattgtgccgaaccttaccattgctgacgtatcaaaagacgttgcagcgcgtttagcggcggttgctggggctgttgcggtatcggtttataaacacgctggttttgatgtcgctttcgactcagtagcgaacctgacagaagccggacaacagcaaatcaaccttcacttcatggttagctcgaaaacctatgatgacgcgtttaacgtggttgatgccgtgaagaatgatccgcgcctgaaacaagtaaacgcgatcgtgttcctgggactgaaacaaaaaggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcgacgatgtttagctcttacattaatgaacgtggtcagttcttcccttgctcgtttaccgaacgttgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggatgtgtcgcctatggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtatctattgacattccaacaaaaccgcgtacactggaatcgttgattgaaaaatactctggaatggttatttgtccttctaccgcacaggtggcaatggcagaacgcgatgaaattgtatttgaatgtgatacgaaaggttatcacaccgttgaagatatgcagatgattgaatatctctggggaatccgaaacgctgtagtacatcacatactgaccgctgaaaagaaagccgaagtcgtgagagaagttgaacagcgcgaagagatccgctataatcggatgtctgcacaggaaaaggatgaagcatatgaagtgtgccgccgtagttgatgaattaatgagcgcgtttaaaacgcgtcgtacagatgggcgtattaaagatccgaagtcaatcgcgatcatcgaacggtacgcgatgaagttaagcgaacaggaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactccgttatgtggaacctgatgcacctggatcgcctgatctgggaagtgctcgaagaagagggtattgtatgaaaattcgggtagttgaagttcatacgcctggatgggttcctgaaagaacatacaagttagagaaacgagtatttgggtttttctgggttccgttgacttttaaatctggtattcatactatccaatacgatggaagaaccccagaagaagcgctggaattattcagactaagaacggaaaaacatttaaccgttgttaaggaaattgattatgaaactcgatcgtgaattaagcatggctatccgcactattgaaatgatgcttgataaactgagcgcaaaagaagagttttgtgtaagtgatatcgaagcggatttagttgaatggcgcggtgcgctttacgaagcgacaaagggcaacgatcccctcttcgatgaatatgacgtgtataacgtcaaggtctggaacactgaataccgtttcaagtggcctggtgacgcttacgggcatattcaaaccatttacgtaactggtggtatggtgtttgcaaccagtgttggggctagtgaacttccgatcaatcccaatagtaaagtaacgacaccgaacccattaggacatactaccgtttgtttgggtatggcggaggatttctccccgaactattcaggctggatcgaagccagcaaaactaaccttaaaagagtataaattatgtggaaaattgttgtgtgtattttgatggttgtcgttgttgtgttcttgcagtcaagctgtactgacgagaaagaggcacagcgtatcctggaagcacagggttatacgaacatccagttcacgggttacaagtggtttgcgtgttccgaaaaagacacatattcaaccggattcgaagcaactggtgtgaacggcaagcagatcaaaggatctgtgtgctctggaatgtttttcaaaaatagcacaattcgtttcgaataactgttgacactaatccccgttgtgataatatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagacggtaacgaagaacacggcttctatgatgctgcaatcttcgaaaccgctgaacaggcttgtgatttctggtcttacctgagcggtgacaagcctttcaccaaatacggtgtttgccagtgcaaagacatttaatcccagccccgaaaggggcttttttgtaggtgaaatatgaccaaagcagaaagaattatcaaccatcttcaaaccggattcccgtaccagggagatttacagcgcgatatcatcgaactgttatcccagcatgacgggatggaagcggagataaaggaattgactcaccctgacgtgaacgtattcgcttcactgatggatgatgtgattgctatcgactcggacgaactgatctgcatcgagacaacgaacccagaagataagacgatcctgaaacaagcgtatgaacggatcgaagcattacacgatcgcctgttcacgttaactttcccaaataaaaacgatagaccttgttgacatcaaaacagattgtggtaatctgtatatgaaaactaattgtgaggaatacattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtcaattctctctggatgatcgtaacgtaactgggcgcaaccattataatttccatgcgttgttccgtagcgaagcagatgcgcaagcatatattgaacaaatcaataatgataaacttcctcctgatgacaaacaggagagtgttgaaatgacgattcgctggaaacgcgatcgcgcggaagatgcaatttggggttacatgtaaaacgttgcgcctcttaaaccgtaaataccctgtgtagcccatagggtattttcataaagaggtatgtatgtttaaatttagtcagaaaagcctgaacaacctgcaaggcgtgaagccggaactggttaaggtggtaaaacgtgctctggaactctcgcctgttgattttggtgtacgcgaaggtctgcgcaccgtagagcaacagcgcgagaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctgatgaactgggtgtaaaactgcgctacggcatcaactggaagaacgatccgaaccttccgattgaaacgaaatttatcgacgcaccacacgttgaacttgcataaggcgacaatatgatttcacaattctatgttgacgctgtaaagcagtcacgtaacctgcaccttgcgcgaatcgttgatgggcgttgggggcaagaatgcggcggtgtgtctatcttcgaaactgcgctggatatgggtcggatgtcgggtaaaaccaaagcggctttcgatatcatcaagcagtctaaagggacactgaatatctacgttgcaccgacaaagcagatgggtatttgtgctgcggtagaacatggactggataagggcgctgattcgtctttcattctgtcgaaacgtcaagatctgacttccattttccgtggacaaacgatcaagtatcaggcaatcaacctgattttcgatgaatgtgacacgacgatcgacgaacggtttgaactggcaaaaacgctgaccttgtgtatgcgttcaagtcatcttcatccgttcccatatatccatattatccgtttgggtatgtaattgcagtgcgcggggtgcgaatccgcgtaccccgcaattaacaggaaaacttctatgaaatatgttctagataccaacgttttaatctcgaacccatattcaatcttctcattcgttgaggcgggtactgaaatcattatcacctctgcgacaatggaagaactggatcacctgaaaagtaaagagcgaaccgctcatgaagcacgattggcgatccgcctcctgtctaaagtaatcctggggcagaagtacgaagcaattacccaaacaggggtttcgttgaacctgacgaacccagcactgccggaaagcgtgaaactccgtatcgttgattatatcggtttagaagagttcccgcttgataaacaagatgcgcgaattatcgctacctgtatgcaggaaaacgcaaccctgatcacccgcgatattaacatgctgttgatcgcgatgtctaagggctgtcctgttgaacaatacacgggcgatgactcgctgaaagatagcgatgtgttgtattctggctatgtcgatatccctggattctgggatgatgtcgaggtgttaggatatgttggcgaagtagcccaaataagctattcctcgcttcctgacggcgattattacccgaaccaatacattctgtcggatggtgaactcgtagggcgtgtagtggctgctggagagtatcagcttgaactcttaccaatcaaacacgaatccgcgatgaagcgtaagctgatgaaaacaattcagcctcgcgatgcactgcaagcgtcattcattgatgcaattatggataaaaataccgatgtggtgaccatcatgggcgctgctggttcaggtaaaacaatgctggctgttgctggtgcaatgcacctggttaacgccggacactttgcaaacctgatgtatgttaaatcggatagtcctctgtcgggcgaaatcgggttcttacctggtactctgggcgaaaaactgcgtcctgctgtagaaccatgtattacgagcctgaacattctgtttaaggatcaaccggaagttgacaaatatgtagaagggctgctggagaaaaacgttgtccagttccctagcctgtattacttccgtgggcgctcaatcgggcatcctgatccgggtaaaggttcggttctgattgttgatgaatgtcaaaacttgagcaatcacgaaatcaaatccattatttcccgttgcggtgagaacacccttctgatactatgcgggaacattaaacagattgacaacccgcgcaacactgctgttaacaacggctttgtgtatgcggttgaaaaacttaaagagtacggtcattcaagtcatgtgatcctggataccgtatatcgtgggcgactggctgcattcgtcgaagagaacttttaattaagggggcttcggccccctttttcgtgaggtatacatgatcagcgttattgttagtccaaagctaattaccgtttgcgctaactgcaaaagtgggttagagtatgaactgtctgatgtacagaagagaaccgaagcgttttataatggtttcttccgtgctgctgattacatcgtgaaaaaacatatcgtctgcccgaaatgtggtagcgaagtgaaactattcttgtgaggttattatggtacaagttgtaagcattaccccaaaacaaactacctgtcgttgtggtgctgtcctgtcatacactgcacaggatgtcaaagaaaaggtatcaaccgattacactggcggtcgtgatgtgtatcgtgtgatccggtgtccggtctgtgataaggatgtagtagtatgaaacgcgaagaacgttatgcagtgtttaaatatgcggatattgatgccgcgttaagtgatagcgacaaactgcttctctctgcggtagtgaataaaattgatcgctatcgtaaagagcaaggcaaagaacccataaaaggggttgttgtcgagcatgattggcctgaatatgaacaggtctggaagatgatcgaaacccgtgttgaccgcgaagaaaacaatcgtaagtttgaaacgatgctggacaataaagaacgtctgggttatttcttcgtggttgagactcacacagggaaattcctgatcaccagtaacgcgcacagcacaagccgtctgaccaaatacagcggataccaataccgcgccttgttcagtcctaattgtggatttgatcacagcgaaatctttacgactagctggagcgtttactttaaacgggctgttatggtgtcgttcgatgaaatcgttgcactatacgatccgaacgtatcaatttcgaactataatcttgctgaattcatcgagaacaaactgagcgatgcgaaaaccatttaaaatggttgcataaataataagacgagggtatcatagccctctcttgttacaaataggtattacaatgaagaaaattatctttgctgccagcattttcttatgctctttttctggcaacgcggcgactgatccgttaggagagtttatccaaacactccccgctgtgaagtcaactttaccgctacaacaagcaacagtaatgaagaaagcgccagccaatgcccccagctatgttaaggaattggatgatattacaccaaagcagaaaaaggttttggagtacgctttcaggatcggaaatgagtacgatcgcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtatgcacttcacgaactggaatactggcttgattaccacaaaggcgacttgaaaaaggcgctggcgagttacaacgcgggattcaagtattcaaagaaagaagcccgtgattacgctcgcatggttaaccataccgcgaagctgttagaagaaaaacgcattatctgataaaaagcccttgcaatttcgcaggggcttttttattatgtgtgtaccaactattgaggattaaattatgagcacatcacatcgagttattaccagtcacccgactatcatcaagccgaacatgctgcacatcattcagggtgtgttagatgaactgaacaaagatccaaaggttgaagtggaaaccatcacggtcgaccgtcatcgtatggaatcgttcagtatctacttcgcatatggagaagaaaaacgcaaactgtttatctgcgaaagtcaagatacgtatcttgacgttgatgataacacaattcatagcggcggtgtttacttcaacctgaacgtgtggggtagcaacaaagagatcatggatatcgtgaaagtgggtattcgtaagcacgtcccgaatgacgttagcatttacgaatgtgttaatgatgcaattgaagatcgctttgtgcgcgtaggggcttaacatggaaactaaactgacaccggaacagcagttagcaattattgatgaacgtatcgacgaaatccgagcgattgtaaaaccctatcaggaaaagctgaacgggttgctgaaagcccgtcaggaggtcaaagacgagatcgatcacaaaaccgcttcccgtgtccgagcgatgactccaaaacaacgtatggagttttacatcaattcaccgaacagcggacatgaaattttccgtgatgcgactaagttcttccaggatatggggcttgcgatcgacgggtataacccagaaaccaatcaacatattctccgtatcgcgatgaacgaggatcgcagtaacctcgaaacagtcctgaaatcgcttcaacgcgtgaagccatatgtgaagccgatcggcggtaaattgctgttcgatatcttcgaacatacatgttcacagttcagcacatattggctagcctttgatattgcggaagaacgctggatgtgtttcacgggttggaacctgaaacgcaatcaaaagccggaatttgaaagcgatagtttgcgatcagtgcttgcgtatatctgcgaaacccattattatacccctatcgaagaagattcatactaaggtaaaacgatgaaaaaacttgcgctgttactcactctgtttgctggctttgcacatgctgatgatcgactggctgaactctgcaataatcgtgacattaaagacgttgcggtatgtgaacaggtgattgccgaacaactggacgcggcttatgtgtggggtgaagaaaacgcgcacctcttcaagcgtcagaagttggttaaactgcatgagtttttacagtctgaaccaatgatgaacctctgtaccaatgcgccaaataaggaacgttgtgaaaaactccgtacttacctggttgatgaatatgttgctggcataggattatactgatgatgggattagtaatcttttacgggtgtgtgattgctgctgcaatcattatctggtattacgttaaaaagccaaacgaaagctcgttccctgtatatgatgacgagttggaagcgtggcaaagatgggacgatgaatttaaatgaacacaggttatatcttaatgtgtgttgtggttgtgatcgcggggctggctgtgctggcttaccgccactatacaggtgatgaaaatgattattaaagaaat

SEQ ID NO: 141 - DNA, 178883 bp, Unknown
  source: /note="Description of Unknown: KP2-5a Bacteriophage Sequence"
aaagtcgaaatggatgttccgggcttcgacgctgtttatatgtacaagggttgataatgagttacgtaatttatttcgactgttcggatctcgatcctttcgttctgcaacaggcaaagaaatatcatcaagatatcactggtatcagtgtcacgaacgatgatatgctgtgcatcgaatttgattattatcgtacatttgagcgtgacaaattccttgcggatattgaagcgtttaaaagtacccttttctttgatcgttatgaggttaaatcttgaaaccagttattcttaccgacattgacgggatcgccgtgaagtggcaaagcggcctcccgttctttttgtcaaaacacaatatgccgaccgatattgccctggatatggttacagatgaaaaattccgtgatatgaccgaaatcttcgggtgtgatcaccaactggcgaaaattctcatggaagaatacaacaacagttcgtttattcgctatctaagcgcgtatgacgatgcgttgattgtgatcaaccgtctgaaagccaaatatgatttcgtggctgtcacggcgctgggaaccactcctacagcaagccttaaccgtattgcaaacctgaacacgctgttcccttccgcattcaaagaagtgatggttgttgggcatggtgaaaccaaagtacaccgctacctggaagcgaaagccaaatatggtaatcgtctggtttgcttcgttgatgatcttgcagtaaacttaaacgaatgtcataacgtcatcagccagttgccgttattccatatgttgcgtggtgaacgtgaaaccccgtggtcgcctcaccagtcagttaaatcatggtttgaaatcgaagagaaattacatgatcttacagattctaaatgaactcgcttcgactctgaaaatttcagagaaggaagcgatcctgaaacgtaatgcaggtaatgatctgctgaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaacgcagcccgtgatcgtctgctggatatcgtatcatcggtgaacgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgattgaactgcgaatcatcgacgtgtacgaacacaccaaagaagctcataaggtcggagggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcttgccaatcatcaagaagatccgacgcgataagaccgaaccggatgatattcacgttatcttcgctgatctgttttaaatagcactttttgctaaaaagccccttgcatgagtaaggggcttttgttatattacaaacatcgaaacgaaacagacaaaaggaacatcccatgcaaatcactaaagaactcgaaggcaaagtaatcgttctggtaaatgaagaccgtttggcacaactgggtaacggtggtgaaaaactgccagcagacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcggattcaagagatcatcaaaaacccacctgaaccgacgaaacgtttacgcgaacttatgagcaggaaaccacgttatgaaaaatgaaccaagtaaaactatccgcctgatccgttgggaagggcaagaaatccgttatgaagacgacgaccgcgaattcgtccatgaaatgcttgcgcataatctgggattcaaaaacgccgcactggtgatgatgcaacaaaccagcgatgaagacacctggcaatgcgtcattctcgatctggacaaaaacaaggaatacaccgaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaaccgaatacgtttttcatagctggataacgtctgacacttcacagcctggaacggttgaccctgtttgtctgggttctggaagttgttctcatataccgcgtttctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttttctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggctatcgtcatttcacccagattaaagcaatgaaagacccaatgcagttgcttgagtatatcatcaaagagattcaaccgcgcgaattaaccgcagcagaaaccgaattccttttgattcacctgcattatcacaatgacgataaagcaatggcgatactgaaagagatcggtattaatctggatgatatgaaaatcagcgaagctaagtatgaacatacttttgataaccttcgattggtcttcaataaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacaattaccaacgccggacgcggaatgaaagtatcagcactgcgcgacaaacaaaaatacggtcttgaaattgatcccgatgacctgattctgctgaaacagcaggagatccaggatcagaatgataaagtggttgaggcacgttctaaggttgtcgaacaggttaaggctacccagggcgcattctcatatagtttcggacagcaaacagacgcacagaaagcattgtctaagcaattggaacagatgcgcgatcgtgtggctattgaagaaaagatcaccgaagagaagaagaaagaactgaaagcattgcaggaaaaccccaaactgttacaggctgaggttgataaagagaatgccgctaaccgtaagcgcgtgaacgaaaccaaacagaccgaaaccgagcaagcgaaagcgaaacctaaagcggatagtgaatttgatcagggcgatgaaattctgaacaaagacaatctgacgggcaacgataaaaaggtaatggaaaaactcatagaatcgcttgaagagaaaaacaattcgaacaagctgaatgaggacgacaaagaccgctatcgtgatatgatctcccgctggcaggaaaagatcaccgcagtaccggaaacgagtgcaagtattgacaagcaaccggaagcagtgaaagcccctgttcagcctacaacgcctaacagtgttcaggtcaataacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtacgaaagcagcgtttcaaggctctgataagcgcacaaagatgtattacaatacattcgttatcgaaagccgttatgacctgctggaactgattaaaatctattacctgttcacggtgctgggttatggtactacttctggcggtactccagcagaattagccggactggttaaacaagcgtataattccagcgcttcgaaggttgcaaacgtttttgcaccatcaacaaaccagacgacagcaagcgatttcaacggcagcatcggggatcagattgttgacttcgtatctaacgttgaagttattaaatcgcctcctgtgtggtttattcgtgacttccagacaggagacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagactttcagcgaagcaacctgtttagtgttgtattcgcaaccagtccagcatcacgcattctcgacagcacgatcgggagtatccgcgatactttaatagatggtactatgagttccattaacgcgaataacccgaacgagttcatgaacgctattacagggggcgtaagcaagctattcagctatacagttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggagaattatcactaacgttccgtgtggattcagaagcgcgtaacctgaaagtattcaacgaatggttatcagctattcgtgatgatgtatcaggccagttcgcattcattgatgaagtatcaagcgcgatccaggtaaacttacacaatcgcgatggtgtcccgcacagcacgtatgtattccagaagtgtttgcctgttaaagtcagcaatccagaactgagttatgaaagcaataacgaaatctggacattcactgttgactttgcctataaaacaggctggcttgttgaagcagataaagaaggttgggacggattcaaacaatcacttatcgaaggggcagcaattgccgttcgtggtgtggttactggacaataaggggcgaaagccccttttgaggttaaaatgattgacataatccgcgtaaaactccctggtggagtgaagcgattccctatgtttaccgtgcgcgatcaattgagtttcttgctcaccagcgcggacatggaagggaagacgctcacagaacagcaagaaatgctggatgaaattttagatattctgtatccgggttattcccgcaccgaacaggaaaacatattcactaaggtgtattgcgtatcgttcggtaagaacgcaataaagatccgaatcaaaggaagcagcggacaatcagaagcattcatgcatgtaactgattacgttttgcaaaatgaatatgcccttgatgactcgcttactctgggattcaaattcccgaaacatcgtaacaacagtgaacaattattccttgaatgtatccagtatgtcaagcaggacggcgaaagatacgaatggaatgcattagacgaggatacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattgctggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgattgcggggaactgattaagtttgtgctcaatcgtcatcatatcatggtggacgaatacgaagaaaagctgtacggcaatgagatcaagatttcagtcgaaccacaccgcaccggaaaggaagagttaccagaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtatagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatcgtatcataacgaacttcttcgacttcgaagcagaagttggaatattcaatcattccgatcttgttcgcgtaacggcgttcgatgcatccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgatacctccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattgtcgcgccttttctccagtcttttacgaacttcatcattttagctttcatgttctcgttccttttggctgttccgtttcgatatgtgtaatataacaaagccctcacgcgaacgcaagggctttttgggttaactgaatttattatagagagtgaaattaatccctatagaattcaatgctttacatgttgcatcaagatctgttggttcgatttcgatgatgtatttcaacgctgtgtttactggaatggtttctggttcttcgaaagatgccagggttggcgctttcaccgtttctggttcagcaagcgcggttttctttacgtcaaacgcttctttgaacttgttgaccctttttagcagatcatcaatcaattcgatgttggctccgtcgaattgtttggtttgttccagcatactcgtaatctttccgtatgtagtgcgtctggtttgttccgtgtaattccctacttcataacggtcgatccggtcgatgattgcccgaatatgtccaagattcgcgcgatcgaaatacgcaatcaacttagattttctgaacacgaacatatatggagcattaccgacaatgtaatgagttgccgttagaccaaaactaggatcgatcagaattttaaccgtgttgaaatacgggattaaatttatttcacgttcaggtaaacggaaaacttcatctttaaagttcttcccaatccggtcgatctcttccagagttttacccatcatcgacgaaattatttcaatttttttagatacataagccatttttcaattctcatttaattaatgcataaaagatttgacgtacttcacgatttcttcacgacacatatcgaccggagtatcctcagcaatagcagcatgacagaagatttcaccatccagccagaacgatagcatgtactgaatatcccgaccttcgttttctttctggtgtttcttgatgcgatcaaatgcatcatccatactttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagtcataacttccggtttcatcgtcgtattccggttcgtcgccgcgctcattgaagtgaacgattttaacatcatccagattcagttctttcaacttgtcccagatgcgggttatttctacgctattacatccgaacgcttccagtgtgattgtaccgtcatcgtgtatttgaggtaaaccccagcgaggacgagtatcatcaaacatatccatcagagattcaacgtttgactcaccgtaaatctttgcaacttcctgttctttaccagggcggacaagtcctatcccgataatgaaactactgcttgagctattgctcacgaacccagaacggatcttcatcgccttgcctcgtatttcgcgttatctgcgattttctcatgatacaggttgtatgacaacaccagcgggatacaagctactataagcccgatgatagccagttgatattcgcgtttatcgaacgccatgaatgtaatcgtagcgcccagaataaacacacctaacgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctgtcgattgtacttctcaaacaagcggtagagttctgcgctattgcctggcttctcgatgctaaaattatgcatcccagacagaataccatccagatacagaacagttttgttatcactgcgcaggtgtccgccaaccttgtagtagttgctgaatacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacgacctttcaggatttctaggcgcacgttatcagtcacgaactctttaccgcttaacccgcgagtcatgccacggttaaccagaggcagagaggtaaagtctaccagaaccgacatacgatcatcaccgattttttcgagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttaggacgggaactgttacccaccagatgtttaaccgatactttggttgtagtctgggtgaacttcggaacccatacttcatgcgctaccatttgcgccgccagtgctttacgttcttctggggttgcagcgtttgcgatctgttcagacagttgatccagtgtatcatcttctttctgtacagtctgacggcctgtgcggttgtacgcccagtgttcagaagacaggtcgatcactgtgtcagtttgtgccagcagttcgagcgcatcaaccagagtgaacgcgttttcgtctggaaccatgctgtaatcaataccatcaacgaaacgctgtgacggatcaacaaccgcttgtgcaatcaggtctttcgcgttggaatagtcctgcttagtaaagcagttgtcatacgccttgatcagacggacatcacccagcttttgaagcactttccatgccagatcagggttcattgtgtgtagtgcatgataaagcacgacatacagaacttgctgttcgctggcgatgttcggatcgaagccgtcaacatcattgatcgcgttgtcacccagcgcccagatgtttttgatgtgttctggaaccagtacaacaccgtttgcagcgttcaggacatacacgcgcccttcgtccaggtagatcgcatgggtagcatcagcaacgttgacttcgatacgcgcggaagtctgcgcggtgataatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtaccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacatggtttgtcggggttggcttcgatacagcgtttttgaattcgatatttgtgattgacatttaaattttctcgtatttgaatttttctaaaatttcgttaactttattgcttactgcttcgactgtacgatcacacccgaacttatgcgccaggagttcaacgtattcatccatcgttgtgagtttggattctgcaacgtcaaacgcaagcgcatacattaccggattccatactcgaacgatttggagagtatactcgttcagttcaaaacgttcaagatattttcgcaaagaaaatacatcaaacggtgcgggacgatcctggctaaaggggatcgactcccctaacgcatagcgaggcataacaacgcaaacttctgtttttagcttatccatcagtgatgactctttgatgtgtgttcaaggttacggaagatgtttccatgttccagttgagttccgatcgggccgcattcatcggagtacgtgaattcatagataaacacgccgtcctgattaccgaacttcgtgttgtactcttcgtacaaccacattttgatcagagcgtctttctcttctgtgtccagatcgtaccagtctcgcccgtcatacgcaagcgcgatttgagggtttgaacggtagcgggtttctgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcgcccatcatttcgcgcaggttgtcgatattagtcggatctttcgggaaccggacgatgaaactacttgatgaactgttgctcacaaaaccagaacggattttcattttacatcctcaaattgtaagttttctttggttgcgttcgcaatggctttttcgttgctcagtgttactatgcgcagacgttcgccagtaaagccgtcgcattcagtgatactcacccagtcaaaaggtttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctcccagcgttcggcgtttttaaccttcataccgcctccattttaccaatgacttcttcgtatgtcacagggttaggttcatagccgttagcgcctattgtatcgcctactctgtttcctactaaagaagcaaccgcaactttcttaccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattaaatttcgcaccagcgccagtacatccgttaaacaggtcattaaaagtcatggtatgttccttttcagtttcgtttcgttaaagctaatgtatcactatcctggtcagtatgcaatgtttaattttgcaaatttaccaaaatgttttatcgcttcccgatcgtatgcttttgcagcctcgtattcgtcacgataggaaccgatatgtttaaccttaccatcaaccattatctgcgcgatgtaacgtattccggttggttgattgcgcacacatacacccttgaatcgactggttccttcctttcgtcgtttcctgttctgggagttacgggattgatccgcttcacgcaagttatcaatcccgtcgccagcctcaacaccatttttatgatcaatcacatcaggcagttttccggttgcaacgtagtagatgattcgatgacgtagatatcctttgcttttgaaataaacgcgggtatatcctcctttaatcttcgaacctacttcctttccgatcaagtcagaacgtttgtgtgacgttcgtataattgtccccgtttgtatatcaacagaaacagttttaaggaattcgtcaattcctttctgttcttcttcgattgttcttagtccgttgtgtgacataacaccttcttgatttgttttgctatagcctcgatgactggtattgaaacagaattacctgcttgtttatacgcttgcatcttgcttttgttgataataaacgaatctgggaaaccctgcaaacgaaaacactcacggggagtaagtcttcgggggttctttccttcctgcaataccagacattgaacaccatctttatagtaatttgcagtgatagtcccagtgtgcgtagaatcgcttgtgacggcctgataaccgaaccccttaccgtttgccttatttcgttccttacgctctctaaagcctttccatgcgttatctgagagggtgaatgaatcatcagcatcttcgaggatgtcgcctacgcgtgtaggtgtacgcgggggaacaggaaatgaaaagaatacatcatccaggaagcagacaataaacacgcgttcccgtctttggggtagtccgaaatcctttgtgttcaggcgttgatagaatacgttatatccttcggcctccagaagcccgtaaatcgttttaaacgtcttccccttgtcatgggttagcagttcaggcacgttctcaaagaacagcacacggggctttttggcgcgtataatgcggaggatttcgaagaacaccgtaccgcgtacatcatcgaatcccagtttcaatccggctttactgaacgcctgacacgggaaccccgccagcaggatatcatgatccggtactttgttttcatcaatggcgaatagatcaccctgtaggttatcatcgccccagttttcgatatatgtttgctgtgcgaacttgtcgatttcagacgttaaaaggcattcgacaccgccgaacgccttatcaaatcctaatcgaaccccgcccacaccagcgcagaggtcaattattttcatacgtcaaaatcaatctcgtcgattttgtatgagttttcttcaatgtccgcccatagggttacattaacgtgtttgctatcttcgtacaactggcgaccatcaatcccgcccgtgtaattgctttcggtacgttcagtaacttccagtcggaggctatcgcgcatgatctgaacaacagcctgttccagtgtaactgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttactcttcgagcgtaacctttttgaatcagggaatcacgccctgatttgctgggtacgtcattgaaatctaagtctagcactttagttgcgtatccgtaaagtttatacagaacatcaatttcagcgccggacaatttaggatacatcatttgtaataccccacaacatgatcgctgtatatgcgttcgatgaaatcgttccagaactcgcgatcaacttctttcggatatgttgaaatcgctgcaaggcgttcgacttcgcccataacttcttccagtttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaatgctttccagtcgatcccgttgttggcttctgcttgtcgtgcgcgttctccgtattcatcccagagtttatacacagacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggcgtgaattcctgaataccaccgatcgtttcggtttctttcagtacatcgacaacttcgcgcagtgcagccagtcgggaacccttcacgccatatttcgcggcttgcttacgaacataaccgaacaagccagttagttcagtggtgtaaaaacgccagcggttagcgcggatatactgccagatttgagagttagcgatcagcttgtcatccgaagcgtgaagcatatcgagcgctacggtatcaccatcacacgcaagactaatgaacttagtcagactatacaactgacggtcaacgtcgtctacggtgtttttagagcttttatcgcctgtgctggtgtcaacagtcttcggggctttccccaggagaatatcgcgcgggtgcgggagaaagatccctttatagtctttgtcgcttgtcggtgtgttcagtccgtacaggtgagaaccgaacacggtttccattacagttttcaaaattcaacccccagggtttttgcgataccgcgcagttcagcggtagtgatatttggtacacgcgttacatgtccacgaccgaacgcgtctttgattttatcagtaagttcgatacggtacaaatgttctttgtattcgtcttcgctatgataaccctgtgtatgattattccagtcattagcgctacctgtttttcgatcaagtcgctcaacacggaaatctttaatatcggtgatatttggatcttccgacgcatacaggtattgacgggcaaccttgatcacatacaaggtgcgaggtcgtggggttttgtgatgactgtatcgacgaataccaggatcaaacagggtatcacccactttcacatcagttaaatctatcatttcattttccaacgttttgacttttcacagtagaacaccggaagacgtgccagaactggcttcactacgtcttcccctgtgttcgtgttatgaaccacttcgatcgtaagggattgcccttcggacggccttacaatgtccagttccaggatctcacgattaccctttgtattgatttccgctacgtagtaatcgtgcccgttgatgtttacgacatcacccataataacgctaattgtgtgaatcatgagtatgcaaacttaattttaacattcagggaatccagcaggatcgcgtcacgtccatcaatgacggttaatcccatgtatttgttatcgtctgcgctcttacgggagtacatgcgacaaaccagagaaccatcttgtgcgatgtattcaacgtggtattcacggcgttctgacgtgaagatgtcaccaactacaacaggacgatcaacactttggcgtttagtcccttcataggacagtttgccgttaccgtctggggtacattccgcgcctttcaacaggatttgtgtcactcggacagattctacggttcccgcaatcaacattgctggatcagcggttcccattttcaggatcagcgttgaacttgttttgtatcgtgatggttcagtgacgaacacgtaaaccatatcgttcttatcacgggcaacagattgcagcgtgaattgcatttgacccggaatacccgacatcgcaatgtgaacacgattaccaggttccagcgccatacgacattttacatcagtgatcccgctaagggttgctactttcatgatttaattccttcaaagtcttcattagatttccagtacacgttaaagttacggcaatcgtgatcagaagtcaacgtatatttttcttttgttttctcgtcggtgatcaccatcgtttcattttcgatggaatccacgccatagacgaacactttatcaccgcgcttattcaggaacgcgtcacctgtttgaatcaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagccacaacgatttgatagtggtcatcgaagaattccccttgtcgttgtacgacctcatgtaagggcatccagaacgcctctaacgcatcgtcagaaccgcccataatgcggggcagactaccatcattgttaggctctaacttgatgtactgcgccacagtcggttttgagaagtgtacggaacgcttcggatgatcgaacagcatcgaattacggattgaaccacgaataaccttttcaggaaccttgattcgtacctcttcgagcagttcgcggatcgcacaatccaggaacgtttcatttgcgtttttgtgtccgccaggaagggctaacgcgtctttacctggtgcgaacttacgacgaattaccagcaggtgattgttacacacaaccacactatcacccgtacagcagtttagcgcttctgggtatgggtagtttttgaatttctccaattcgctttcccatttctcgtattcgtagtacagtcgccaaaatgtatccgtcatcatccatgaattgatataactcacagtagacgaaggaacataacgagatagtttcttatcccatccattcttatgcaaaaagatggttggtcgcaaatcggtcgcagataaatctttcccgtcaaccttaactggatctaccggaacatgagtccatccaaacgctttcagccagtatgaatcagcatccttttcgtaaccatagatcgcgatgttgtcgcctttggtttcgtcgattgctgtacgaacagaggttttccatttttcttcgttgtaaagataatcaggaatatgagcaaatttaacacgacaaacatcttcgtatttgtattcagtcatcagccacgaaaagatcattctttcgcgttcgttcgctgtcagagggtttaaaacgttagggtaagcatatgctgaacccagaaggatgtaaacggtttttgcttcttctaatgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccagagtggggctttaaaaccttatttacgagaatcgaaaatcacttgtccatcgtaacccgcacccattacggtatgtggaacaccgccctggtatttctctgcgcgtttcatctgaacgtcaagttctttccagcgaatcatttctggtgtaatggtacgctgcaacacggcgttcgcttcggcttctttcttagccgcatacagacgggcatcagcatcacgctcgttagcctgtgcagcattgctacgggcttctttatcggcaattgcctgaacaaccgcctgttgagcgatttgctctttacgtgccagttctgctttttctgcgttcacctgttcttcacgaattttcgtgttttcaacctgcttcttgatcgcttctggcagatcgatatcctgcaagaatacctgtttcacggtgtagccgtaaggacgggcatactcttcaacttcctgctgaattgcgatctgtagctggctttgaacttctgcgttatacagatcctgtgctttcggtacagatttaccgaactcacggacggtagacagaagtttttcggtcacgtacttatcaagcgcctgatcctgattacccgcgttgatacggttgatcggggctttgttaccatcgaactgcaacatcacggtcatatccacagtggatttgaatttatcctgggacggaacctgcaatttgtcaaacttcattgcgatgtctttggtgttgaacacctcgaaatcagccagtgggtttaccaggtggaagccaggcagaacaggcttcggtgaaactttacccatgaaggtttgagtttttaccgtaccatcctgaacgatagtgtacgagttcggaaccagccacagtgcagcgattacgcccagagcgatcagagtggttttctttgggttgtttacgatagtgtttaagttcatcattatttccattgggtttatgtttcaattcgatagttattctatcatcactttttcgcgtgtcaaactctttttaagaaagttttgtcagcttgtaaatcgtttgatagcacaagcctttgatctcgtccagaatgttcttcaatgaactatctactgaatcatagattgtgtcggcttcggttgctattttacggagatacaccaccgtgtcaagcacattttctgtttttaatacgggtttatatcgaccagtgataccaatatgaatttcggtgaatttatcaaccaaatcctgcatatcttcgtaaaaactctcaaacgctttatgttgagaatacgatccggtcgcaaagtgtgcgctatgcatgtatgttacagacatcagacacataccgataaaggcatctactttgcttgagttatcacgatctgttacttcgttaaatgtttgcatctttcatcccttacgaacgatgaatagtagcaaattcgtttgccaccctatagcccaggtgtttacattctggttcagtgcggcattgtttttgctgccattttcgttccatatagttatagaacaattcactggtatttacactgggagggattgtgtcaagatagacctgtagcgctgcattgatgtaatagtcgaactctttcgggacgacagtatttcgatcagcatgtgatgcaggagacaagattaacaatccaaacatcatcgcttgtgatatgcgtttaatgttcataaacatttctctacgtacacacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaatcacgccagctttcatccggcgtaactcctgacgcattttagcgcgtactttcgaatcaatctttttgactgcgatcgaaagcatcgcggagatatcaccatgagctttgttaccgtcacgattcaggtttttatcgaatcggatatatgcacaacctgatttgtgtttccagttggttgtgtaccaacgcaaaccatcagggctttctccgtgctgtgcataatactgtgaaaatgcttttgtctcttcgatttgttcgatagaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttacgcccacagtgacacattccccgcagttctcggatctcgtctgcccaggccaacaaccagtaagaaccctcgaacagattcaactggaaatcagtacgcagaccgtaagccattacagggatttcgagttcatcaacaacgcgacatagatcgaaaacatttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaacagtcgcgcactctttccagcgttcattgatgcatagtgataatacagtttagccaattgtaaaccatccgttacccatgagttttttgttacgtcgcgcaagatgctctttgatttctggcatctggatcgcaatatcatactcttctttcgtcatagtatgatttgcgcaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatattgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgattagctcgctccactgctaccgcatcacgaaccgcatcattgatttcattttcaacgaaatccagaatatccgccgtaatgtcgtcaatacaggattgattgtagttgcgtgaatcaggatcgtcatcttcggcataatcctgatacgcttcgcccagttgtttcagtttatgttttaacagcttttgttcttgcggtctcattctctcgcctctttacgtccggcatcaaccaggtcatccacaaagctaacgatatcatcccaccaatccagcgcttcctgtgatgctttcgcgtcaccatcaaggaaacggtcacgagcgctcgcaaacttctctattttgctatagagcttttctttatttgcttcaatcatgataagtccgccttacgtggatcaaccgatggatcgaagtgaacgacgatgatcgggtaatctcccgtacactcgtcaataatagcgctaatacgcaaccaatcgcccccagcaagccccgcaccgataagaggggtaatgataggcaatttttcaggaaacgcactggcgcgttctacggcgctcacaaagcatgaccggattgcatcataatccacttgtgggccagtaccccagaatttaaactgggtgtatgcgttgaagacaatctgaccttcttccgtcatgtagatggagttagtgcctaacttccgctgatcgcctttcatagtcagtgcatcaattttgaacgcaccagggattttgtgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcatcgtcccatctttgccacgcttccaactcgtcatcatatacagggaacgagctttcgtttggctttttaacgtaataccagataatgattgcagcagcaatcacacacccgtaaaagattactaatcccatcatcagtataatcctatgccagcaacatattcatcaaccaggtaagtacggagtttttcacaacgttccttatttggcgcattggtacagaggttcatcattggttcagactgtaaaaactcatgcagtttaaccaacttctgacgcttgaagaggtgcgcgttttcttcgccccacacataagccgcgtccagttgttcggcaatcacctgttcacataccgcaacgtctttaatgtcacgattattgcagagttcagccagtcgatcatcagcatgtgcaaagccagcaaacagagtgagtaacagcgcaagttttttcatcgttttaccttagtatgaatcttcttcgataggggtataataatgggtttcgcagatatacgcaagcactgatcgcaaactatcgctttcaaattctggcttttgattgagtttcaggctccagccagtgaaacacatccatcgttcttctgcaacgtcaaatgctaaccagtacgtattgaactgtgaacatgtatgttcgaagatatcgaacagtaatttaccgccgatcggcttcacatatggcttcacgcgttgaagcgatttcagaactgattcgaggttactgcgatcctcattcatcgcaatacggagaatatgctgattggtttctgggttatacccatcgatcgcaagtcccatatcctggaagaacttagtcgcatcacggaaaatttcatgtccgctgttcggggaattgatgtagaactcaatgcgttgttttggagtcatcgcgcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctaccccacacgttcaggttgaagtaaacaccgccgctatgaattgtgttgttaccaacatcaagatacgtatcttgactttcgcagataaacagtttgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtcgggtgactggtgataactcgatgtgatgtactcatgatttaatcctcaatagttggtacacacataataaaaaagcccctgcgaaattgcaagggctttttatcagataatgcgtttttcttctaacagcttcgcggtatggttaaccatgcgagcataatcacgggcttctttctttgaatacttgaaccccgcgttgtaactcgcaagcgcctttttcaagtcgcctttgtggtaatcaagccagtattccagttcgtgaagtgcgtacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaacacctatttgtaacaagagagggctatgataccctcgtcttattatttatgcaacatttttaaatgggtttcgccgcacgtagtcttgttcgcgattcatactactacatccttatcacagaccggacaccggatcacacgatacacatcacgaccgccagtgtaatcagtagataccttttctttgacatcctgcgcagtgtatgacagaacagcaccacaacgacaggcagtttgttttggggtaatgcttacaacttgaaccataataacctcacaaaaatagtttcacttcgctaccgcatttcgggcagacgatatgttttttcacgatgtaatccgcagcacggaagaaaccgttgtagaacacttcgtttttcttctgtacatcagacagttcatactctaacccacttttgcagttggcgcaaacggtaattagcttatcggacggaataatgttaatcatgtatacctcacgaaaaaaggggggacgaagcccccttgatcaaaaattgtcttcaacaaaagctgcaagtcgcccacgatatacggtatccaggatcacatgacttgaatgaccgtactctttaagtttttcaaccgcatacacaaagccgttgttaacagcagtgttgcgcgggttgtcaatctgtttaatgttcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacgtatttgtcaacttccggttgatccttaaacagaatgttcaggctcgtaatacatggttctacagcaggacgcagtttttcgccaagagtaccaggtaagaatccgatttcgcccgacagagggctatctgccttgacatacatcaggtttgcgaagtgtcccgcgtttaccatgtgcattgcaccagcaacagccagcatggttttacctgaacccgccgcgcccatgatggtcacaacgtcattgtttttgtccagaatagcatcaacgaatgacgcttgcagagcatcgcgaggctggattgttttcatcagcttacgctttaacgcctgttcgtgcttaataggcaacacttcaagctgatactctccagcagccactacacgccctacaagttcaccatccgatagaatgtattggttagggtagaaatccgcgtcaggaagcgatgaatacgttataacggcaacaggcccgacatactccaggacttcaacagtttcccagaacagaggcaggtcgatataacctgaatacaacacatcactatctttcagcgagtcatcgccagtgtattgaagaaccgaacaacctttagacatcgcgatcaacagcatgttaatgtcacgagtcaccagagttgcgccctgctgaatacaagttgcaatgatccgcgcatcctgtttatccagagggaattcttcggtgccgtcataatcgacgattttcagtgttacgctttccggtactgctgggttcgataagtttaacgaaactcctgtttgggtaattgcttcataattttgtcccaggattgctttggacaaaagccggatcgccagtcgtgcttcatgagcggttcgctctttgcttttcaggtgatccagttcttccatcgttgcagcggtgataatgatttcgctgtcaggttcgatgtaagaatagattgaatatgggttactaatcaaaacattggtgtctaatacgtattttgacatacattaaccttatgtggtttcgttaaaaaatgtgccgaaaacctctttcgctttccggtcataaacggcttttgcttcttctggagtggtataataccccaaaaattttctttttccatctatgtttatctgcgctttgtacttcccatttgctttgtgataagaaacacctttcaaccccgtactgctgtttgaattacatttctttttcatcgcgttttgttggttcgtcgctttctgtagatttcttgctgtatctccattttcaacaccatacacatgatctacgataggaggaagataaccattctcaacgtaaaacactattcggtgtcgcaaatacatagaacctttaaaatgaatttgggaatactcgttcttgcttccggcttcacttccaggagacatagtgccgcgctgaattttccaatacacttttcccgtagatgtatcaacatctacataactcagaagagactcaatcccttgaatctcttcctgtatggttcttgatgaataaccatgacttttcattacatacccaaacggataatatggatatatgggaacgggtgaagatgacttgaacgcatacacaaggtcagcgtttttgccagttcaaaccgttcgtcgatcgtcgtgtcacattcatcgaaaatcaggttgattgcctgatacttgatggtctgaccacgaaagattgtccgcaaatcctgttttttggaaaggaggatcacgttatcatccccgcgatcgataccatttccgattgcttcatccatcgccatttgtttcgtacaagcaacgtagatattcagtgtccctttcgactgcttgatgatatcgaaagccgctttggttttacccgacatccggcccatatccagcgcagtttcgaagattgacaccccgccgcattcttgcccccaacgcccatcaatgattcgcgcaaggtgcaggttacgtgactgctttacagcgtcaacatagaattgtgaaatcatgttgtcgccttatgcaagttcaacgtgtggtgcgtcgataaatttcgtttcaatcggaaggtttggatcgttcttccagttgataccgtaacgcagttttacgccctgttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccaaagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaactggaacaggcgatcgtgtaatgcttcgatccgctcatacgcttgtttcaggatcgtcttatcttctgggttcgttgtctcgatgcagatcagttcgtccgagtcgatagcgatcacatcatccatcagtgaagcgaatatgttcacgtcagggtgtgtcaattcctttatctccgcttccatcccgtcatgctgggataacagttcgatgatatcgcgctgtaaatctccctggtacgggaatccggtttgaagatgattgataattctttctgctttggtcatatttcacctacaaaaaagcccctttcggggctgggattaaatgtctttgcactggcaaacaccgtatttggtgaaaggcttgtcaccgctaaggtaagaccagaaatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgatgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacatcatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcctgttcgcttaacttcatcgcgtaccgttcgatgatcgcgattgacttcggatctttaatacgcccatctgtacgacgcgttttaaacgcgctcattaattcatcaactacggcggcacacttcatatgcttcatccttttcctgtacagacatccgattatagcggatctcttcgcgctgttcaacttctctcacggcttcggctttcttttcagcggtcagtatgtgatgtactacagcgtttcggattccccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgctggaatgtcaatagataccggaaccattcgcatcgttgaatcattatgggattgataaatcatcagaatgtaatctccgcaaactgcattctacgctcaatcgcatggatagcgttatcgcgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaagcgacacgtccagaatatcacgatcgcggacatatgatttaatacgagatacgattaacattatttcaactccactgcatatacatcggtttcaggggctttgtgtacgcgcatatctttaccacataccgcataagccggacagttacggcaaccgttatgatccttgttgccagtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctaccgagtcgaaagcgacatcaaagccagcgtgtttataaaccgataccgcaacagccccagcaaccgccgctaaacgcgctgcaacgtcttttgatacatcagcaatggtaaggttcggcacaatgcctttagaacgcgcataggccatcatatcgaacatatcagggtttgtttgtccctgtgcatcagcaccgagtgcgcattgagttagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacatgggattggaagacagcgcgagcaaggctttcattgtcgaacggtatcgactggtgtttctctttgctgtcaatgttaacgcgccagaactcactcgaaccgtttttggtggagtaatgcatcagcgttaccgttttattcttttccaggaaagtacgtttgtcaatctctgttttgagttcgtgttgcatcattttacactccgtttcagtttacgttcgtcagccagttcttttttgtacagtttaatgtacttcccgttaagggtgcgaagctgttggaaaaccttgttgcacaaagcacgtttcgctttgtattccggtgtattacggattgattcgatcgtcatacccatttcgtttttagggtaagcgcttaactccgctccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactacaaatggttttgttgtcggcgttgacttcttcaacaacgatttcataaccccatgccccactgtactcacatttcacgttccggtacttgatgtaaactgctgcaacatcttcttttttgtagttccggcttttgtagatgatttccatgatttcctccttcgtttcgatgtgtgtacaataacagatcagggttatggagttttagcaattcgtgctaattatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgttttcctttctctgtttcgtttcgatgtgtgtaatataacaaaagcccctggcggttgcaaggggctttttaaacaaaaagtgctattttgtttcttcgaggattcgaaggatttcggcgcgggtgattggatgttttgccagctcacggatcgcgtggtcaacgtgtatcttacacatcaaaaacttctccccgcacttgtcgcatgttgcatacatatcgccatgtatacgcccgattgcatcagtcacccaataacgcatccatgcataaggagttccccgcatccatccggtagcaacatgattgcatttacgtttaccgaacatattaccacccgttaggattgcggaaatgtgtttgccagtagcgcagttgttcgcggttcatgttttggttatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcggcttctgattctgctttttgcttgtctcgaagcgcgagtgacagatcgctaaccagatccagaaccgtttgcggatctacggtttccagatattttccgagaccctcttcccagcttttaatctgtgtcgggctatcgccataaggaacaccgtatgagaacgcgcgtttatactctttacccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacatatcagagcgcatcatattgaactcgatactgttctgttcaacgaagttaccgatcattgatgtccagcccatcaccaggttatatccgtcttcggataacccgtaagccaggttaaccctgatacaacgcttatcagccagttctacgcggatacggttgcttgtgttagtcactttactggggaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcattagaaacttcacaaccaactacagcggcaatgtttttgttcatgttcatgatgttttcctttctctgtttcgtttcgatgtgtgtaatataacaaagcccctgcattgctgcaagggcttttttcactttaatcgaatttttctggcaactggtctacaagtgcttgagtttgatgaagttcttcactcaatttatcacgataatgaaccaattcgcgggttctggatgctgaatagctaatgattttatcagcgttagccatgtaaccgtaaccagcacacgcgatttccagttttgcgttatcgccgttaggtacgcggatatgagcatacgccagcaagtttttaaccgcttgcaacagttcatgatcttctttgccgatgataaactggtttggttctgctgaatccatatacagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttgccgtcgatcacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccatgatcgcgtgatcgcgactgcgaaaagttaactgatcgcggatacggttatgaaccggaatatcatctttagacatgattcaccacccaacccaacaaaccagtattgatagccgcaacggtaaggcaaatcaccgcatacacccgcgcgttgtgaactttggttttcagttctgcgatctcctgatccttttcactttcgaactcttcgcgggttccatagtaaccaggatcagcagcggttgcgggacgaactgcatctttttcaacgatggttgcataaccactcgttacttgcgttgcaccgtaccagtcaccgcgatcggtgttgatgatcaagtgatcacccttcgcgttagctttatgcttcgacttgccaatgacaattacacgttcaccattcataatataatcactctttcacgttttgttgtaagaactctaacagctttccttcggcctgtaaagcataaagtttattcagctttgctatgttctcaaagtctgatttttcgctgaacgaccagacaccatcatcggaaaccagcgcaccaaccgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtcctggaagatcgcgaatatttttcacggtgaatgaatcaccccatgacttatacgcgataggttcagcggcgcgggttgcggtagccagaaggatcatttggcagatttggaaagtagttgcttttggtttcatgatgtatatcccacaagtttagtcagtaaattccccatagtcttacgcgcatgatcgcggatctggctatacggaacatatttgaaaccgtccatttctgtgatggttcgcccgttcttcacgaacgttgacgcacagaagcatttatcggcttcggggtaattattgcctttatacacgaataagtaaagctcttttttactggtataatccagtcttccgaggctttccagttcgtgcggttcaacaagaactccggtttcttcgaagcactcacggatcgcagcgtgaataggttcttcgcctttttcgatatgcccctttgggatgtcccaatgaggcgtttcggttgcgtggcccattaaaacgctgccgttattcaggaagagaataccagcagaccgttccattactgcaccctgaacttacgatcgtatgctgccagcgctttatctgctgcatcaacagcctgtgtgtgtttgttagcggagttctcgctaaacacttcgcggtaaatgctaacccagagagatcggcgggtatgttcgctttcttcgttgacacgagaagccgcaaaagcgttatgctctttgatcagttgtgcgaattcagcataatgatcaatggtttgttgttgaatagctgtagaagtcataattcacctatttctttcagttcagttttgagtttttcgagagtcgattggtactgaatgccgttttctggatttggcagacgggcataatacagcgtaccagttttgttgatgtctgacaacacctcttgatcgagggtagccggatcgatgccaaaagccattttaaacatggtttccgcgtctggggcgaatccgtgagagaatgcaaaccccagctttttatcaaactgcatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttactagatcggtaattttcattcaatatatccccaacgaatttttacgttatcttctgacgccggacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagctattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaagtaacattgaagtcttccatctgatcaacccagccagaatccggtaagccagaaggatacgtgttaacacgtttgacttcgaaccctttaccctcgcatttcgggcatttgtgtgggtactgggatttaaccatactcagcagttgccccagcgttgttgaacgatcgaagcgttcgaccagtgccattacatcagcaatacgaatcgaaccagcatcaataacggtatacaggtttttcggtacatttgagcgcatagtatatttctcacttaaaaaattttttgatgaaagagaggaacaatccaccaccgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaacaccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttaggtgcgatgtaattaacatggatcgcgtttcgcgtgttcaggctcaacgtgtactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatctcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatatttgaaatactcaatctggcgcagacgtttttccgctgcctctttcgaatcatattcaccaagttctttcgtgcgatcatggttcagcacaacccacttatcgccgcgatgttcgatgtgctccgtgatgtcttcgactttcttatccagatccagcggttcagcatcttcccggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttaaagcggctatggagataatcagactccagaactcccacgatcgtattaccgtatttcgtttcccacttctccacgtcaaccagtcgggcaggttcagagataccggaggcagggaacagatcaaccgtcttacggctatacacaatcgttgtatgcagttttgcagcggaaacaggattctctacacccagaagtttttgcaccttcgcgagcgcttcacaggaagcctgatcgaacttcgcacacatatagatccccggatcaactacgggtttcgctacttcaataaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttgcgtttcaaatcgtctaacgtaccattatttaggattgtataatcactcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaagcgcaattgaagtccagatagacggatctactttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcaataacttcaacatttcggaagttatgcacaaccatttgagcaacggtatctttacccgttcgctttttaccacaaataccataaatcatttttgcgttttccgtggagtaggcacgatcacccttccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaagtctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacatttccgtatactttttatacaatcgttaactatccgtcttcgcttcgcttgacggaactcgcttcgctcgtaaccttgaataatttagttgatctattcaataaataggtatatcatacccatactttcaaaagagattgaaaacatgaaatcattcaaagaactactttctgaatctgttcagaacaaaaaatttgctaagaccgttgatctggttgaccgtggtaacgctgcaaaaggtcagatcggtttcctgcatttcgcacatggtgctgattacgatgtgtatgcgccggactcccacgatctcgcttacttcggtaaaggtgttgtccgcctgaaaggtaaaaccactggcaagactcaggcagcgtatattgactgggcgaaaggtactgtttcattctacagcggtgatcctgctgatgacctgaaattcgacaagccactgaaattcaaaggcgcttctctgtacaaagaagcagaagaaaacctggatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaaacctcgtctggtatcgggtaaacgctttacccaggaatacaaaggtgatgttctgtctaaactggttctagctgaatcagaagatttgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggcaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggggcgatctctgcaagtggtgaacgtagatgggctggcagatatgctttgatcatttgatcagccccgcgcattcccttcacgttgttccaattgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggaagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggtttgtcttcttctgcgatgatctcgaactcaaaaataaaactcataattccctccgtttagggtatttattgccctttccatccgaacacacgtttcaacgtgtcctctgtgatgattttgaactcccagcccttttgttttgctgctgcattcgcggctttccatttgtcaatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttttatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagcgattatatcaaggaaatggaaaaggcaaacctatgaaatacggtggaaataaatactcccctttctttgagggggtggtcgaagaagtcgatgatcctcgtctactggggcgtgttcaggtgcgtgtattcggtgagcatccggcacagaaacaaaaatctgaaactatcggtattccagttgaggaattaccgtggatgatgcctattcaggatattcgcagcgccgctatttctggtgttggtttttccccgactggtatcacgcgcggtagtttcgttatcggttactggcgcgataaatggcaccaggacggcgttatactgggaacctttgctggtgagtaccgagagaagccggacacccagaaaggcttctgtgacccgtttggtgagtatcctcgctatgtaggtaacgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaacccagaagatccttttgttcctggtgatactcgcgtaatgttcgaggaacctaaatccgcatacgctgctgaatatccatacaacatggtattcgaatcccgttctggacacattcaggaattcgacgatacaccaggctttgaacgttacaaccgtgttcacccagcaggatcatacgaagaaattcgccctgatggaacccgtgttgttaaaatcgttggtgatgattatcaaatcgtcatgcaaggccgtaaattaaacgtcaagggtaatttgcaggttgttatcgagggtgatgcgttcatttacaatatgggtaacgttcaacagaccgttgatggtaacgtgaccgagttcgtgcgcggtaacgtgaatcaaaccgttgaaggtgaatatgtggggctgattaaaggcaacgcagaattaaccgttgaaaaagatgcaaccgtaaacgtgaatcagaatttaatggctaacgttaaacagaatgcaaccgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggtactgtacaggtaggctaaacatgatcatggattatgaaaccatcattgatgggattatgcaaaactttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatttgttcaagaaccctggcgaactcgcgatgtacaaggtggaaaactccggtggttacttgctgacttccggtccccgttgcgatccgcgaatccgacaggtatacaaccagactacaggcgcgtttaccagcattgattactactggaatggtaatcgtattgcgtacatgaaacacgacgaatcccccgcgcaccagtgcaaatatacagggatgtcagtaaacacgaacgcagataccagcattcctccggttcctccggctctcccgtcaacgtatggggcgctaccgagtgaagccagattgttttctgctcgctctggattgggctgtattccggcgaccgtggggttcccgtatacgaatatcagcgatgctatgctttccgcgtggaacgagactcgtaaaacgttcaagctggctttcgatatgctgacgggtacaattaaaaatggctctggtatcgcgacgatgtttgacgggctttcgatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgattccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctcccgaaacaccaaacccgctttggtctgctgtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcattgtatgatcaggggcaagaactattcaacaccctgaaagcacagacacaggaaagggattcgattaaacgtaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaagaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtacgtaccgaagtcatctttgatggttcgactatcctgatccgcgatccaaacatcgaccgtagccaggttcgcgttaccgtcaacggcgcacaatgggatgactggacaaacgaaagtatcgtaaacgcaacgggtgcatcaactgttttttatatgcgtgaaactgttgatggacataccgaagtttactttggtgaaggtgaaaccagccaacaggtcgctggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgaatattgttgagaacccgactaattcagcggactatgtaggcgctgatggtggtggtgaaccggaagatatcgaacgtattcgcgaactcgcgcctatcatgcgtgagacacagcgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgcttgacatctgttcaaaaagaggacatgcaaaactatctggcgaagtataaccttgcgactattacgccgtcgatccttgacccgaactatctgtatatcgtacaaagcatcaaagtaacgtatgatatcagtaagttggttgaatcagaggaatggttgcgtggtcaagtaatcaacgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcgcgttctgttgtttcgaacgggttcaaatacacaaacgctgctggtgattcgtatgacgtgcgttatgcatcaaccgatatgaacaccacaaccggacgtgcaaaaattgttatcggaccattcaaaaacggtgatatcagtatcgcagcttatacaggaaccgattttgataaatatcctggagtgaccgatcgtaataaatattacgaagtcggctatgtggaacactacactgatttcattagtttcgatctgggtgtcctgaacgttccatccgatcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcacccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaaggacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttattgtacctgtttgaacgttttcagaacatggcgaaggtgtcaaacgacaaagggcaaacatggcattactacaaggcgtttaacgaccgcgtaggaaaccctgtatcgcgctctgttgcgtaccaaagccgaaacacaacctatgtactgggttacgatcgtatcttctacgggcgcacctcaacggatattcgctggtctgcggacgatgtgcgattctctgctgatgatgttacgtttgccaaactggggaaccagactggccttgatttcgacgtagactcatacaacacgtttgctaaactgcctggtaacgtgtcgaaatatgcagaagcaatggcatgttccgatgactggctttatgtggttgcgaaaaacgttgtgcgtcgtatcgcgctgaaacagacaccgatcgacaccgatccgagttctccaacgttcggagaaaagattttcgatacagcaagctatacaattgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggcaagaagacacgaaaacctttgtgcgcctgtacgggaacaccgagaaagaacgtttttatatccagcatgaatacaccaatatgtcaacgaacggcacggagatttttatttccgtagcgaactacaaatatccaggcacacttcccgatcctgaattgttgatcgagaaccctgcactggtcggtgctgtaaaatatgatttgcgtcctggttatactgccagccttgcgattaattttgcgacgattcgcgctcatatcgacgacccgactgtttggaaatttggtgcgcaggaatattacaacgaggcgaattatagctggttcttccgcgactctgtgcgcacatggatcactaatgataaccgtcctctggtggtgtatccgaaaatcacctacagccttgtaaccgatagtgctggtccttcgtcatcgcttcgtgtgaacaaagaggtatgggatcgcggacatgttacgatttacattaacaacattaagtttaccggattcacaaagtatacgaacggcgtgttgctgtataagagttcaggcgaaatcatcgggttctttgaactgagttaccgcgctcgcgataacttaacgattttctggaaaccagacaatacgttattgattgccgatcttattcagcaggaacgcgaaaaaccgtatcaaccggatctgtcacctggtttgattgacccagatttaagccatatgattacgcgctttgcgcctcaaagctatctggaacagcagtatttcgagaagttcggggaatactatttgcagttcgtttcgctgggtgaaaacacctactataacaagctgctgaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctattcaacgaaaggcatcgaagcaagctataaattcctgttcaaactgttgtataacgaagatgtaagtgtagaaatcgaaagttcgaacactctggaatatgatattctggttcattcaacaaatatcaaccaggacattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgatgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacagccccgatcgtaactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaaccccaaaatcttttacattaatgacatcgtggttgtaaactccgcgccgtataaccgtactgactacggtaaaggatggatggtataccgcgttgtagacgttcctgatattggctcttgttcaatctccagtatcacgggtaaagttgaatgtgtgcgtattggtggcatttggacaccgacccacgaatcgatcgaacctccacgcggagaagcgaacggtatcgacatgggcgacggctatatctgggaatatctgtatacaattccaccagatgttgttatcaaccgctgtacaaatgaacatatcgttgttccgttccctgatgaacttgaagaagatccggttcgttggggttatgataacgtgatcaaatggtatcctgatatgtacgatttggtgtaccgaatgaaggttcactcaatgcgattccgcgcgtatatggattccctgttctttccgcaagcctctttacctggcaaccgtgggttccgtcaaatcagcgttattgtaaatccgctgttgaaaaaggcgcaaccatccgacccagaagtaaaagcaacggggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggcgacccgctgtatgacggcggtgttaaacttaacgaaatcatcaccaacgtatacaacgcgtttggtgatgtgcgtttactgactgcgaatgatggtgtgggtacaatgttactccacgcgaccggatatttccagaaattaccgcgaacctattattcaggaaacccgattgaactgggttcactgcatgatatggatacctctacagggccaattacggttgtgcttccatcgggtaaacccggcgaagggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgagaatcgcattaaattctcgattaaagcggttgacaccattaaatcagggatcgcagcatgaaacaagaaattcttatcggtaacgtggttgatgacggcgcaggtgattatctgcgtcgtggtggtcaaaagactaacgccaactttaccgagttatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcatacaacgtccgcgcactggaagtttactatcgcggtaacttgctgtacatcgacgataagaacgggtttaatacatcaaacagtgattacggctcgcctggtgcgagtgcaggacaactggtagatctggatggtgtaaacatccgtcttaaaaccccgtgtaacgctggtgacacgcttcaattcgttacctatctggatggtattgctgcatggcgagcgacgtatgaagcgcataccatgcgcgtatataacacgggtgacacagaacaggttagtatccctggtgaaatctgggttggcgatttatcaactaaacgcacgtttactaatgctgaatttgggatcagtccccgaattttgattaacccaaactcgttcgaactactgttgaacggtcgccagcttgttaaagcaggtgatgcggatctcccgacatttgtttgtgagggcgcagaaggttatgatgaaagtagctgtattgcgaactccggcgcatgggttccttctggacaggattacagtctgatttttgttaactccgtggttacgggcattaaatttgctcaacctctggaatcccgtgatgtggtaactattcgctggttcaacaatgatatcggtactgtcatggaatgggacggtgtaggcggtattaaagaacacaccgataagatttacctgaacaacgaagaagaagtgacgctggttaatcagatcgaatatactgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggcgattatatgggctttggtatctggacacgttacgcggaaggtatgttccttgcaggttggacaaccgatgcatcggatagcgattttggtctgaacaataacgatctggatggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcgaagcagactttttgcaatatgaaatgggtacgaaagaaccgctgattggtggtaaacgtactattggtggtgcaaacgtcgatcagcttcgaaaaggggtagattaccctaacgtacaatcagcaattgatgacctgtattctttgtctcagcagatcccgatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcgacaatacaacgaacgcctctaccgtatgcgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacgtggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggattgcctaatgccgcgcctggtgtgcgcggtattgctgctattgcgacacaggcaatgattgacgcgggtactgacacacagacgattgtaactccggctttgctggcgtatcgtttgcaaaaccctcatgcatcacaaaccgtatggggttacactcgttacgcaactgatgtagaatcagtaacagtaacaaacgatctggtttctcttactccgcgctcgttgaactatgtgtttaacacccgtcaggcaaaagaaaacgtttggggttctgcgaaactgtcaacaactgctcaggcaacgtccggtactgatgacactaccgcaatgactccgcttaaagtgaaacaggcaatctctgctctggttccggtacagtcaaacgcaacagaaagttcgtttggtcttgttcagttagcaacagttgcagaagtccgcgcaggtactattcgcgatgggtttgcgatttcaccatacacgtttattcgtctgactgcaagcgaaagtgatttaggtttactccgtatcgctacccaggcagaagtaaacgcgggtactgataacaccaaagcgattaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcaattactgctgacaataaataccagacaaagacagacgttgacgcaaatatcccgatcggatgtatgatgcttgcagcgtttaacgccgatgttggtaacttgtttatctgtaacgggcgagcgatgaaccgcaattcaaacccagaactgtttgcccgaattggttatacatacggcggttctggtgatattttcaacttgcctgatatgcgcggtcttgtagctcgcggctttgatggtgggcgtggtgtcgatacaggtcgcggttttggtacatatcaggctgatatgtttgcgtatcacgaacatgatctccagatgatttatcagaacggcggtaatcttcctaagagccaagcagtttatgaactgaaaagcgcggaaaaaaatgaccaacgtgttatgcacctgaataacgattacagcaaagcattaggtactggcggaaacgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaagatgaactgggtgcatatcctggctttaacgaagatggtgatgttgatccgtcctctactggctccggcgtgaaatacaaggtaatggctaacgctcaggcggtatctatccatgaagcacgtattactaagctggaagatgactgggtaaactcagatgtaggtaatttaaccgatgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtattgattcccgcatggaaactgcggaaacgaacattactactctgcaaacccagatgaatgatccggttgttggggttctgcctcgcgtaatccttttggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactctcagccaacaagcatcaaaggccgtctgctgaatgtggaaaacacacagcgcgacgaccaccaggcactggttgatattaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggactaactggaacagaataaagcctctcaccaggatgttactgatgctctggttccgtatatcacagaagttgaagcggataacaaatacgaagcgaagaaagttccactgtcatttactcaaaatctggtcggtcgtaacgattatatcgagggtgatgctatttctttatctgttaccgttacaggtggtaaactgccttatgtgtaccagtggaagaaaggaaccgcaaatatcgggactgattcaccgagtgtaattatccagaacaccacaacgagtgattccggcgtatataaagttgtcgtaaccgacgctgaaaataccgtgattacttctgatgaacttgacattgtggtacatacggttcctcagttcgatacaaacttgagtgatatttctgttgttgatggtgatccattgactctggaagtagtgtttagcggtggtaaaactccgtacacttacgtatggcataaagacggatctgtattgagtggtgaaactggttcttctatcgtcaagtctgctgcaaccagcgcagatgcgggtgattactatgtaaccgtaactgacgcgatgaacagtaccaacgattcagcaaccgcgactgtgactgtaacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggtgatgataacccgcgcaacgtgttcgacttgagcaaagaacacatcttcgcgatcacgaaggtattgcgtacaaacatgggttcattgaccacaatggacggtacagcggtttatccgtggtttaccgatttcctgatggggttgactggtggctctctgggtgggcgctgtgcatcgagtgtgtacggtatgaacgcatacggcgcggatatgggctactttacccagatgatgtcctatcaacgctcaatgcaagacctgctggccccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtgggcggtgtacgagcgggacagggttcaactgttacgggcggaacgtctgcatataacaaccgatgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttctatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgtgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttattttcctatggacaatagcctgtttgaaattacgtgggtagaagccgatccgttctatcagttcggtgatcgtcctcagcgtaaaatcaacctggcgaaattcatctacactggtgaagaactggctcctgaattgcagcgaaatgaaggaatccatatcgaacctgatgcagaactggatctcgaaccgattcgaaatcttgacgggctggctgatatcaacattgaacagtacgaagaagacaaagaatttgaaagagaaggtgatgaattcatcgaatcttttgatgttgtcaacggacgcggttcaccgtttgcaagtctgccataaatacgttatatgggtataggcgaaagtctataccctcttcgaagaggattttatgatatacgcaaaacttaaagaatggttgcctcatgatctatacgttgagtatgttgatatcataaaggcttctccaaaaactgaacacacagaaaaacatcacatattaccacgttctttatttcctgaattcgaacacgaaccggaaaatttagtagaacttgatataatgaagcatttgatggcccacaggacattagcaaaaaccaatgatcctaaaatgattcttgcgttcttcatgatgttcacctatgaacacaaacgctattcatcgttatctgaacaagaacagcagttcattcttgaagaaaagacaaaggcgcgaaaggcaatgcgcattgttaaaaaagaacagatgaaaggcaaacatgacggtaaaaacaacccattttacgggaaaaaccataccgacgaattcagaaaaagaattggtgctgttcataaaggaaagaagctatcaccagaacatatagcaagtctcgttgctgctcacaaaggcaaaaaacgagaaaaggtacaatgcccccattgtgggataatgtgcgccgctaatacagcgaagcgctggcactttgataactgtaagtctggacgcgtccagcagggggattagaaaatttttggatactggtataatagctcactacgcaactacattgttcttatgggacaattgtttaaccatgttcaggttaaaagagtacgcggcgatcaagaaaaatacatcaaggttccgatcacctatgcatcgaaagagaagtttctcgcttccatgaacaaacttaactacacgttgagtcaggaaaacgttgctaaaacggaaacaattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccgtatcgtctgattttcgaactgggtgtgtatacgcgatatgaagatgatatgttccagatcgcagaacagattttgccatattttcaaccacacttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatttgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagattgcattacacaacgcgaagaactccgaatcacctcgccacgtcgaggtattcacaagcctgatgaatcagttaaacgtttcaaacattggcctgatgaagattcacaaagaaatgcgtgagattacggaagagactacaaaaccaggcgctgaaaaaggcggtggtgatggtttgaatatcgagaatgcaaccgtatttgttggttcccctacggaactaatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcaatgtctgcggaagttctggatcgtaccaaacaggcgatcgaactactgcctgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggcttcgtgccttacacggcgatctggacatcggttaaagagcgattgtatacagacggcgacaacggtacatttgatgacggttattcgtggtctgcgaaaatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaagtacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaacagcggtcgttctgtaatgacctacgggccacagaccgataaccagtacgcttttgttgtgcgtcgtggtggtattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctctctgatggtgaatattccactggcaacagcggttgataacatcattgaatggcgtactggatataaactcagtggtggtactccggttgacaataacctgaacgtaagttcaagctatggcttcctggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggctgctacgattaccgtgtaatctgcgacaccacgaacaacacaccggacgtaatcgaccgtaacgagtttgtagcaacgatctacgtgaaaccgcctcgttctatcaactacatcactctgaacttcgtagcaacgtctacgggcgcagatttcgatgaactggtagggccgcaagccgtataacgtcaagggggctgaaaagcccccataaataatccgaggttaaaaatgcttactgacattttacgcgcctttgaatccggtgatttcgcacgtccgaacctgttcgaagtagagatcccgtatctgggcaaaaactttaaattcaagtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccattcacggtcttttccctactaacgtaggcgaagttaccctggactgggacagcaacaacgaagtgtcaacctttgaggttactttcgcgctggactggtgggaataaaggctataaatacaggggtagcaatacccctatcattatttttcggagttactatgaactttttgggctttggcaatgtacttagctttttcaagaatttcgcccgtgaggacgaattagatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcaatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgtggttatcgcgaatttttcgtgtatagcgctcctaaaaatggctatacatacaacgggcagatctaccagcataaccagaaggttaaaatcccgcgctccgctatcgtgtatgcgcattctggactggaagattgcagtaacaacattatcggatatctgcaccgcgcagtcaagccagcaaaccaattgcgtttactggaagatgcgatggtcatttaccgtatcacccgcgcacctgaacgccgtgtattctacatcgacgtagggcagatgggcggtaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgctaacttctctgatatggatgatatcaaatggtttaaccgtaagctctatgaagcactgcgtgtgccattaagccgtatgcctcgcgatgatgggggtatgcaaattggtgggggtggtgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagtaaaatttccttcattttccagcaggattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcaattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcagtaggcgttgatgttgtttgggggccaagcgctccagatgcttacgttaagccgattaccgaatctcagtcaagcaaaccgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaactctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtgtcgcgtacttccagaacgtaacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagaaccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggcatcaacccgtttgcgaactctcgctctcaggctccggcagatcgtatcacctctggtatgatcagcaaagaaatgtgcggtaaaaacgcatacttccgtaaggtctgggttaagggcttataagttgttgaaaaacaacgactttttaaagggaaccttcgggttccctttttgtttatataaataatgaaaactattgaggctatattatgaaacacatcatttataaaataacaaacactataaacaataggatctatatcggcgcacattcgactgatgatattaacgattcatacatgggttctggtaaagcaatcaaagcggcccaacgaaaatatggaattgataatttcgtaaaagagattttgttcgtgtttgatacaagcgaagaaatgtatgaaaaggaaagggagattgtaaatttggatttcgtcaatcgtcccgatgtgtacaatatgggcgtaggtggttctggtggtcctatgctgggaatgtttcattcagaagaaaagaaacatgaaatatccaaaagaactcgtgaaagaatgacaccagaagtaaaagaacacctttcaaaaataaaaacaggaaagaaacaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtctgcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgatggtactgacgttgtttatgaggttatcgcaccgattaccctgaacactctggatactgacaaagacaccgcgatcatgaaagctgtgttccaaagcaaaattcgactggttagcgaagccgctgatacttctaagtatgaaaccagtgaagatatcgagtcaacctccttccagatggatcgctggaatattccggtacgctcgcgtaagtttaaaaccgaaatgacggttgaactgatgcaggatttggaagcgaaccagttcgaagctgatggggtgatcgaagacattctgggaaccgtggcaagtgaagaagtcaacaaagacattattcaaacactgatcaccgtttccaaacgttacaacgttgatggactcgttacggatggtatttttgacggtactaccgcatacaccgcgaaggatgctccagcattgggtcgtatcctgtaccaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacacaaacagcccgttcgattatatgctgactggctgcaaatatgatctgggtgatatggatcacgtaggctctctgttcttcgctccgtataccgaagctgacgaagcaggttcaatcaaagtatccgtagatccggcatccctgcaaccaaaagttgctattctgatgcgttacggtctttccgtgaacccgtatactgctgaaagtgattctgatcgcctgatcaaaggtgatgattggtctgctcttgcaggtaaatctaagctgagtcagatcgtaggtattaaattacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggtccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagtggttgtatcgaagacgaacgcccagatttatagcagtaaatataattgtagggcaagggcatgtttaccgatggatgcattttcataatcggataaacctaatggcctatatggaatgcaacatatattcgtgattgggatttttttctcaacctggaacctttatgctaacagtgtgcaacggcacgaactacgattgactaccccgcaaatatacgattgcatgttgcggcgaatgtgtcacagtaccccttgtggggcatggctggctgattaatcagcttacgcagtttagaatagcggtgacgacaccgcgttaaaaatcaactatgcttcaaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattctgcaattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataagcccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctcagtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgctttagccgattacgctatgactgtgtttgcggttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttggtctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagctggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgtaacggttatctgtataagctgagtgattttactcctgctgaacctgtcgtaacaattacaccgaaaaccgctcctgctgatttcaaagtaggtgatgcggatctggctgcaactgatctgtttaccatcgatccttctggtacagcaatgactctgagtgttgactcttccggtcatggttctatcgttggtggtaaacttcatgcggttagtgaaggtgatgttgtcgtaacagcaacctctggatctgttactgcaactctgacggtaaacgttaaagcacaaccagtaactattaccgtataaactaagaaggtaaacaatgctgctatttgaattcaatgatgtattcgcaaaattcagcgatgcgatcgaagccaaatttggcaaacgtcctcaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgtcctctgatctcccgcaatgataagcatcgtcaagcatgggatagcgcagggaaatatcgtagtgttttcctgaacgacgatatgaacatcactattcaggatgtgaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatgttttctttctgataacccagcgcttcaacatcacgggcgatacttgccagcttgctcatgcttttcagggttacgtcaaagatcaggtttggtttacggtcttccggtgctgctgtgataccagcgtacacacgcgcctggtttttgttggatacgttgaacacgtctgcgatcacatgatgcagtgttgctacgttgtccgggtttttcaggttcattgttttgacatcgtgaccagttttcgctttgatctctgctgccagtttggtactacccatgaccaattttttgagtgcgtcaacgtccagggtgatcccttcgatacctaacagcttttcgagggtgaaccctttaccagaacccgcgccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgtgtttatagtgcaattgttcgacggataggccggaagaactttaaccataaggtaacaattatgaaaaatgaactgcatgaattcatcaacgccgctgctcttggcgaccagtcaaaatataaatcccgtcgcgataccctgattgacgatttctgtaatctcttggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcatcacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtctggagaatagcgataagctgtaatctctgaaaacaaggagataaccatgaataccattaactgccgcaaagagttcgttgagttctatcacggatcatgtactgctgccggaatcgaaagcatgttgttgcctccttgtgattctgatactctgtctgaaaaaggcagaaagaaaaatctggatcgtgttttcttcactgctgatatcgggctggctcgtatctatgctggaagggctgcacgttcaataggtggtgatccggtactgtatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcctggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatgatgtgtaaattgattttgtggtatgctccgatcggttcagatctaactcgcaaaatcgcccgtggttatatcatgacgaaacgtgagtttgaccagatctggaacgaacccgactgtttcgaacgcgaaaaatacgaaaatgaggttagttgtatatgaaactatttcatgttgtgtatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttaatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaggaaattgagcgaattcgtgctttccgcgcagaaaatccaaaagtgaaacatgctctgcgccgtgtgtacattaataaacatcgtgaagaacagcgtaagcctaagaccaaagctaaacgcgatccgcgtccagataacaaacgtaaagcaatcaacggcgctatggcgctggcattccaggaagcgggtttagcgtaagaggtttacatgaattcttcaatgatgaatcgctggtcgggcgtgataacttcgactatcaaaaaggatttggtgaaggttgaagcaaaaccaaagccagtagaaccggaatcactcgatcctgctgagttggaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaaccagtatgttcttactccggcagaccatttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaaaggttaaattatgtttgtgaaatattcttctctgactaaccattatgaaggtaaattcatcaatggtgtgatcatgaatggttttactggttgtgtgtgggttgcgcgtgaaaagatccacggggctaattttagcctgatcacttcggacggtatcaaagtcattccggcaaaacgtagcggtgaaattctccctgctgaacagttttacggttgtgaaccagtagttgcaaaatactctgaacctgttcgtaagctgtgggaaattctagcaaatacctgtgaatataaggaatatgctgatactggttctttggttgttcaggtatacggcgaatttgcggggcgtggtgttcagaaagatgttgactacggcgaaaaagatttctacgtatttgatatccgcgttaatggtcaattcctccctgataacgttgttgcaaattacgctgttgctgttggcctgaaaatggctccactgctggcatacggtacgtttgacgagatccgcgcattgcctatcacctttgattcggtggttaacctggcgaactccggtgcgatccctgcaaagaacggtgttgaacctgagttcaaaaacttcatgatgttgaaagatgatgaaggtgagaacatcgcagaaggtttcgtgatgaagcctgttcaacccgctttcatgccgaacggtgaacgtgttgcaatcaaatgcaaaacgacgaagttcaccgagaagaagaacaagcaagcgaaccgcttcaatgctccttctgaactgtcagaaacagacaaagtgaagctgaacgaattcacctgcttcctgactgaaaaccgtgtgaaaaacgtcctgtcaaaaattgacagcgcgaatatcaccgcgaaagatttcggtcgcgtgatggggctgacggtacaggatgcgctggaagaaatcgaacgtaactacggacctttcctggaacagttcgaaaatccaacgctggcgaagaaaaccttcactaacgaagcgtcaaatctggttcgtgagaactggggcgcaatcctgaacaatgaattttaaatctgttctcgaaaacgcaaaaacggctaccctgatcggtagccgtgaaccccctgaacgtatcgcgagtatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattcgaatggtaaggatatcatcgactatacagaatacgacacgtacaaagccgctgacgaagcgagaaaggtagctggacacttcgacaaccaaaacgaatgggtacagcgccgatatgctcgcaattcaatgcaggtattaaccgaaaacctggacaaacctacagattttgttctattctgggcggtagagaaagatttttgtgttaaaggtggtactgcgatcgctgcaaggcttgccagattgtataaggttccaacgttcaatctttggaatcaaaacgttctggatgaagtctgcgatactttagggattaacactaaacctcctactctggattttctctggtgataactcccgaacaatcacgtaattacgaacgcctctcagttgaagaggcattaaaaaaggcgaaacataatggtagaaatcaatggaatcggtgtgaacgcacaggcgggaagcgggacacagtgggtcaaacgcgaaacgcaagatgatccccgctgtggacgtagcccgacactggcggaacgtgcgcgtaaacttgttgacgaaatcaacgcgaaaatggtcgaagcatcccgcaaagacatttccgagtatgtcctgaaatatccgactaaacaatcatatacctttgatatgaaacgttttatcggtaaggttatggatcaggaatgtaccgaaaaagcatatgcggatctgggtgaatggctggcggaagaagggtttactttcgatacacagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggttggtgggattgctacatcgactatagcgacaaccgggtcttcttactgaccagcaactaaggatcgactatgtttggaatgaatgagtgttcagaagcggacgcgctagaagactgggctgactttgatgaccttgatctcgatgatgaagatggagaattcttctgtgttgggcgcggggttgaaagaacgaagcgtgaacttcgaagccgtttagcaatggggcttactgttggatctggaaagaaacagcaagttaaatattccgatggttctattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgtaagagtaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttggcacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgcggactatcaaactctgtttgatgaagttgaaaacgtcgaagcaatcggtgtttcaattccggctcgcgaacattcgactacgatttcctacggtaaagagaacgaagacgaagcatataaaaacagcatcgaaatgttcggggatagtttctacgcttgtgtgtacgattcctgggactacaaaggcgctgtagatcgcattgctgaatataaagagcaaatcattgctgcgggtggtactctggttgttcgtcctgattccggtgatatgattgataacatcatgtacaccctgcgtaaactgggcgaaatcttcggatacaccgtaaacagcaaaggttacaaagttctgcataattcagttcgaatcatccagggcgacgagatccacgggcctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgagaacggtgtattaaacacctccgatacagtaggggttatccgtgagcgagcaaggatttaatatccgcgccaacgataacggatcagtagtcttctacaacaatcagccccttgtcgctcgcaaggggcttttttgtaagttggtgggctacgggttcaagttggaacaggtggacaacgcgacactaaaagaggttgttcggattgcttatctgttgaaagataaaaaagatgaacaccgtgctattgcaatgcttgagaaattaggcgaaaatcattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgctcccggtggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcacgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatatattctctggttctggtacagtgatgaaaatgtcgatactaaccaacagacggttcaaaggcttcgaactgatggagaattattatcacgattctattcttcgtgttcagccatacgttaacaatctggaatcttttctatgagttatttgggtgttatcccctatacaggcaacaagcagtctctattacctgaactcttcaagttgttccccgaaagaagttcatacatgcgtttcattgattgtttttgcggtggccttagtgtgtcgttaaacgtccctaaacccgttctaagcaacgattacgataagacgcttattgatatgtatgagcgtcttaaaacgcttcctgacctgtctcctgtgcgagaattgattgcatcgaagggactggggaaagacaagaaagaagagtatctgaaattccgtgatgaatacaaccagaacaaagatccgttatggctctatgtcctgatcctgcattcattcagcaacgttaaccggacaaacgacaaaggcgacttcaacgctaatttcggatgccggacgctcaacgatgcaacagtaaaacgctttgaacatttcaaaaagaatgtgaaaggcattgagttttccagtggttcattccgtgacattgatatctgtgaaaatgatttcgtgtattgtgatccgccttacctgatcaccgatgcagtgtataacaagttctggaacgaagatcgcgaacgtgagttatatgctttcctggatgaactgcacagcgaaggaatcatgttcgggctgtccaatgtgactcaccacgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacacgtaggcgggttcgaccaacttcgtgagtacgtccgcaccctgtaataaataatgacaccttactgaatggtgttattatgctgacgaaacgaattaccaaaaaagactacccaactatcaagcaagctctctttaccgaacaagggggctgttgtgctatctgcaaacgtcccctggagggcgagatcgagaaacatcaccttgaccatgaccatgcgttagacggcgaaaacgccggacgtgtgcgcggcctactgtgtaacctatgcaacggtacagaaggtattgtgaagcacaaattcaacagatccggtctggtgtcccgtgatgtcgattacatccagtggttagagaacttgcttgcatatctgaaacaagactattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcgaaatatagaaagcaattaatgaaggcaacgaaatgaaagtagaaaaacgcgacggtaaaaacgtcgatttcgataaagaaaaaatccgtattgctgtagaaaaagctggcggtactatgacggatgctgatgccgcaatcatgctggttcagtacaatcagatccgcgatggtagcgcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcgaacaaagacgcaagggtattcccgacacagcgcgatctgctggctggtatcgtagcgaaacacttcgcacgtaaccacattctgccaaaacacattgtagaagcgcatgattctggtgatatccattatcatgatctggattacagcccgttcacgccatacacaaactgctgtctggtggatttgaaaggtatgctggctaatggcttcaagatgggtaacgcagacatcgaacccccgaaatcaatcggtgttgcgactgctcttatggcacagatcaccgcacagattgcctctcaccagtacggcgggacaacctttgctaacgttgataaagtgctggctccatatgttcaaatgacatatgataagcactttaaagatgccaaaaagtatcaaatccctcgtgatgttcagtatgcaatagataaaactgaaaaggatgttttcgacgcgtttcagtcatatgaatacgaagtaaacaccctgcatactgcgaacggtcaaaccccgtttgttacaattacgttcggtactggtcaatcccgatgtgaacgcatgatccagaaagcgattctgaaaaaccgtattcgcggcctgggtaaagagggtatcactccggtattcccgaaactggttatgttcatggaaaaaggaatcaaccttgatccagaggatcgcaactatgacatcaaacaacttgccctggaatgtgcttctaaacgcatgtacccagatatcattagttcagctaacaaccgtgctattactggttctagcgttcctgtatctcctatgggttgtcgcagtttccttagcgtgtggcatgatgataacggtaatgaaattcttgatggacgtaataacctgggtgtggtgacaatcaacctcccgcgtattgctcttgaagcacaggaagcagacgacgcacacgaggctttttggcgtattcttgatgatcgtctgggtttgtgctttgaagccctgatgactcgaattgatagtctacgtggtgttaaagccagcgttgcgcctatcctgtacacagaaggtgcatttggtgtccgtctgaatcctgatgatgaaattctggaactgttcaaaaatgggcgtagttctatcagtctgggttatattggactgcacgaaacgctgttgatgtttggctcaggccagcatccattcgatcgtatcggctcccagaaattaggtcgattgatcattgaatatctccgcgctgcaaccgaagcatggaagaagaaaactggttttggattcagtctgtattcaaccccagcggaatcgctctgccatcgcttctgtaagctggactttgagaagttcggaagcgtcaaggggatcacggataaaggctggtacacaaacagtttccaccttgacgttgatcgcaaggtgacgccgttcgagaaaatcgactatgaagccgattatcattacatcgctactgctggtcatatcagttacgttgaatttcctgatatgaaaaacaatctgcaagccctggaaaaagtctgggattatgcgatggataaactggattacttcggaactaaccttccggtcgataagtgctttgtatgtggctctgatgacgagttcacgcctacagaagaaggtttccactgtaagcactgcggtaatcacgatccggctaaaatgaatgtaactcgtcgtacttgcggatatctgggcgctgctgaacgtccgatgaacaaaggtaaacaaaacgaaatcattcaccgtgtgaaacataactaagaacacctagtattagcgccttcaataaataaagaaaaattgagggcgctaatatgttttacacaatctacaaaataaccaacactatcaatgggcgtgaatatatcggcgctcataaaactgataatctcgatgatcgatacatgggttctggaaagaacatcaaacatgctattgatttctatggcattgaatctttcgtaaaggaaatattgtatgtttttgatacggaagaggaaatgtatctaaaagaagctgaactcgtaacagacgagtatatttcgcttcctcacacatacaacatcaaacccggtggtaaaggcggaacggcctacgaacaaagcgaagaacatcgacgcaaaaacagtaatgcgctaaaaggaagagaaatcactccattacatcgcgatcggatctcccgtgcattgaaaaatcatgtccgtagtgaagaacatcaacggaaactgagtgaagcatcaaagattgctgttagtacacccgaacataaagaaaagatgtctgctcattttacagaactgtataaatctcgtcctgaattgaaacagcaaatatcatcttctgtcaaagcacattatgctaatgaaacagaagaagagaaaaatcaacgtcgattgcgtcatacagggaaggttcggtcggaagaaaccaaacaaaaactatccattgctcataaaggaaaacatacaggagagaaaaatcctatgttcggcaaacctgcatcgaatcgccgtatggtttctggtgatggtgttgtgtatggttccgtcaaagaagctgcggaaacactggggttgtcgcaaggaacaatcgttgctcgatgcaaatcacagaaaaatgtaaattggttctatgtaggtgttgacttgccgaatcaaatcgattagtattttctacatcgaagcaaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgtgtttctgctgttcaggaaatcgtgaagttgaaaaagaaagtcaaagaacacaaagaccttcacactggcaaagagtcggagatcaaaaaacttctggcggcagggcaggaagtgtccaacagtcattacgtgctggcgctgcaacaccgtaacatctggcagggcttgcagacgaagatcgaagaactggaagggatgaacaaagagattgatctctctgtcgtcgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtatgattacactattgaacgtgatcgcggtgaagaatggttgatttctcgtaagagaaatttctatgttaaacttcctaaaaactttcatacgttaccgaatgatgatactgaccgcttattgaggattcttgtagatgggaatgttccacagcgcgtttttcaggaaatggttgatcatgcgtgttctgaatgggataaaaagtattgcgaagaactgacgcatgatagtatagtaaacagcaacctaaaagacgcttacgaacgaagaagtgtgtacgacatttacgaaaaagagaggaaaagtgaaatgatgttcgaagacggcaacagtgcattcaaaccagcacgtaaaacgtatccagactggcgcaaacagtacgcagaacagctatggcatattgacattcccgaagcgcttatgaaagcgattagccctgctgttgactactattcaggctggaaagatgaatatgagttagaagtcggatcttttaaggcgcacgtcattaaagcgaccagaatccttgatttcgttgaagcggttgcgtcgtgtgacatcgttgaagatattcgtattccatcaatcaacgtttcgcggtatagttctcctggtaacattcgcggggatcgttatgcgaacctggcaagcactacggataagctaaacttccacaaaatcaatgaaaaaggatttgatggttgtgttctgatctcaatggtggttgtcacaacacaaggcgaatacaagctgatcattgattgcgacaaagcaaaccgcgcagtacccacaatcaaacaatgttttggtgaagatttcaaagcattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgtaaagcgataaactttcttctgcacgaactgattgaaaacggtatcagatttgaattcgttgatccgattaacggtgatgatcgtcatctgctccgctgggtgtctggtagcaatccgctggattcagtatcccaggttgtagagtctgcgcataacaatatgccttgtcgtgttctgttgggtagcgttaacgcctccacatggaatggatctgatgcttattatgtcggattcaaaaaagagttgacggacgacgaatgatgttataatatgcccctgtagacaacaaactataggggctaaatcatgaaaatcaaaaatactgctactgaaaatctttgtaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggtactaaataaccatgtaaatcaacatggaatacttctcatgaactatcacagaatatacaattctctcatatcaaaatataggggagagttgcctttatcatttcgccatacaaaaactggctatgaaatacaccacatatacccaaaatctatgggtggttctaatgaaccagacaacttgatttatctcaccccaaagcaacactatacagcacatcatcttttatctaaaatgtatggcggtgcgatgcacaacgcattctggatcatgtcttgctccggcactgttccgatcacatccagacagtaccaaacggcaaaggataataaaatcaaacatcaaataggaaagaaacattctccagaaactatagagaagctcaaaaaatccaggcgaggaaggacatattccgaagaatcccgaaagaaaatgagtgaatctcagaaaggaaaaactcgtagtgaagaaaccaaagaaaaaacacggaatagttgtcttcgttcgatgtctggtagggtgaaagtagttataggaaccagtattgaatcaccggacgttacaataactctgcgcgggaaaactgatataaagaacaacggattcaatcaaggaaaggttcattcttgttgccgtggtgagataaaaagtcataaaggatatacatggagatttaaatgaattatattagaatttacaatatggatctggtaaacggtaaaggagtccgggttgttatgttcgttgcaggttgtaaccacaaatgcgatgggtgttataaccgtagttcgtggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgcttgagcgcgtccgtgcgacgtttcctgataaagacgtgtgggtttggacgggatacaccctcgaagccttacagggcgatacagaacgctctaagctgttaccattcattgatgttctgatcgatggacggtacgaaaaggatcaaccgactaagaaaccgtttcgcggttcggataatcagcgaatgattgagttcaaaaagaattccatcgaaattaaaaatatcgcttgacctggttggtagttctgttaagatatccacatcgaaacaaacttgaggacgagaaaatgaaaaacgcaatcatcaaagaaatctgtgaactggttgatgtgtatggttggagtttaggcgctgcaaaagcagaagccaaatctcgtctgcaagttgtaatcaaagcccgtagcaaagatgaatttgttactaaattgcaagccctctatgagagataatatcatgattctgaatttcaaaacccgtaaagaagcccgcgactattgctggaagtggtcgatcccgctgaaaaacatcaccaaaggaagcggttcacatccgtggacggtgagaaccaaagaaacccgcttcgaaactggtaaagattacaagctggttgatgtcgaaggtttcactgacaacggcaaaaacattgcgaacagtgttcaatcaaaacagatccaccaattactgaacggtgttgtaaacatcgcaagccgtaacggtgatcgctataccttcaatgctccagcaggtgtcgctatgaacacccttcgtgcgtgggaagcgaaatacttcacagaagttgctccggctaaagccccagcgccaaaacgcgctaaaaagccaaaaccagtaggcaaaccgtctgttgctcctgcaccagctaaaccggatctggattctgaactggatggtggcgttaacctcgctccaacaacagaaccagttgcgaaacctgctgcaccacagccagcgcttgtagaagcgatgcctggttgttttgttgccgaccgtccgtatgttctggtagatgaaccaggtttcctgcgctctcacactgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacccgaagaggttaatctcggtaacggggtcgagactgaaaatggtatgcgtatcgcaacgccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcagttaaccgctgttgagaatatcgaaaaactgttaggcaaagagaaaaagcgtattttgcaggatctcaaaccatacggaaagaagaatgaaagtcgaaatctacggaattcccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgtagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaattccctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccgtcaagtggtaaaacaaaggcgattctgaaccatatcaatcaaacgggcgaaaaagcaatcatcgcatcgatttccatgatgttatcaaaacagtcttatgactactacatcaatcaggtaaaagggaaacgagcggtgattgtggacacggatcaccgaaccaaaagaaccaacaatgactcgctgcgtgaggttgtcaaagattatgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatggtcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacaattacagggaagatcctacaaacgtttcatgatgtggagttcaaagattcaccgcttcaaaagctggttgactttaagcaatacaaaaacactgggcgcatacatatacatgtgctcgcagagggggattattcgcgttatactggcgatctctctcaatctgggacgacagtatacacccagattaaaaaacgcgtggaggcgcttttagggggcgaacagttcatctattgcactaacacatatagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcaattgtgcgctcgttctgatatcagacacaacaacagcaaacgaaagattaatttatttgtgcctgatatgcggttagcgaaatacatgaaggaaaaatattttcccgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgagggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgctacgcaaacgatggtgactcaatcacaacttacgatctggatcgccttgcttcggtgaacgttgcgactctgcaagtttatcctggtagcggacacacgatcagttatgacggtatcaataacgtaccctctgtgacttcacagcgttccggttatggtattttcatgttcgatcaggctaataaccgttgggttgtttatgacggtgatcagcgcgttcgtctgcgtcgtatcagtgatgacctgaacatgttgccgaacgattacgtgttcattactcctgttgctggtagtcctccaactgtgcgtaacgttacgctgactcttccgcaagatgttgctgaaggtgatcgcgtgtatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagctacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaaccgctactgaaacgcgtcgtggtatcgctcgcctggcaacaactgcggaagttaaccagaacacgacagcaaccttccttgatgacgtgattgtgacgcctaaaaagctgaacgaacgatcagcaacagaagatcgtcgtggggtgctggaaatcgcaactcaggcagaaacaaacgctggtactgatgacactaccgcaatcacgcctaaaaagctcgacacacgccgcgcgaccgaaaccctagcaggtatcgggaaactcgttacaacgggcgctacgacagcggagggggctttacgtggggatgctggtacgaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgatgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctggcaattactccggctaccatgcagttcttgaacggtactgatccggcgtggggtgcgacgacaactcgacgcggtgcggtgtttatcactacccaatcaaacactttcatcggtgataatctggttggttctactcaggccgttgacgattatctcgaagatttctatgctgtatcgcctcgcggtctgaactttgctctgcaaaacttcttaccgaaaatggcaacggcacagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacactgtaaccacgaacaataacattaatcagtctgcgaaagcaaacactgtttatgcaaatactgttctgagtggtgaggctgcgggaaccaaaaacttgcttcgtaccttccgtggtggtgtggcggatacgatctggcatgaaactgttcaggcaagcacgtatcgcctggcgacgggtacaacggatctggttgatgttctgacagtaggtgatgtcggtaacggcacaatggcgtattccggtacgaacattcgtctgaatgacaaatctctggctaacatcaacacggcgggtgatttgtttgttgcaagtacagcaacgcctacggtacaattacgaaccgctgcaactaatggttggaacggtgtaacaattagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcaggtgatttctctgggaacgtccagaaaatgcgcttaactggcattgacgataaggtattgactgagttcaacatcaatatcaccgattacaacaaagcgatgatcaacggaaacctgatctatcatgcgggtcgtaaaccgactccggcagaaatcggggcggtagcggtagcgggttcaaccgtcgatactctggttgtacgtgactatatcaaaatcggtaacgtgaaaatcttcgcaaatccagcaactaagacttgtgaatttgtgtgggaggaataatttaaatggcgaataacgaatttatggcgttattcggccctgatagtttcacggcgagtgtgttttcagaagcaaacgccgtgaaatatcgccttgttgtccgtggaacgaataacgattctgcggtcaactcggttgaggtatctatcaatggggctgatattattaaccgaaacgtacagcgcggtcgagggattaaccttgctgtaattgacggtacgagtttggctttgctggatttcaaaacttttgatatgtatggtgatcctactacgaatgggactgcgattagtgattacctatctacacttccagcaaacagaattgtgtgtttctatacgttcgatgctataaaatctaccgatgcgtttttgagttatatgcgcacaatcggatcggttgcatggcctgaaacacgattctttaacacgccgtcatcatcaacaaacaacccgcaacgttcatcctattcagcaatctattcatccacgatgaaaaagatctgtatggaaaacttcgtaggtggttctggtagtggactcaaagacaacacgacgagttttgttgaggttgtattcgatgaattcagtgatatcggggtgactggtattcctgaaagaatggttgatgatgttcaggtatatcagaacagcggcagtgcttacggcttccatttatacgggatgtgggatattggttctactgttttcttgggggacatcttcaagttcactggtgatgtttattgctcgcaagaacttcgcaatgctggcggcgaatgttatctctatatgtggacacagaacgcctctggtcaatggatatcctctgcgatcctgcgaacaactgggttagctcctgatgaatggcattctctgtcaggatatttcactatccctacggacgcactaaacgtgaagatgggctgtatggtatatcactacccgtctaccgtgaaagtggggcttgctcagtgtcgcaatgtccagatcagtaaagttccacgaatcgaaaccgatcgcaacggggcggctatcggtgtcaacggtattaggatgcaaacactttccgaagtcactgatgctggaaccgtaaacccgattgaacaattgctttctctgcctgtttcgcctgttggggttatcagtgacaagaaaattagttcgcataactttgctgaacttgattatattgtttctgatccgactgaatatacttctaccaatacagcggagtaccagttcaaagaatggactgctacccagcaagcggcggtaacgaaagcatcactaagcagttatggcttaaaagctggtgatacgatccgtatgcaatgccaaatgaaacgcgatgcaaacgcaatcgccaacaataaagatgcatatatcgtaatgcagttctgggacgcgaataataagtatatttcagggatccatatgcgtgatgttggtacgatcccgaacgtatattcattctataaaaacgaaggggttattcctgctggtgcggttacgtttgatttcggtttatatcgtcatccaaacaacacaaacatcggtacggtatccgctaaagacgttaaactgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacaccgaaaacgatcgtccgacagcggaggatataaacgcactatcgacgattaacggcggtactgttgcgaagaatactacgtttagtcaaaacgtgacagtaggcgttttgttgaccgcaaacaatattcaatctaaccagtgggtcaggatcactggaagtgctgttgctccggcagttgtttttcgtcgttctgatattacttcggttcctgatgtggaatctgggttgatggatattaacgcatacaacggtatttctggcggacagttagcgggtacaattaacgtgaacgctcgcacagacggaggtaataaaatatacatccgtgcctttaaaaatggtactcaaaatacgctgttgagtctggactcacaaacccaacaggtaacagttgaacagggttctttccgtgtgatcgggacttctaacctcggcgtgacgaacgctgcatcaatggcggttagcggtgcggtaactgcgaatacagtaaccccagcaaactgggctaatcatgatgaacgttatatcacgggtattcctcgcggtatgtctggaacaagtttcggggctgctgttgtaactgaaaagaacgatgttctgacagtaggcggtaacatcaccgacggtccatatggtaacactacgtattacgggcaggttgtcaactatcgccgtacattgaatagtggggtttcattagttcaaacatacttcgggaacgaaatgtggtttcgtcttggatcaggttctccgggtgcgtggtcatggaaccagggcgatgctaatggttggcggcgtgtttatgatacggtcagtccaccaactccggcagaagtgggggcagtaaacaaagctggcgataccatgagtggtgttttaaccctggctcctacttctcaaccgcttaaaacgcaaggaggcggtatttttgcgaatgacggaaacgtgtatatcaataaaatcggatttagtggatggattgatgatttgttcttgaaaaatacaggcggtactgtaacaggaacaattatccaggacggccttaactctggtgtttattgtatttctgcattgagtaccctagcaactggaacgaagaattaccttcgtcgtttccgtggtggttctggtgatgtgatttttcatgaaaccgcacaaagtaatacatggcgtattgcatcgggtagttctgattcacaagatgaaatggttctttctgctggtagctgggttcgatatcgtggagaggttgtttcgcaatcagcaaacggatttcgaatcgcatatggtaacaccggatcatttattcgcagtgacggaaacaacacgtatttcctactgacaaatagcggtgatgtttatggtggatataacaatttgcgtccgatttattacagcaacaccacgggtgctgttacaatgggacatacgttatccgttaatggtcgtattagtcaatctagtagttatattgacaatggaaatttaacattaaacggtagcggcaacggacgcgttgaatttattcgcagtggtgcaaaccctagcgatatgtatatcttccatgctggtgatgctactcgcggaaaccgtatagaactgtcggattcatcgtcgtatctggtttattttgaacgtcatccatctagcggcattcagttggtaatgaacggtaatggtagctttaacgatgtatatattcgttctgatgaaagactgaaaagtaatttcagtaagattgaaaatgcattggataaagttgatttacttgatggtatggtgtacgacaaagcaaatcacattgggggtgaagaaactacccgtgaggctggtttagtcgcacaacaactgcaagaagtattaccggaagctgttaagaaaggcgttgatggtgaacagaacgagatcttaactgtttctccgactgctgttattgcgttgttggttaacgcagtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggcagaaatcggattaggcaacgtaacgaacgatgcacaggtgaagaaagctggcgacgatatgacaggcaacttgacgttaacgaacaatgcttcattaactcttcctcgtcgcattaaccttatttccgataattcatcggcggtgtatactgtagcaacgcgttcggataacaacgcagttacagatccgtttccgtcatcggaaactcgcgtatacagtttattagttaataccaaatcacatacaagcgatcctgcgggtggtgctactttagccgcacatctgtttaaccagaaagcatccggtgcgggtgtgatgtttatacaggtatttggtccacctaataagacaacaggcgcttctggatcggtgacagggcaactgttgatgaacggggaaaatggtcaactacaaatgactggttccggtttaacgatcaggatgcagaccgttgtcagtggtacgatctttggtacgcaaatgtctatcaagggcgattcgaaccgaaacctgtacttccaggatgctggcggtaatgagcttagtttgatctatgctgatacaggaaagaacttatatgttcgtactggtggtggtgcatatgcaaccagatttgcatctgatggaactttagttctcgctaaccatctacaagttccaggtaattctatatttactggggttggtcagtttaatggacgattagtagcaaataccgattatgcgagtatgagtgcgaacgttcctgttttaatggttggtactgttggtgatggtaacgcagttggcgacggaaatactcactttggatataaagattcgaacggaagatataaccatcatcttcgtggttctggttctacgttcatcaacacaaaattggggcttaacgtaaacgtcccatcgtattataacgacgttccacagggcacaccagcgcaatatttcttacctactgttggacagggcgggaaaaactatttgcgccagttccgaggcggtaatgcggatacgatctggcatgaaactgttcagggtggcgtatatcgactggcaacaggttcaactgacggacaggaagaattagcaatttctactgcgggttatgctcgattccgtcaagagatacagagtaatacttatggtactggcggacaattccgcgccgtaggaggaaactatggtttcatcattcgaaatgatggtggaagtacatatttcttacttactgcatccggcgatcagtatggaacatggagtggtctacgtccgtttactatcagtaactcgaatggcgttgtttctatagcaaacggtgcaaacatcaacggttctgttaactttggtaacgcggtaaacttcaacggcacggtcgaaacaaacggtcttggttgtggtactgcaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagagactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggtcatgatgcggttggtggtagttttaacggcaacgcattcggtacttgtgtttctgcacaattcagcaatgagattagtgtaattactattcaaaatggccctgctgttaacctaagacttacgatggatgacggcggtgtgtttgactttgacaataacggtcgtatacaggatggatatcgccaatatcagattgcttctgcccaacataacgcgtggtatgactatttgaacgcccgtgtaggccaaacacgatccggtctggtcactcaacgttaagtaaattcctaaatatgttcggggtcggcatccccgaacttgaggattaaacatggcgctattacaagataaattggcggtgcttgaacgggtaatatcgttcatcatggcagtcaaaacatggaaacagctattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttacttcaatctcgaaaactactattcaggatcaattctaatggaatggtatatacagaagcccgaagtcgccgatacgaagttaatgatcgtgtgcaatcaggccgctagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcaggtcaagttcgtcgtggttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatagggcggtacgcggttttacccgcgcacacttcattaagcatttcttcgtatgtcattataatacctttactcgctgaacgattgtctgtttaacttctttgtattcgttgtgaagtttaggtgtcgctttgaagcgaatcacatcaccctcttcaacaattttgttaccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccatgcgatcgaagtattcacgcgctttcgcttccgctttatctgggtcagtagacaggttgcagatatagttatcagaagtgaatccacctccacgacgctctacacgcagagtgtacatagcgtttttagcgccagaagaaatgaagtatgtcgcggtaactttagtcaggttagtcatggtgaatctccttagtggtttcgtttcgacaaggccaatatagcaaaagccctcaaccgaagtcaagggcttttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgttgcaccgatgaatctgtgcctaatggatcttctttgctgaacagaatttgtgaactcataagaagaaacctgttcgaactactaaatcaatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacagtgatactcgttgacgtgaatcatagtacgaagaaattacaaacatatattattttccttattggggcttttcagccccattttagataattaatccagcagtttgcggattttatccgcgatacgtccggcgcgggatgcactttcgcggtgatccgcttctttgttacccagttcagccagtttgcgctgatgttcttcttccgctgctttgcggtctgctgctacctgtgcgacctgttcgttatcgtgagcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagatttgagaaaccaaagaggtttttaatcttatcgtgtgcaacgaagtacagagaagcactatccagcaaggccaccatcgctgatggttcatgttcgcggcgtttgatacgtaacagagtacggtttgcgccagtcttacggcgttgatttggggctacgtagaatcggaatactaccttacccgttttatcatcaactaccaggtagaagccgtgttctttcaggtcaaccccttcgaacttggtgaagtcaccgcgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttctccgtcttctgtacgtccagcggtaacgttgcctccgttccagatttctttagcggttttgatggctgtttctgccccgctcaagttctgccagtagtcaggaatgctctgtaggaatttcataatcaaatcctccgcgcctgaatcgctccaggcgctgttttggggttagtagtgactgaatcccacagttacatcacgcatcacctgataacggcatacacgcatcttagcgttatcgtaatctgtcgggattgctacaacatcgcgaggattaaccttaacctgaatgactcgcccacgtcctccgccatagtgaggcaggtacgattttgcggcaacatgcaaaccacatgaacaggttcggtttttattctcgtctacctggttacgtggcatttcaaccacaacaccaggggagttatcaaacttaccggaagccagatcgcggaagtcttcacgaacacgtttccacgcgtagaaatctccgtcatctgccagttcgatatcgttatgtaccatgaacccataaagctgatatacagcatcgcgagaagggttttccatcaacttctcaaagaagttaaccaggtgctcgtaagggcgatcgttgtacatttcgcgaacgatacgttgcgtgataccgctgtcaaacacaatatctttgtacaggactttatgcccgatgattttaatgttgcctttgctgtaaatcttcaacgcttgcgttgtgtccaacagggtagcaactccctcaatgtcgcccttaaccattaaagcatgtgctttttcgaagttagggtgtgacgaatccgctgtgatgatcttgccgtccagtaccagagtaatgaacgattcagaaccaatcattttagatttgacatctgtttgcggaagtggtttcgatgcttccgtattatacttagcgtgttgctcggtaataacgcgcccgatggttcggacgcttacaccaaattgtttagccagtgcggttttgtttgcgctggtcagaaagccctcataaactgctttcttttgtacatcatcaaggatcttaacgtttctcattatttccaccgtataagtttgaccaaatccatcacaattttatcatcattaaacatactgcggaatgtagaataagatgaatgtaacaacatgtaatgaattgatgggttgcgttctgcaaataaatcgtaagcagtatcaacgcgttctttcatatctttccgcattttgtaatacttcgttgacatttcacgaagtaacaggttacgcaccacagtttttgatttgtttttgccctcgataacatcataggtaaacttaccatcaagataatcgagcaacagatacaattctggattatagcggtttttaaccatgcgatcaagggttacgcccatagaatcgcgcagggttcggatctcgcttccgtggtttgatgaaatccatgcagggaaccagttaggttttatcttcttcgctgcgtccgcaaaacgttttaccagataatcatcaaggcatttcatgttgctatctggaatgcgactccacagagagtttcgcagaaccatcacttcgttcagccctgtaaccgttaacatggtcatcatactgctggcgatgctacccaacgaatagttctgtgcttctccgtccagtcggctatattcatcaaccccataaaggcgcatagcgtacatttcatccagtttcacaaactgtgctttagtcaggtacagatcgtttttctgtaagttgccctgatcatccaggaagtaatgatatgctgtaggcgtttttggacgcggttctgaatcaccagaagatgattcacgcgttgctttccagcgcttgcgatcttcggtatacgtttcgaattctttagtcatttcactggttttcagtgtaacgatctcagattcatcgaaatacccagttctgatcaagtcctgaacaggttcactattaatctctttggttacgaaactgatacgttccgaaccattcaacatgcagtaaccgatcagatatgggcggagtgaacgcgcttcattatcgttttcaacaatgaacagtttcttctgtcgccacggttgaatcatgcgcataacgtcctggcgtttggtagtttccgctttgtatgtctcgtgacggcgaccagaacccacacgttcaaatacgcaatctttcccgtcatatgggttagcccagaaaccacggatatattttccggttgcagtttcactacttttaagatgcgtcagaatttcagccaacgattctttacccacacggaaacgattatcacgggttacgaacccctgcaacaaaccaggcagattattaaaccatacgagtttatcgcgggttgtcttctgctttttatactgttccatcaactcttcatcaaagcgtttgttgattttgtccagtcgatccgtaatcactttcttcgtgactttatcaaggctcaactcttcacgcgacggcatgaagtccagcgatcccagagggaaatccagaatatacgcgtaattgctgttacggtagcagtagaacagcgagttttcgaacatgtccatgtcgattggatagcaaatgttacccatacgcgcgtatacgcctgaatagttgatagacttataacggatgatcccgcgatcgtctgcttctttcggttgccagtttacatcaacctgaacaccgataaagcgcggacggatacccgtaaacggttcataaacacgcgccgcttcacgttcccattctgcgatatcttcgactttaaccggaacggtgatttgaacgccgttaggttcgtctgtttcggtttcgtagatttggtcaacgaaaggttcaccattatccatataagccgtgtacgcacgtttaacgccgtcctggatggattcgatagtgaatgtttcggtgtagcagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtaaatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttaaagatgatgttatcgcatgaatatttcacaggcttttgatcaagcccatattcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcttttgtttcctgaaatgtagatgttcgcaaggttgcgtttaccttcctggatctcattgtacatcttttcaggcatattgcactgataaacttcgccgttcggagttttcaggaacaaagcatacatatcctttttgctttcccgaatcactgatttctcacggatacggcttttacatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaatgcgtcaggctgtgcgatcatctggtcaatgaagtccaccttcgccagcgccttatctaacgcttccttagtctcctggatgcgcttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttctttcgatagatccttatagcttacgatataccctttttcttccagcttatccagaatagagatatatttcacgcgatcatacttgaccggaatctctgtgatcaccagtttggttttaccctggagttcgtacttgccgtacatcgtaccgttttcaatgtcgcctttgaaatgcgggtatttcagatccagcgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgcgggattgttaaatcttcatccatgtagatagccttgaacagcggagacagcttacatttaatgtaacgcggtgcgcctggctttttaaccagacgggaaccaaagaacccatcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaactggtttgaacccgtctaccaggtgcgggatcgcacgagaataaattgtgtaaagagcaaatgtaagcccctccacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacagcggaatcaccctcggtcagaaacaaagtggtttctaccccgtcagtgtcgatccctgatgccggaacatgttttgcaaccttcgcctttttcgctttcttcttcgctttggtaatggctgctgcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcagaatagataccgtcgatcatggtgtcaacatgaacaccgccgtttttcgtatccagaccattaacgaaggatttctgtttgaaaccgtcttctgtgctcgccaggatgaaactgattttgttgtttgtctgggtaatcgttttatcaccgtacatcgcgccatacatcgcgaatttgttcgggaggatatcgccgttatatgtgaatttaacggcagggaaagccactgcaagcgccataaggcggtctttgatgacttcctttgtctcttcgtcgataccgtccacaccgaagatagagaagtcaggggtaaacttaacggttgtcccttgctccttcgtcgggctggtgcggtaatccatgttctgcgctccgtccgtacaattgatcgtgactttgcgtttaccgttggatgtctcaccgataaagattgcgctgtaacagtttgtcaggaaagaacctacaccgttcatccccattgttacgcggttttcgtcatcgaagttagaaccggatttagccattgtccaggctgcaacaggtttaggaacaatcttcccttccggcgttctcacgtcatcttgtggaataccgcgcccgttgtccgaaatcgttaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatgtgatcgcgatcgctcaagcagaatgattcatccaccttagcgccctttgctggggcttctggtgctttctgcggctcgttatcgtccattaagaaatctaaactcatattcacctcgttattagttctcaggcattatatagggttctatgaaaaagaaaacccctttcggggttttacttgttgtacgggaatccgtctttcaccatctgcggcttatcaaccgttcgtttcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgcttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacgggcctaattgcttacaccatccatcatatttggataatatagacgctttcaattcaacgcgataaaccaacatgatccgatcctcgtaattgattaactacaagtagagtaccacttatctaatttcttatcaagcagtttattgatcacttgcgcgatttctgtcgtcccgtgggttgtactcagtttcaggtaaatcacatccagggcacacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcggtacttcctcacctttattgacgtggatcgtaatttcagtttccggttctggtgcaacccataccggattgaaaagccctttcatatcgttgaactttacaggaacgggaataccttcaagataaagaatccctgtttcttcatacaccatactgatccggcgtggtgaattgaagtccatcggattcttacgcaacgcgtcatacatacgacgagtcggatcggcttctgatgccatttgacacacagccattaaaatagatttcggggcgtacatatcgccaactttatacttgctcatttacaatacctttatgataaccaacaataaaacagttcacttctggacgttcgccagggaaatgcacacactgcatgacgcgttcagccatgagttcttcgcccaaataaacagaggtggtttcttcgttgtaatgacaatcatacgaagtcttaacactcataccaggcaatccggcgatatgcataaactttgagttcgtgcatggtttaccctcaatgttctttccgtttacatcaaacgttgcaaacatttcggttttgctgttctttgggcgtctgctcatttcttcacaacctcattatatgttgacaggttccattcatgcacttccggcactttggagtaatgatccaggaatactaactggacttgcataacattagcacgatccatattgaaaaggaaacgttgcggggaagtaatacacaggaaatcttcggtacttcctctgcttgcgctaaactcttttgtttctccgccgtcaaatttagcatagactggcgtagaaaaatacggggcgaatagttcgcgtttggaatcgtccgtaatcgcgctgaaacacacgtctacgagctttccggttccttcccgtctgatggtgagcattgtccctttcgtgcgccctaagacgtttacagagcgcgtggtgacatcaccaaaagcgtttgtgtaactcacagtctccacaaagcccatatcacgacgttgttttaacattgcttcgtgttgcgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtaaccgctacggtcgatcgcgttctctgggttgttgaagatattaccgcgaatacccttagcaggtgctttccatcctgcggctttcaggatattgccgtcattgtccaggaaaccagcaactgaacgctgatcgaacatttcaccagtctgtttgttgcgagtatcctgcacaatacgatgatacttacggcctttttccagaacgaaaacagtttcaaagaattcgttttcgaatgcgccaccgttacgggctttgaacatcgcatccagtaaaggctgtgctgcggctttcagttcgtcaaaagtatacatggcaatctcctaaagtctgtttcgtttcgatgggataactatatcaaagctatcccgtgaagtctttagcaaaaagtgctatttgttaaacccgtttcccttgataccatttcgggaaaataacccggtcaataaaagttctccccaagttgaaactatcaccgaacaggagaacaccaaacaaagggtcgtgcttgatatcgtttttcccgacagtcttcattttcccttcgtggatcacggtgtcacccaccgtgatatccttgatgcttacttttacatgatgcatacaatcacctctgcgagtttagcaggttttgcttctggtctaactttcaacgcatcattcagattcttttcaaccattgctaccgcgtcgttttcgttgaaaccgttcttaaccagggctttaactactttggcttctaagtttttcatgatgcgttccttttgtctgtttcgtttcgatgtgtgtaatatacaaaaaagcctcctgcattgcaagaggctaatttagcaaaaagtgctattttgaaagaggtataagcatctttcgcataccgccgttttgtgtggcatcatacacgcgtttagcatccataagggagagttcaacatggtatgatttccctttcccgtcaaaatcaaacgttaccgtaccgcttgctacgcttacatgagtaaagatgaactcaccagcgaaatgctttcgaaacgctttgtcgtgatccaggaaccattcaaacgcttccccgtgctggtacagtctgacgataatcattgaaactatgatgaaaatcagaactgctgcgacgatcgtaagctctttcatcacttacccctgtttacagattgacggtgtagcacacggttaacgcgtggcgcttgatacggtttcattttgtacggtgtcggatcagagtattcgatccggttaggtaatgaatacatttcaacatttggctgaatccagcggattgagtcgattaacccttgagttaacgcacgaccgaaacctacaccaactaaacataaacgcataatatccccttactgtgccagaatgtgaagccattcacccagccacacgatcgcctgataagacaaccacaccgcgccggacacacaagcaatcacaccaatgatcgcgaatccaattaaaatgttcaaaccttctttcaaatcaccaaacatgtttcatcctcttttgtttcagtccctacaaaataacaaagcccctgcacgaatgcaagggctttttatcacaattcgactaactgaggcaatttcagaaccatccccggaaggatatagcttgcattgctaacggttttgcggttcaacttagcgatagactgccagcgctcaccacaaccgtataatttttcagcgattgaatacatgctatcgccaggctgaacaacatattcatcgtattcgactttaacgaacgcggggttcatgagaatgtcaaacatctgcgcttttgcttcgttcagtgtttttgcatgtacagttttacctacaaatgataatttaatcatcttttcctcggcagactcaatggatcggtttcttcttcgcttggtggttcttctaaccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttgccaaccatcttacgcacgatatcaaccaggataccgcgatcgaattcagggccacgaacataatcgagtgattgccaacggctcacaccgtccgcttttaggtcttcaaagaattgtcgatgtcctgcatagagttccagatcttccggcgacggtttcaggatttgacgggcttcttcgctttgttgtttccaccaggcaattgttccctgatcagcaatacgatcaggctggttgcgcaaatcaaatttgtacttgcgcccccgtgcaaccagttccgcgaacgttggcgggttgtggggatcgtcaacaaatggaacgtatgagagttcgatcaccttcccattcggggaaggaccaaccgtttcataatcccatacgtaatctacgggtaaatgactcatgaagttctccgcttatactcttccatgaagtacgccagcgtaagcgcaacttctgggttgatatcaaaagtttcaaactctttgctttgcaaagtcatcataccgaactgacgcagaccggaatgataaattgccttttccagacggttcgcgttttcaacagcttctgtgaattcgtccaacacatcgcgatcgatgaaatgcggaagttcttgaacaggggttttgaaaattagatctgcaattgcttccgcgtggaggcgagggatctggatagatatatcttttttcatgatattaatgtccatatgtctttattttcacgaatgtttcgtgccattctaaggatcagcacgataacgccatattcatcataagtcagttcaacttcttttgcaataggagaccatgaataacttggcccgttcggagaatacagaatatcattagatttttcaatgaagcgcaaacggtgaataacttcttgcggatctgctgcgctatacatcccgaacacattgaccgcatgtggatctttttctcgaattttatcgagtgcttcaagaattcggggaatgtcttttacaaggatagtcaatttcataataacctcaaaaggggcaaagccccttatacataatcaacggtgtaacgtgcgcgggttacgcccacatagattaactgcttacacagatcgtaatctgcgaacgcatacgcatcgcgcgtgtacatatacgcatggtcatacgtgctcccctgcgatttgtggtacgtgcaaaccggaagaggcttaacatcctggaacttgtttttaatcgcccagaacgaatgccacggggctttatagcctgtttgttgcttgatgcgcttataagtgctcgcaacgtaggccagatagttgcccagacggtctttcatcaccggatcaacaacaacttgaatctgtgcttcggtttcctcttcgagcgataccgttttcaggagatagaattcaagttcgatcttctcgtcgcacttctccgccttgataacttcccgacgcgggatgatttctaagactcggattttttcgttgttattatacacaatctcggtaaagatctgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggatgacatcaaagatttcttcatcaaagaacggggagagttcaacgcgtccatcggcgtttaccggacggatctgatctttatcacccagtcccaaaataacagcgttgcttggaatactgcgccggatgattcggaacagatccatatcaaccattgagacttcttcaacaacgaacacgcgacaggtagacagatcaggcgctttctttcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcactcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgtggtgatgcaaacagttccggcgttttcccgttttcaacgtatggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccgaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatcaagtcccagcgcgaggaacttacacatgaagaagtgccactggtcaatcagttcaaacaggatttccagtttgtcttcttctttcatttctgcgaatacctggctacgcagttcctggtgatttgctttccacggtttccagacaccggaagccgcttttgcaccgcgtgacataccgcccagagcggtgtaaagttcgcgggtttcgtctgcgattgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgtaatgcattgcggtagaaaccttctaccatttccagatcatcggctttaaccaggtgcgcacagctattaaacacaggagttttatcagtcatatcaatctcattttttcggtgatttgttccacgacttaaaccgaagtttcgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaatcaattttaaaaggcggtgagtagtatcagggtgtctcgcttcattgtcaagaacccagacacgcatatttttatacggaacatcggacagcgccatttgtccgcccgtaatcgcaccagcattatctacaaacaggctatccagcggcccttcaagcaggtagacaggtttcaacggatcgatggtatcttgaccatacactttcgttgagtgttcacatgctttgattgtcatgtattttgcgttggcattgtcacgcaaggcgcgtccctggaatgactcgattttacccttttcatcaaagatagggatcaccaaacgcggttcatccttcggtaaagggtatgcgtccgcattcacagagttaaccaggtgttgccattgacgcgtaaaccagaggcgatcatatttgtctttaggtatgtgacgacctgcaacatacttaacgatagggtgattttctggcaacgtgtccagacgttcgcagaactgcaattcaggaatatatttcttttcttccttcggcggttcttcgtgcgtctgttttaaatctttacgatccttgaaagattccatcaaatacgccgtgtaatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattccccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcgacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatctcttcatgttcttgctcggtcaggttccagcggctccgtaacgagtcatacgcgctcgtaaggttcatgaacccagacatataaggaaccgcgtttaaacggcgcttgatgtgccttacagagcgatggaatggggaatatgcttccagttcttccttcgtcttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggctccggttcggggaattccatacagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacgaaaattcgcggacatctgcgggagaatgaacgtacccgcacgggcaatctgtgaagcacgttcaatcactttatattcaaattccgcgcccgtatacttacccttaaaattggatgtctttatcttgccgaaaggaggattgctgatcgccatatcaaacagagtatcaaactccgtcgttaacgcgtctgcgttaatccaggtcgcttccggtacgatacgcttacccaacttatagtatgtatggtttaactccacacagacgatttcacgcggtttggcgtacatcatcatatgaagcatcgcgaaggatagcccaccgatacccgcgcacaggtcaacaacgcttccactggtacaagcatcaatggtgaaatcgcgagcaagtccgatcggggtaaagaatgcacccagttcagagttattcgtaaatgcaccttcatggaagttttcgataatgaataacttttcgtcgtaggttagcgccttgtcagactccaccagatccattatcttgttgtgttgtttggtttccgctttcgttaacttcgccattggctttttccggtaataagaacagaggggtagattctaccacatcaaagccccaatcatcaacaatattgctttcccagtcgcgggtttcccacgggctgcaaatccacttatacaccccagcaggatcttcaacctgttcaggcatacccagcacttccgcattgataccttcgtccagatagccaggatgaatattaggccagcgcatgatatcaacatagcctttgtcgtcaaccgatacgatccattctgaacgatacgggctttcgaactcctgttcttcgtctggaagaatcatatctaataaatcactcatttcactaacccttctttaacgccctctttcatggctttcagaacaccgataaaagcgtctttgccaccgatagcgccgatgataagcatcaggacaccaacacaacccgctaaaccgattctgaacaggttccaggcaaacgggatagccagaagcaccaaccacgggaacggaaatcccataagtgcgtttagaaccagtaagataaaagcgattgcaagtttcatgatgtcctcctttgtttgtttagaataaggtatcacctttcgtgaaggattgcaatacctatagatacaaaaaagcccctttcggggcttaattttatgctttgttgattagataccgaagaacgtttttggcctgaacttcgttacagcagagtttgaattcttggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccatgaagcatttgccataaccccgattgctgccagtttcagagacaggaggatcaggaacacaataacgagaatctttttcatttcactatacctttggagggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaatccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtattcgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgtttccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgttgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatcggggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagacagaattgacgcagattgactattcgagtttttgatcagttttttcaggagtgctttattagacatttatttttccggtttatatacacgcataatatattcctcacaaatttatataaatggggcatttctgccccgtcaggtcttaccagtcatcaccgaacagagtgttcagggatgcgcgtttttcgtaatcaattttacatgcttccgtgatgttttgcaacgggctaatcacatgtttttcaaataatccgttgtagtcaacccagttgagaatatcactttcgatctcaacaggtaaacgcgtaccggattgccatgcgatgcaatcggattgccacgggtttttatctcgcaacggcagaaccataaccttctcaccttccataatcggggtaattccttgaaaacccttcgtatatcggttaaagaacagaacgcctttgatgtggtttggtgtccctttgattgggtatccaaaatcatcacgatattttgagatattgttagcagatgatacaccagctatttcgcggtagtcaagcgccttatactcttcttcaaatactttgaagtgttcgtgtaaggattcttcaccttcttgcaggatgcgacggatcgcttctttcaagaactttttaaccgctgtcggtgtactacttcgctgggtttccattcccatgatctttaatttaggtttctcgtagcgggttccttcggagtcccatacgttagccgcatatcgtttcttagccgtccagaaactacccagacctttcgatcccagaggtggaccagaaatgatttcgcgatccataaacatcaggtgttcgacgttgttcatgtactcgcacagttcgcggtagcccttatcaatgataggttccatgcgttctttactgaacttatccaggaagtcaacccaatggttgttatccctgaacttactttcaccgccgactttcgcgatcacgttgtccatacaaacataaatggagtcggtgtcacagtaacgcacgtatgcgtaatccgtggtgttgcacagttcgttaaggtattcgttaaccttacgctcaatccactgaatagccaactgcccgaacatggtgatcgcgctggcgtttcgaatatcgaagtaacggaaatgttcgttacccaacgcaccataaagggagttgattgaaatcttacggttaagctgtgcggtgtttgcctgtgcgatcttcttctcacaaactttcttcacggctttaagcatttgcttagacagcgttttcagtacagcttttgattcatcactgaaatcttcgtagaactcgaaatcagggttgatcatttggttgtgcgcgtccgtcaggtgttcgagttcgtgcttaatcagttcaagatttcgctcacccgccatcattcgttttttccacatcttacgctgatcaaatactttcttgatctcgaccggaatcacgcctttaacatcgcgtcggaacatccacccgttaggagagcagctaaattcatcgctaggacgcggcgcagtcttattgatgtattcatgcatcggacgcactgcaaagctgttagcgattgtctcagggcttatattcacctgtcggatgatagacggatacagactggttaagtcgaacgatacaatgtaacggtatggagcgacaaccggatctttaacgtatgcaccatcatacggcgttttagtatggcgtttgttttctgggattactttcttctcttcacgcagagagttgtaaatgattgcgtcccacgttttaagcggtgacataaccccagggaagttgattttcgcgtagtatgctacagacagaaccagttcgataaagttgcgtttaccgtcgatatccaacacgcggataacgtcaacgatgttatacgtgatgtatttctggtgatccgcttgacgcagttcagacagagaaccttcgtaatcaactttgtttttacccgtttcgaactcagcgatcgcgcccagagcgtaagtcggttgcggggtgaaactgaatttcttgtagagatccattccatccatttgagcaacgccgtaaatctcatagcccagttgttcgttcccgtaatggtcggtcgttgtcttcgcagtcactttcccgaacgggctgaaatgacgaacaacgttttgcccgaagatattcaggtaacgggtgatgatatacgcgatatcgaacttgtttgagttccagcccgtaacaataacaggcgtccgctctttccagtctttgatataagccgacatcagcgacttttcggtctggaatgaacggtaaacaattttcttcaaatcttcttcgctgatctcgttttcggtatcaactttcgacgctacccattcatctaaaccaccctcgaccagatcgtacacaaagaatttatcttcaacgctgtcatagtgggtgattgcgtcgatagcgtattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagatagattgcaagtaagagacagtttgatgtcttcgctatgcagacggttgatcaagtgatcgccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcagggatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaatcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctggataatgtttcttcacgaatccggcgatcacctgctggtcatattcgattttctcgatttcgaggataccgaaacagcgtttgatcatttgcttcatgagttcaacgcgttcttccttcgacggggaaccgaacttgactaccggacagcgggagataagcgcagggtgaatcccgttgatgttgttcgcggtgatcagaacagttacgttcttgctatacgcttcgataaagctacgcatgtgcttctgtgcttctgccataccagggcgatcgaattcgtcaatcaggatgattttgccgcctttcttctgcgtcatggaggatgcaaagcgatccatttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgcccagacttgatgaagccgcgcatcgtcgctttatcagcagcagggagaatgcattcatcgatcgtcgtcgggcgatagcgctgatcccatgcgaattcttcgggagactgggagattttgccgtatttggtttcaattaactgtacgttttcactaagttccataatattaccttcaattgattatcaaaaaggggcttaacgccccttgtgtactgctttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttgccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacggatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttgatggatttcgtcataatgaacgaaccctttttcagcattacagacgggttgatctgggagaagtttttcaggatatcgatcgtttgtttagagaatttcatattcaacctatagttttcaattaggcaaaagtgccgttaatcagggattctacaatgttcttcgatgcattgtcaaggaattctttgcttttggattctgtgattttcgcacccgcttcgcgagcatcgtaaatgaatccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaattgggggctttcgcccccgtaagcattacagatccagcagtttatccaggtcgtcatcaccggaaccaccttccagatcaaacggaggtgtatcatcatcttccggtacgcttccgcctacgttcagttgacttacgccaccagattctttagcacctttggactggttgccattatcgaagtttttcagttcgttgtcaaatgagttcagttctgaatccagatccgcaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcaccaccaaacggacaggttacagcaatacctggttcatccagatcagggttgccagcgatagcagcggtgatcttatccatgattttcttgccgaaacggaacttaaacactttaccttcgttttccggcgctttcggatctttaacgaccagaatgttagcccagaaggattgtttacgtccaatcatacccagagttttatcggcttcgctgcctttcactttggctttttcgaacagatcgttgtcagagatatactgacatacaggacaaccatcataatcgccgtgggtagacggacagttttcaatgaaccattgattgttctttttgaacgaatgattcaccaggcgaacaaacgccagttcgtcatcagagcggttaggcaggaagcgaatagtcgcagaaccgtttttctgtgcatccagagtgagtttccactctttttcatctttctggaagccggatgaacctttcagagcggcgacttgttcttgcagtttggttggatcttgacgtttaaagaatgacatatgttatttctcgtttaagttaattaaagtttgtttcattaagtttcggtattttacgatttcttcgttactgatttcaactaattttctgtatgcgtttagttttttactaaattcattccagacgaaatccgttgcgatttcatcgtgtttatttatgatgtctaaaaacgagtcgagaatcaagaatgattcataagaaatcaccccagactgtacgagtttgctgatatacgaggttgatgatttgacgctatactgaaacaccgttgagaggggaatacctttcatgcgggaaaattcataaaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagaaaagtgatttttcatcaccatgtacagtttgtataccgcgatcggtttcaaacgggaattagcgtctgaactgtcaaacggggttttaaatttcacatgaaatcatccagggtttgcgtcgtcgcgtggtctttagccacagaaggacgcagcagattgtttttaatggcttcgtcgctaatcttgtcaatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttgccgtcgataccataatccgttttcgctttggatttgatgtctttgaaagaaccctggaagtgttcgatctgagttttcacgttcgacgcttctttgatcagttctttaaccgctttagcgatgtctgggttttcttgcagtaattctacactcattttgttacctcaaaagtcacttagtttttcatacatacgggtaagtttgcattccatgaagtatttctccatttttgctttgttcccgatttttggagcattgtacgcttcttcgattgccgttgcaacatctttcggaataaaatcaaagtcgcgaagttcttcgttttctctgtagcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacacggatacctttgtacggtagattagcacggatttcatcgtatgtcgggtgaaggaaaccattcaggcgatcccagtcccaatccgatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccaatttaactatccgtttcgcttcgctcacggaagcgcttcgcgctgattttattaaataatatagattggaagtaggtttgaaacacctgattcaatcggctataataaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgatgatggaatttcggcaacgatttccggccttcataactttgacgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaaccaaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagagcttagggattccgattatcatcgaccctacagatgtacgagatccagacttccagataacagaaggtcgtctggactatgtaataaacgccgaaacaatgatcatggagatcacttactatgaacgtgcagcatgaagtaatcgacgaagtacaccaaaaatcagcgctggatcttcgtgaagaagaactggaatccatcaagggtacacgcattgaacaggaagccctacgcaaagcgcaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatgcggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgccaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaattaatatcatagacaaagttcaaacagattcggatgtcgataccgactttgaaatcaaaaccgttcgtggtcttatcactgagtatatcgccaacatgcagatcaccgacgatgaaaaagaggaagtgaataagctgatcagcgaactatacgcggaggtgtcaagtgcatagccgttatgatgaatatttcggggcgaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggtcgggaacaccccgatcgaactggaatttgatacagcaaagaaaaccctgatcacggggaaaaacggtggcggtaaatcgacactgatcgaggctttaacctatgccctgttcggtaagtcattccgcgatctaaaagtcgggcagttggtgaacagcgtcaacaaaaagaaatgcctggttgaactggaaattgaatacgggaaagactcgtacaaagtggtgcgcggacaaaagccgaaggtgttcgagatctggaagaacggtgagaagttgccggaagactccgcagcaggtgattatcaggcacagcttgaatctatgctgaacatcaaccttgtgggcttcaaacaggttatcgttcttggtacagcgggctacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattcgcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacaacgtttaaccctgatcaaaaccaaacaggacgagttgcaagggatcatgaatgacttgctgcaacagcaacgcgcactcaatgccctgaaaaccaaatatgaagccctgaaaggtactctgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagtatcgttaagcgttatattccgtacttcaacaaacagatagcatattatctggatctattgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaagtgtttgatgggccacttgataaagagggttcattcgcgattaaatccctgctggattctgtagatggtaacgttattgtaatcagtcaccaggatcttgatccgcaggacttcgaccgccacatcatcatgtctaaggttggacggttcacaaaaccatcaatcaaagatatggcgatctcatgttagaacgtgaatttgatttaaagacctctcccgaagtggagaggttttatctccataatgaactattggaagaaaaacatgtagttacaatggcagatgttgaggaagcattcaaagataaccccattgaattgacccgcatcaagaataataaatcttcggtgtggttcctcgaaaaaatctattgacagtaaaacataaataccttaaagtcgcccgtgtactgagttgcacgggtttttattttgaggaacggaaaaatgattaacgaacaaatgtcacacagcgaagcattgaagattttgggcgctactggcgacgaatctaaagccgaactgtcaaaactctttaaacgtgcttctctgcgcaatcaccccgatcgtggtggtagcactgaactcatgcagaaaatcaaccaggcgtatgacgttgcaaccaaaacaaacagcgctggtaaaactttcagtgatgttcgcgcagaacacgcagcaaacaaaaaagcatgggaagaaaaatttgcagcgtatttcgcggttgcgaaaaactatttcagcacgaaattcaacgcgcaagaatttgcggaatatttcacgaaattcaccggacaaccaacaacctacacccagacaatcagcgaagttcgcggtcatacggttcacgcaacctatcgtttcacttctggtgatgcgttctttgacttctctttctcctgtcaaccgccgtcagaaggtaaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaacggtgaacaaattcaaacctgctgaacgtctgaaaggtactatgctggaagatgaagacggtgcatgtctggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagctccagcgccggaagagaaaccaaaacgcaccgttaaccgcatcaataaagatgactatttcaacgcactgaaacaagcgggggcaaccttccgcagtaactacggtgagtttgataacggcgcgggtttgactttccacttcaaacgcgagatcagcaaccgtaaaggtttctggagtttcagcagctttgatttcatgcactccggtcagaaacatgtggaatggttgaaagatatcgacattgacgaggatagcaaaggcgcaagtatcggtttgctggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaagtcacagatgaatgcaaccattcgttctatgctctctgccctggttaaagccggacgcaaagacacaccggaagaaatcaaaaaagcagttgatgaagcaatcgctctttggcgcttgaaacactaactggttatgctataatgggaactgttgaaaagcagttcccttttttatgaggtgagtatgattattcaggtatcggttcagggcaacactctgacagtaacaaattccattatgaccgctatggctgcatgtcgtgatcatgtgatgtcaaaccctccggtaacggaaattctggaaattgatgtatgggaagacggtgtgatcgaagaatcctttggtttcactccgttagaggaagatttacgcaaaatggaacaatggctatggcaaactgtaccccaatgaaactaccaaaacacacaaccctgttaacccgcgaaaaacttcattctgttgaatggagtccgttagatgtgatggtgttcgatctggaatccaaaatcattaacgcgcatgttaacggattgagtatcttttctgttgaatttgaaaagattcgcgggtataatgaagcctgtaaagacaaattgcgtgtcatggttgaagctatgggctacatcgtgactattgaagacaacaaaatgtggattgcgctatgagcaaagtaaaagcagttttcgccgttggtcatgatatgtacgaagtggactatgctttcggttatgaacagggtttgccgtggggccactgcaaagaggatttgcagaacttcaaagcagaaaccgcaaatagcgtcctgatcatgggtgcgaacacttttacttctctgcctggtaaattgccagggcgagttcattgcgttctgtctgcatccggtcaacgtttggtaacgaagaacgggaataccgctgattacatcattcacggcggcgggttgtctgctgcaatcgacgtgatgaaagcaacgcatccagatcgtgatgtgtgtctcattggtggtaagtggttgcttctgcaagcaatcaataatacactggttgatgaagtggttgtgacccacatttacggacatcatgcatataatgcaccagcttttaaacgtgatgtttcgttcacggttcctgaattctgcgaagcggttctgaaatatgaactgactgatttcaaaattcaacagatcgaatcaaacgaacgagtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaattgaaaaccaaaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcatacgctctcctgacgcatattatcgctgatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgatcccgttctacgaacacatcactaagctggttgaggctggaaaatacgataaagaaatcctgacaaaatggactcctgttgagattgattatctggaatcaaaaatcaatcacgataaagattttgaattctcgtatgctggcgttcagcagttgatcgggaaatatctgttgcaggatcgcacgtccggcgacatctacgaaacaccacagtatgcattcatgctgatcgcgatgtgtctgcatcaggacgaaaaacacgctgataaaatcagtcatgttgttgacttctataacgcgatttcggatcgtaaactgtcattgcctacgcctattatggcgggtgtgcgtactcctacgcgtcagttctccagttgtgttgtaatcgaatcgggtgattctctgggttctctgaacgctgttacgtccgcgatcgtgaagtatatctctcaacgtgcgggtattggtgtcaacgccggacacattcgcgctatgggttcaaaaatccgtggtggtgaagcagtacatacaggcgttatcccgttctggaaacacattcagacggcggttaaatcctgttcccagggcggtgttcgtggtggtgcagcaaccctgtattatccgatctggcatcttgaagttgaaaacctgctggttctgaaaaataaccgtggcgttgaagaaaaccgtattcgtcacctggattatggcgtacagcttaacgatttgatgtataagcgtttaatcaataacgattacatcactctgttcagccctgacgttgcgaacgatcgcctgtatgacgcgttctatcaagcggatcagactgagtttgaagaactgtataccagtctggaaaaagacccaacggtacgcaagaaacgcatcaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggatgacgatgataaactggctggcgaaattggactgtgtacgcttatggcgatcgttctcgataatgctgatataagcgaattcccagcccttacacgcatcgcagtacgcgcactggataacttgcttgattaccagaactaccctgttgcagcggctctgaaagctaaacagcgtcgttctctgggtgttggtatcaccaactatgcatcctggctggcaagcaactattgcgactactccgaagcatatgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaaacgttgatgaactggcatcacctgtgtataactgcgattgggaatggttacgcggtgaaatcaaaaaacatggcttgcgtaactcaacgctttctgctttaatgccttgtgaaagtagctcgcaggtaagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtcgatcgaccgtatgcagtacgcgaaaatgccggaacacgaaaaaatcattttcgattcgaacctgcaatatcaaaccctgttggataccattcaggggcgcggccctaacctggctttcctccctatcgcttccgatgtctcgatggaaacgtggatcgaaacatgggcgttcagtgaaacaatccatagccgcagttatacgcacattcagcgcaacctacacatcgacccgtcaaaagagttcgataaaattctgcgcaacgaagcgatcatgaaacgttcggcttccatgacaaaatactacgatgacctgatcgcagaatgtcacgaactgaaaaacattgtgctcaaaatcgaaatgttaacgtcccacggatacccagacgaatcgatcgcagagtacgaaaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggtaagatggaaggtaacgcgaagatcatgcgtctgattgcccgtgatgaagcacttcatcagaaaggcactcaaagcaagatccgactctggcagatgggtaaagatgacccagaaatggcggaaatcgcttaccagtatgaagaagaagcgacaaagattttcctggaagtgtacgaacaggaaaaagaatgggctgaacacctgttctctatcggtgatgtagacggcgtatccctgaaaagtacgatcgcttatatcgaacacctgacagatcagcgtatgcgcgcggttggcttgcagtctccatttaaaccaacgccgaacccgtatccgtggatgaacaaatggttgaagtctgacaacgtacaggtagccccacaagaagtagaagtgagttcttacctggttggcaacctcaacaccgagatcagcgacgaagcctatgcaaaatggcgacaaaaatacgcttgattgtcgcgtcgtaaacaagtataaaggtagttgggatgtcgatattcagagaggtacgaaattcggtaatcccttctacaagggaacacgggctgaaaacatcatgaacttcatcccgtatttccaaaacttgattcgaactggcgtgatcacaatcgacgaactgaaagcattggacgggaagcggttaggatgtacatgcaaacctctaccgtgccacggtgattatattgctcactgcgtcaatgtgttgaccggaaaggtgaataagttggatatataatggacgatgtaacatttggtgtaatatttcctttgcgtctgggttcagacaaaaggatagaccggagttttgttaaatgtggagaattccggcattgtgtgtattttattgaaatcgacggtcggatagtgtatgttggaaaatgtcgtgatttgtggaagcggttagacacataccgcaattcgaaatactggcgggaagcaaacccccagtaatattctgaaaaccgcacgtctggaaatggcaatcaaaaaacgtaagcgtgtaaatcttatcgtgacaacacacgatgaagacacatatcatgattttgaaataaacatgatccgaaaaatcaatcctgaatggaacaaacagcactatgacaaagctaaccaaaaatcagaaaaccctctttgaccagttgatgaaactgtgtaacgaaagcgaatgcttctacttcattgatcaaaaaactgtaatgcaaaccaatgttcgcatctttaactatcgcatggcgagctattccgactggttaaaaccaggtgcgctggaatgtcgcggtatcatgtttgcgatggatggggatacccccgtaaaactcgtcagtcgccctatggagaagtttttcaactatgccgaggtaaaggcatgggaagcactgaaagtctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgatcgcctgaccgaactggttaacgatggtttcacagtcaacatggaatacgtcgcaccgacaaaccgtattgtaattggctatcaggaaccagcagtggtgatcctgaacatccgtaataacgacacgggcgaatatgtcgattatcaggatatcttcgcagatggtgtattacgtccgttcctggttgagcgcgagaaaatcgaagtcaccgatctggatgcattcattaccgaagcctactcgaaagaaggtttcgagggttacgtaatcaaaactgataaaggttttgtgaaagcgaaaaccaactggtatgtaaacctccaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggcaaatcacgcaaagactacgcgatcgcactgagtgctgacttaacccctgacggtcgtattatctttgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaataacaatgcagcaaaacagaatcagggaaaagaagctggttctattatgagcaaatcaaaaccttacgtgagaattcggcacggcgatagaaaatatttcagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaatgaccaattggctaaagatatcaaagagttacaggctgatatcaaaaaagtcaaagagacaaacaacaccaatacggtgatctatgtcgaacaaaaaggtaaggatcagcagttggtcaaggatgccggacgtaaagatctgctgttcaagaaaccaggactgatcgaaatcaagatcaataagtccttcgaagagtatatggcggagtacgacaaatgaaaattgcaacgttagcccttgttctgggcgttctgttggttgggtgtgcggaaaagcccccagaaaagattttgcctacactccccgctaaggtgaatccggttaatgtgaaatggaaagtggttgcagaagtccgagagattgacggtaaaaaataccttgtcatgccttatgacggtaatccatatgttgccctttcatatcccgattcgttaatctttcgtagctggatgaatgacgttaagcgtcagaaagaccagacggataacattctgtgtaccgtgggataccctgagaaatgcaaaaaatcaaaataagaataaccgaagttgatttctttagtgacttaaccgttggaaaggtgtatgatgctacaaggatcaaagatcaactttggatctgtagtgattggtctattttcttagatttacacacttatgccaatcgagcactaattgaatatgagattgtgaaatgaatctgtttattactgtaggcgtaccaggtagcgggaaaactacatgggcgaaagaaaaagcacgtcaactgggaaacactttgactgtttcccgcgacgatatccgcaaaaccctttattgtgctggcggtgatctcactggctaccgcttcaccgaagagaaagaactgtttgtttgccgagtgcaagaagatacagttcgtaatgcactggcaagcgggaagaatgttatcgttcacaacacccatttgcaccaaaaagatcatgatggttggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccaagcaaaccgaaatgtgttatcttcgacgttgacgggacattaaccaaagtcggacaacgtagcccgtatgactttacgaaggtgatcaacgatccgcctaaccctcctgttcaagaactgttcaggatgtataaggccgctggctatgcctgtgttgttgtgtctgggcgtgagggtactgtacagtgcgcacatgataccgctgcaagcctgattgggtatggtgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtaatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggagtattatgagcgacaaaatcagaaagattcatcaggcatggttctgtactgaaccaacgatgcttcgttatggttgtgtgtttgggttggttgataacgatcctcaacaggacattgcaacaagtccggttgttgaatacgcgattccggcgaacaaatcgtttgttgaagtggtgacacgttcaggtactacgtatcacatcgttaaccctgataacgatttcatcaaagacattctgaaatatatggatgatcgttaatgaaattcaaagtaatgaatatgctgagagcaatcgatcggagtcaacgttctcagtgtatttcgaatcgtgtaggtgctattatcgcgatgggtggtcgtgccgtcgcgtggggcgaaaataatacggtagaccttgattgtcgatgcaactcatgcaacaatcatatggtgaatgatgacggtaaactgaaagcggttgatcgtcctacacattcagcgtggtcaaacgataacgaaattcatgcagaaatgaaagcgttattgagtgcgcacacaagaggtgttatactcaaagacgcagcactttacacaactgcatcgccttgccctaactgcgcaaaacatatcgaatggtatgttgctaatggggcgattacatcggtgtattatctcgataaatacgatcgtggtaatgatgaatggatttcacgcttacggaaatatggctgtttcgtggaacaaattaaacgggaagagttagaatcgtttatcgacttttccaaagtagtgtttaacaacaatgagtaaagaaatgtctgaactgaaagtaaaagcatccggcgaatatgtgatcatcgaagctactgcgcgtccgcagggttccgaaatcaaatctgaatctggtatcgtggttggtgtacgccagcacggggaacaacctttttatggtaaagttgtttctgtaggcgtagacgttccagcagaagcggcagaacgaatcctgggtaaatatatcccactgccaagcgctcacatggcgaatgttcctgaccctgatctggttgcgggttacatttccgagaaagaagcaaaagagaaggaaacgaaatacgtttccgcacattacaaagcaatccaggcaatctacgagatctaaaaatggctaaatcaattcaagcaattatcgctgataccgtcagcaaatccaaaaagctgttcgacaaaggcgaaattctggaagccccagcgcgtattgacgtaatgacagcaatgatcattgatgcgcatcagggtaaacttaaatcccgtgccgatgaagtcatggcgtacatcgttcagttcgaagacgtatgtaagtacgcgaaagatgttgatccgctggttcgtggtatctatcgcagtcagttctaaaaattccggccctttagctcaataggttagagcgagcgactcataatcgcgtggttactggttcgagtccagtaggggccaccaaataagcaggtatagttcaattggtagaatatctggcttccatccagaatgttgagggttcgagtccctttacctgctccaattcgggtgcgtagcgcaatgccgttaaatggttcggaatatgcaacctttctcacggagaaggctctgttggtatccggtaataggttccccggaatgcggggtgaagtaaagaaacttccagcccactaaacaatgtgagatctatatgagaattcgtgaaaagacggtgtatgactctaagttaggcagaacaatccatacgttcaaagagattacgccagcgcaattcaaagagcggtacggcatgacattcaacgaatggaaagcggggttatgtaaaaatgactaccgatataaattaaaattccgtgaatgttatgttgatgacgatccttatgcagcagatgtatgtggtgaaattgcaccaattatcgagaattcgcccgacgcactaatacaatcttgcatagatgcagcatacgaaatttaaaagagaaaaatatgaaaggtcttcaaaagctgtttgaattaaccccgaaaattcgcgaaatcatcgcttcatcaaatgaacaggaaatcaacggtaaagtgatgaaactgtttaccgaggaaatcccagatttcgataacgaattccgtaaagcgttcgatgcgtattctgttgatggtttctttgcatcgccgcaggtgaatagcaagcgtgaacacagtcaccgtttattcgactggtcgatcgtgaatatcgttcgtcgaactgatattgaacctactaatcatcagttggtttctatggatgcttcggtattcttcatccagtatcttattactggtggatttaaagcagaaggtattccgttctgtaacgaagctctgtacgaagaattcgcagaagcgtataagtatatcaaagcagttcgttaatcaacaggctatcttcggatagccttttttctggagaagcacatgcgctttttaaaatacgcaagctggcttgtactggttccccttgatattctttctggtgttctggctattctgctggctcctttcgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaagcgtacaacttcgcttatcacgtcttagggcgtgaagcacagtcagacttcgcctggaagggcaatccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgtaatgctggcgttccatatcaacccgttgcgttattatgtcgtagaaaggtaatacaatgaaagcatatcagattttagaaggtttacacactggcacaatctacctggaagaaggtaatgatgttcgtgtggtggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtatataatggcgattgaagacgtacagggctataagccccactcgaaagaaaagatcgacaaagtaaaccgcatcaaggccgcagaagttgccctgggcgaaatcttcaaagaactggatgaagagtattcaagtgattacgcggtatcagataccgattcattcactaccgaagaactcgatgcgatgcttgaacgtatccatcaaatccaaaaggcgaaagaccgactgaaagaagcctctatgtgggcgtgtcgtgcggtgttccagcctgacgaaaagtattaaaaatcaagccgttgccgaaaggtagcggcttttttcgtttttatgcaaaataatgcttgcactgaatccgactttcttgtatctttaaccacgtaggcaagacaacttaactttgaggatgacattatgaaaacttacaacatgaaagaactggtttgcttcaacactcgtcgtgaagcccgtgcgtatgttctggctgctggtaaaaatacctctgctgtaatcgacctgggtactgataaagctgttggcgctcgttgggctgctgttgtagttatcgctgctcctgtgactcctgttaaaactctggttctgggtgcgcgtaaagccgaaactctgaaaaccagcacttgcaataacagaggtgttcataatgtcaccgtcatcaaaaaacgtagctttggtttgagggcttaacatgagtaccaaagaattagaacagaaagtaatggggttcatgagtaacagcgaagatcgctatgcaaaacacctcattgtcgaactgatcaccgcgttacgtcgccgcgacaaagagatcgaagaactcaaaaacgcatcggttcaggttgtctataaagatcgcgagcgtagtagctgggaaaaagaatgggatgcaaacccccaagaccgccaccttttcgggaaataagcatgagttccattaacatagaaaaagattttgtgatgtttgttggggtacagactgtaaagaaagatatcttcggtaaactgtacctgtcgaacgacgatcgcaaccccgcatcattcgaaaccgaagatgatgcatatatcgcgaagaacaccagcgataacgaagacattcgccagtatgcgcggatctataaccgtgaagtaacaacccgtctggagagagcgtgatgcgtgaaggtattgaagtaagaacgtttcagttcgaaatgcgtcgtatcccagaagcatcaatgaatctcattcgagaacacaacgtgaaaatcgtagaaattgatgcatacgcgggtactgatctttataatgatgcgaagattgacagcattgatttagaccttgagggtgatattggggatctgaataagctggctattgcattgaatgcagaaaccaacaaatacgggtatacaatcaaatgaaatatattctcgaatatcatgagcatcaaattaccgaagcaatgatcgataagatgcgggtatataaccaaaacattaccagcatcaaaccgctatcagtgtgccgtgaatttgggggatactccttcgcgatgtacacaaattccgaagacgacgcaaccgcgtatctgaaaagtatcggtgcaatattcgacaaattcgaaaaagtatggaaggtaggtttctaatgaaaaagtattttattgaagcggcagatcgtatcgttctggctctgctgaactggaaccgtcgccaggatgtttctatcaaggcatcaaccaacgggacaacatatgaccgttatgatccggcgcgtggactccataagccttacgaggttaaagcgtgaagtattacggattcaaaacgagtcattacggtaaagcataccgcactgacaacatcgatcgcaaacgtccgtactatgattctctggtacgtgctggacgcaaacgcgctcgccaggaagggaagaaggaagcagaaaatgaactttgatcaacccattgcaatgataatcggtgctgtcctgggaatgcttcttttgtttggcggaatcccattaactgcatatatcatgaggttattctaaaatggacatcggaagcggttcacaatatccatcatgcgcattgagcaacttcgccccgcatccgttcacgtttgacggggtagaatgcgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaacggtactcactgaacgtgagtttgtacgcaacttaaccagattaagggatctgttatgataggttataaagattatgatgaaagagtagaatgcgcgttcctgttcaaaggcgcgattaacccgctggcattactccacgcacagggcgctttgagttctaccctgattatgggtgttatctacaaagcgggtgtgtattacgttaccatcggagcgaacaacattaacgtgatcaacagctacgttgaaaaatgtaagctgaaagatattgtgttcgat

SEQ ID NO: 142 - DNA, 38903 bp, Unknown
  source: /note="Description of Unknown: KP2-7-1c Bacteriophage Sequence"
acttaggctcaccattgagtatctacgacatgttcgctgggatggttggtagcgatacctataagtacacacgctctactgtactacctaaagagtccgagaagcgcgaccctaccaaggcagtgacaggtagacaggtggcttcaactatcgcaggtgcagttggtgagcaggttccgggtttaggttttgtgggttctgtgggcgcaacagcaattaacgccgcttccctgctatcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcgactaagaccacaatctccacaacgagagcgttggggccagcggacggttataacatgattgaaatccgtcgattcacctccgctaccgataggctggttgactttacggatggctcaatcctacgtgcgtatgacctgaacatctcgcaggtacagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtctgcgctgaactctgcgaaggctgctgctgcatctcaacaggccgctgctgcatctcaacaggccgctaagtcctcagagaacaactcgaaggtatctgaggacaacgcaaagacctccgagaacaacgcgcatcaatgggcgcagcgtacagaggactctccggttcagggtagcgagttctctgcgtatcactactcacggaaggcctccaagagtgccgccgccgcaagtacgtctgaggggaatgcaaagacctctgagaccaacgctaagacctctgagaccaacgctaagacctctgagactaacgctgcatcgagtgctgctaaggcttctgaggaggctgctaagctgactaacatgaatgactttgctgcttctattgattcagtcaacggtaacaatgttgtcatgaagggtgacttaaccattaaaggaaacggtaaagtatcaatactgaaccacagtgggctataccaagataagaccgtgaatggcgtgaactatgccaacaggatttatatggatgatgctgggggcatgcactttgagaactaccgtgtgtctggtacttcagtcaccttacgtgctggttttgttattacagataccaacaggtttgactttacagggccaacgcgagttaagggtgatatcaccgcatatgtggatgcgccacctaatccagccatcggtcaatacctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattaccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagaggacggcacaacataaggagaacaagaatgttatcttttgacttcaataacgaggtcgttaaggctgcgcctattgttggcacaggggtcgctgatggggcggcccgactcttttggggactatcgttaaacgagtggttctacgttgcagctatcgcctacacagtggttcagattggtgccaaggtagtcgataagatgattgactggaaacgtgcaaataaggagtaacccatgagcgacaagactttaatcaagctgctggagatgctggacacggagatggcacagcgtatgcttgctgacctccagagcgaggagcgccgaacgccgcagctttacaacgcaatcggcaaactgttagaccgccataagttccaaatcagtaagctgaccccggatgagaacatccttggtggtctcgcggctggtctggaagactacaacaaagtggtcggccctaatggtctgactgacgatgagactatcacgctacagtaagtgacatactcaaggttctccacgtggggagcctttatggatgttatttggtgcatctacgtgaagtctaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgagggcagcactgataggatgcttaatgacctgcgtagtaataataagcggctgtcagtccgcatcaagacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagatagatatggcccggtgtctggctaacggagacaacaagaagtttatcctacaggctttccgtggtattggtaagtcattcatcacctgtgcgttcgttgtgtggacgttatggcgtgaccctcagttgaagatactaattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctccgggagcgtgagttggaatatggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcaacgcatcctcgtgattgacccaagtggtcgcggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggcccgtgagaagggcgctgtggcccatgacgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagtgcataaggaatcattgagaccacggatggtcactttaagaaattccttaagaatcaatgagtttgaattaaccctcactaaagggagagaggggacttaaagctactatataggttagtcattcaggttatgcaatgaccctttatgcactttaagtctcctctatgattggtgatattatcattgtataatcaccctaccttagagcaactgaaaggaggtggctcaatgttacgcttgctgattgccctgctgcgtcatagagtcacttggcgatttcttctggtacttactgctgcccttgggtacgcaggtcttaatgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcctaaagagaccctttaagaatttactacaaaaatctgaatgggtatctcacagttcaagaacccaaagtaccccccatagccctcttaaagccacctaaagccagccctacccctagggtttaaccttcggttaaccttgagtgtagcgataactcactacggtatctactcgagtggcctataggatagcctaaagtgttgcctaaagtcaatatctaaagtggtggatggcttaatgagggcttaaagagtgtcctagtgtaccagttcaatagtacatctctatgtgtccctatctgttagcctcctaaagtaaaccctaaagccatcacctaaagccatcacctaaagagcgccgctatcttaaagacaaccagaccgatagacccactgttagcctgtagtgatgccttgtagttgcctatggtgtctatcgtcaattcaattaccctcactaaagggaataagggaataagggatacttaaaggggaattagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatacacagcgtcaaccggacacaaggtgtcttctaggtgacttaagcgcaccacggcacataaagtgaaacaaaacggttgacaacatgaagtaaacacggtacgatgtaccacgaaatgacggaacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgctttacgattgacgagttcggtcgccgctggcaagtacgataagtgttaaactcaaggtcgcacgctgagtgtggcctttatgattaccactaaataaccctgagaggatatgactatgaaacaatacgccatccttattcccggctggtgctactcaatgacctgctacgggtacaacgaaagggacgctcgtgcccgattcagggatcaacaaggcttcggcaagcgtttacctaatggtacggctgtatgggaggttatgtaatgagtaagttactggcaacatccaaaatagcaggccagtgcaccgtaacactgcgtgagtattaccacgggtcaatgggaagcacctacgttgtgcggtatggtaaacaggtcacacattgggtaaacccgattttagcacaagaggattatcaagcctgtgtggtacaccaagcaacatgtgcgggctggaatgattgataacgcgctttgcaatcactggacaacaggcttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctatgcatcgcaatgtactttatgcgagactttaagcgcggtctggcaatacacaaggcaacgctgagttactttaagtggggattcatcccacggtttacggttcgtgaacgtaacggacgctttaaagccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagccaatgctggtggctcttgcggctgctatcgtgaacgatgagactcaggacggcgaactgacgcaggcagcaggaaacacgtcgctcgaagatatggactactggcagacactggctgagcgtatgcgtgatgttggatttgtacgcttgggtaacggtcactttagcgcagcatatgagcacgcactgttaccgggcaaggtcatcaaggtaggctttaagaaagaggactcaggcgcagcctatgcagccttctgccgtatgaatcagggtcgggagggtatccctacggtgtacgacattcagcgtcatgcaggctgctacacggtggtcttggactatctgacaccgcttaacgattggtgctacggtgaaagcgataagattcgccaccacttccgcgctgcaagggaaatcattgaggaggattgcttcaataccgccgaagagtacccgataagtgacgggttcattgagacctgcaaggatatccgcaagttcttcctaggcattgcatcgttcgattgtcacagcggtaacatgatgaaagaccaaatgggccgcttgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggaacctttcaggtagcacgtaaagcccgtgcaaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttgggtgcaccacaataacctaaactttgcagaactggagcgcctcgctgctgcggcaatgatgatgcacgacgaggtgcgcattcagtggggcaaaccgttacacatagacgcgtaccttgacaggagactgcaaggctgatagagtcttttcttacaggtcatcacgaggtggcctgaataggaacgatttattcacaacgaggtaagcaatgaacatcatcgaaactatcgaaaagaatgacttctccgaaatcgaactggctgctatcccgttcaacacactggcagaccactacggtagcgcactggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgtatcgtagagtggctcgaagagtacgcatcgaagaaaggccgcaagcccgtagcctatgcaccgctccagttactcaagccggaagcctccgcgtttatcaccctgaaagttatccttgcgtcactgaccagcacgaacatgacaaccattcaggccgctgctggtatgctagggaaggccattgaggatgaggcacgtttcggtcgcatccgtgacctcgaagcgaagcacttcaagaagcacgttgaggaacagcttaacaagcgccacgggcaagtctacaagaaagcctttatgcaggtggtcgaggccgatatgattggtcgcggtctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcgcaaaacaccgcatggaaaatcaacaagaaagttcttacggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatatggttcccttacaacatggactggcgcggtcgtgtgtacgctgtgccgatgttcaacccacaaggcaacgacatgacgaaaggtctgttgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtctggcaggaataccgcaagccactccagaagcgtcttgatatgattttcttagggcaattccgtctgcaaccgacgattaataccctcaaggattcaggcattgacgcacacaagcaggagtccggcatcgcacctaactttgttcactcacaggatggtagtcacctccgcatgacagtcgtttatgctcacgagaagtatggtattgagtcctttgcgctcatccatgacagctttggtactattccggcagacgctggtaagctctttaaggctgtgcgtgaaacgatggttatcacctatgagaacaacgatgtgctggcagacttctactctcagtttgcagaccagctacacgagacccaactggacaagatgccaccgcttccgaagaaaggaaacctgaacctgcaagacattctcaagtctgactttgcctttgcataacaagcacttagcattaaccctcactaacgggagactacttaaggtctccctctttaagacactttaggtactaagagattaaatttatgattaacattaagactttctttaagaacatctttaagttaaaccgcttgacttccgttaagttctacgcttggatgcccggtagtgatgacctccgcaagaccgaatttaagttaggcttagggccgtgcggtaaggtggtcacgaagttggaatgttactcaacgtcctccgggatggtcatcttccagaccactgaggacaacgaaacgaaatcattctactacccgaagggttcaacgtgtggtcgtatcgaacggacatacagttaaccctcactaacgggagagttaaacttaaggtcatcaccggcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggctgtctcgcgtatccaagttcatcccggcgctggaacacctgaacggtttcgataagcgctggcagcaactactgaacgatgaccgctgcatcttcccggatggcttcatgctggatggcgaactgatggtcaaaggtgtagacttcaacaccgggtctggcctgctgcgtaccaagtggctcaagaagaacaacttcatgtttgaccgtggtggtgttgagccgctgaaaggttccaaagtagcctttgagttagaccccaagctactcagtgttcgcctgtatgcggtcatgccgattcacattgcggagtctggcgaggactacgatgtacagaacctgctgatgccgtatcatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaggcacacggtgaagacttctacaatgggtgggcctgtcaggtcaactacatggaagagactccagatggctccctgcgtcaccctagcttcgagaagttccgaggcactgaggacaaccctcaagagaaaatgtaaccaactcactggctcaccttaacgggtgggcctttcttcgttcagcggtattaaccctcactaacaggagacacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatcaccttgtgttcacctgctgattactcgtggtgagttcgtcaaggcgatgaacaaagagcgtcctcatctggaagccgtggtcacttactggcctcgcattcgtctgttcgttaagtggattaaggaggtgctgtaatgctgcaacatcattggaacaaaccagacttagaggctcgcttcccggttaactctgtggtgcgatactccggcggtggcctcaagcgcatcttagggatgagcggagtggtaactggtcactcgcacacaggtcgcgtcaaggttcgcttcggtactcagcacgctgaggttctcccgaacaacctgattccgctaccgaaagctggcgttaagactccgaacgtggaagcaccgaagacagaagtcaagtctgatgttacccatccgaaccactacatgttgttcgacaacgtggaagccattgaggttatcgcccggtcaatgaccgtcgaggcgttccgtgggtactgcttagggaacatccttaagtatcgcctacgtgctggcaagaagtccgaactggcaactatggagaaagacctcaagaaagctgcattctatcaggaactctttgacaaacaccgggggctgtgttatgacgcttcgtgaatgttgcgattggtgtgccgctaagtggaaccaagctatcgaggatggtgacaaggcgtctgctgacgcttaccaacaactgtacgcgctgtgggagcggcgctttaaggaggccaataaatgagccaatgtaacaacgggtgcaagtatgcgaaggacgtagggatggagaaccactcctgcgcaaatcgctgcatgtactcagaacagaaataccttctgacaatggaaggtaacaccgagtcctttgagattccggtattcgcccggtctcttgaagaggcaacgctacaggctgaacattacgaggacgcagggttcgtagttactcgaatccgtccagaagtgaaagcctaattaccctcactaaagggaacaacccaaactatcaaccaaaggagaaatactatggctggtttcaagaagaaaatctacacatctggtcttggcactgctgagccttatgcttacctgagtaagccggattatggcaacgaagagcgtggcttcggcaaccctcgcggtatctataaggtagacctgactctttccaataaagacccgcgctgtcaggcgatggtcgatgaaatcgtgaagactcacgaagaggcttatgctgctgccgtggaagagttcgaagctaacccgccgcaggtacagcgtggtaagaaaccactgaaaccttacgagggcgacatgccgttcttcgataacggtgacggtacgactaccttcaagttcaaatgctatgcgtctttccaagataagaagaccaaagagaccaaacacatcaatctggtcgtggtcgatagcaagggcaagaagattcaggacgttccgattatcggtggaggctccaagctgaaagtgaaatactctctggtgccttacaagtggaacacagctgtgggtgcaagcgttaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggagcattccgttccggcctagaagataaagtctcaaagcagcttgagagtaagggaattaagttcgactatgaactttggcgtatcccttacgtcatccctgcgagtgaccacttatacactccagacttcctgctacctaacggtatcttcattgagaccaaagggctgtgggattccgatgaccgcaagaaacaccttttgattcgtgagcaacaccccgaactggacatacgcttggtcttctcaagcagccgctcaaagctctacaagggtagcccaacaagctacggtgagtggtgcgagaagcatggcattctgtttgctgacaagctgataccggtggcgtggctcaaagaacccaagaaggaggttccgttcgataaatttcagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggatggttagacgtaggttatcacttcatcatcaagcgtgatggtactgtggaagcaggccgcgatgaactggctgtaggttcccacgttaaaggttacaaccacaactccgtaggcgtatgcctcgtgggtgggattgatgataaaggcaagttcgacgccaactttacacctgcgcaaatgcaagcgctgcgtagtctgctggtcacgctgctggcgaagtatgagggttcagtccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgcgtaccgtcacgtcagtgtcagtgcaaagacccaatcaaggctgaggaacacaccgaggaataattaacactcactaaagggatagtcgaaaggccgtccctttgttctcgaaggaggctaaaatatgaacaaaccatacaagcagttctatcaggctccgcgaagacacattcaagtgtgggtagcagctaatgggcctatcccggaagggtattacatagaccacattgacggcaatcctcttaacgatgacctgtccaatctccgtctcgctcttccgaaggagaactcccggaacgccaaaacatccaaagcaaacaagtccggcctcaagggtctctcatggagggacgataggcagtcgtggcgtggtgctgtgatggcagacggtaagcaatacacaaccaccagcaaggacttacttgaggtagtagcgtggatttacagaactaggagagaacttcatggacaattcgctagattcagatagcatatttctctatcacatcccatgcgaaaactgtgggagcagtgatgcaaactcgctgttctccgatggtcatacttattgttacgcctgcgagaactggacgcccggtgacggtgagagacctgagcgggaacgtagacaatcaaatgggagaaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgcggattaccgtgaccagaatggttccatcgtgtcacagaaggtgcgcgataaggacaagaactttaagaccactggaagtcacaagagcgatgcgttattcttgaagcacctctggtctggcggtaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttaccgtgtaaggacgccaacgagtgtcacatcatgggtgaagacaaagcaatcttggagcagatctggaacgcgaacccttgggtgcctgatggtgttgtctctgcgttgtcactcaaagaccgcgttaaggaagctatgacctccgaggacgctgtgggtctgctgttcgatggctgtcaaggcctgaacgatagaaccttgggtgcccgtggaggcgaagtcattatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgacgaactatttggagacgatacgttccacctttatgactcctttgcggaggccgaagctgacagactgttagcgaagctggcctacatgcgaacaggcttagggtgtgatgttatagtgctcgaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaagggaaaaccacatgaagaaggacgcgctgtttctattactgacctacgtggtagcggtgcgctgcgtcagttatctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacaagacggacaatcagacttctaaataccagtgccactgcggtcatccagactgtgatggcggaatgtataattgattaaccctcactaacgggaacaacctcaaaccataggagacacaccatgtttaaattcattaacgctttaggtaagctggtagttaaactgtacttcgtcgaagccaagaagctggacaagaaggccaaagctgattcacagcgagccattgagttggcgaaacagtcccgtgagaaatccgatgcggctgttagtggcatccacaagtcggcagcgattgcagccaaagcacaatccatgagcaaattctttgagtaaggagcacaccatgagcaagtcaatcactcacgcaaacaccatccgtctgccggacaccgctgaccagttcgctcgtcgagtacatattaatgtgcgcggtgagaaggtaacgatggtctaccgctggaaagaccacaagtctccgaaagcacacactcaacgcatgaccttgactgacaagcaggtaggccgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttatcctgaaatgaaaggagggcattatgctcgtaagtgacattgaggccaacaacctcttagagaaagtcaccaagtttcactgtggcgttatctatgactaccgcgatggtgagtatcatagttatcgtccgggcgacttcggggcgtatctggatgcgctggaagccgaggtgaagcgaggtgggcttattgttttccataacggtcacaagtatgacgttccggctttagagaaactagcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgccctggaggcatggggttatcgcttgggcgagatgaaaggtgaatataaggacgacttcaaggctatgctagaagagcagggcgaagaatatgttgatggtgctgagtgggtttcgttcaacgagccgatgatggcttataacgttcaagacgttgtggtcactgtcaagctcttagagaaattccttacagacctccactacttccctgcgggtatggacttcacgaagtacgatgcggatttattctggcgagaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacggacaggcaagccgctgccgagttatcctcgcgtggtctatccgaaacagggtggcgtgtacaagaagcctcgtaataaggcacagcgcgaaggtcttgaaccttgcgacttggacacgagggattacatggaaggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaggcgtggttacgttatgttcaagatgatggtaagattcacggagccgttaaccctaacggtgcagttactggtcgtgctactcatagtttcccaaaccttgcacagatacccggtgttcgttctccttacggggagcagtgtcgtagtgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccgacacgcgacaacgccaagactttcatttacgggttcctttacggagcaggagatgagaagattggtcagattgttggggcagggaaggagcgcgggaaggaactcaagaagaaattcttagagaacaccccggcgattgcagcattgcgagaagctatccaacagtctctcgttaagtcttccgcttggattggcggtgagcagaaagtccagtggaaacgccgttggattaaaggtctggatggtcgcaaggttcacgtcaggtctccacatgcagcgctcaacacattgttgcagtctgctggtgctctgatttgtaagctgtggattattaagaccgaagagatgctcattgagaaaggcttgaagcatggctgggatggtgactttgcgtacatggcttgggttcacgatgagattcaggtggcctgccgtaccgagcacatcgctcagattgttattgacaccgcgcaggaagctatgcgttgggtcggagagcattgggctttccgttgtcgtttagataccgaaggtaagatggggccaaattgggccgtctgccactaacagtaggagaaacattatggcaatgaccaaacactttaaagtaaccttcgacgttactgctgtgattgacagtgaatccgagaagaatctgaacgagttgctggtagacctagctaagaaggccgggtctggcgagaagctgaatccgttcaaacaagaactgcttattcaaggtctgacacacgggccggaaggtgcggctgcgttctgcatcaagcaaggtctccgtgagtttatccgcgatggtcacagtgagttaagctctaccgagcagaagcggatgaaattctcacctgcaactgtgcgggaggtgttcaaatgagtgaatacctgaaagtgcttgcagctatcaagggttgccctaagtcctttcagtcgaactatgtgcgaaacaatgcggctctcgtagctgaggccgcgtctcgtggacacattagctgtttgactgttggtggtcgtaatggtggagcgtgggaggtcacatccgctggtgtgcgcttcctgaaacgaatgggaggttgtgtatgattatgccaaagagtgacaccgtaacgatgactcgtgatgcgtggaatgatgttagcgcgtacattgataagctggagaaagacctagagttcctgaatgctcttaaggcgtgtggtgtggataattgggacggatactctgatgcaatcgagatggtttacggggaggaagacctatgagtttgattaccctcaaagacttcgctgagatgcgtgaaggtaaaccgatggagaagggcgtgctggtcatggatggtgactggctggtgtatcagtcgatggctgctgccgaagttgagacggattggggcgatgacatttggactctggagtgtgaccacgctaaggcgcggagcattctggattctgcaatcgaatcgtaccgaacccgtaagaaagcatggcgtgacgctacggttgtgctggcgtttaccgacgatgtgaactggcgcaaggaacttgtagacccgacttacaaggagaaccgcaaggcgacccgtaaacctgtgggctaccgtgacttccttcaagctctgtgggagcgcgatgagttcattcacatcaaagaggacatgcttgaaggtgatgacgttatgggcatcattgggtctggtcacgaggtcttcggcttcaagaaggctgtgttggtctcctgtgataaggacttcaagactatcccggacgttgacttcctgtggtgtaccactggtaacatcttgacgcagaccaaagagaccgctgattggtggcatctcttccagaccatcaagggtgatatgactgatggctactccgggattcccggctggggcgatacggcagaaggtttcctgaatgacccgttcattgtggagcctgtagagtccgtgttgaagtccggtaagaacaaggggcagacagtaaccaagtgggtgaagcgtgctcctgatgcgactgagacgttgtgggactgcattaaatccattggtgccaaagctgggatgaccgagcaggaaatcatcaagcagggccagatggctcgcattcttcgcttcgaggaatacaattacattgacaaggagatttacctatggacgccgcgaagctgattaccgtcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaattatatgtgctggaaaccgaaggtgaaagtccccaagatggacactaaccagattcgcgctgctgaaccagcacctttgactgagccacctaaatctgtggtatggggaggcgatgatgatgaggacaccagcgtgtcttcctctgaggttccaaccacacagagcagcggtaagagcagtcttaaggtaaagctggatgacaacgcagccaagaacaagagtaaatcctccattcgctccaaggcgtttgggtaactgtgacataacataggggacacattatgggattcctcaagaaaatcaagaaagccgttaagaaagttgtgaaggaagttagcagaccagtcgagaaggcaggtaaggaagtcggtaaagccgttggcggtgcgctgggtgcaggtaagcaggagattatccaacaagaggctccagtaccagtagtgactgcgccacctccagcacagattgtagatgtacctgaacaggataaggctgagggtgaggatggggcacaaaccgagagcgcacgtaagaaggcccgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacatatccgactgacgctatgccctacattccggttcgcatggttcgcattgatggcgagtcttatggtcgctcctactgtgaagaatacttaggtgacttaaggtcgcttgagaatctccaagaggctatcgttaagatgagcatgattagtgctaaggtcatcggtctggtcaaccccgctggtattacacaaccgcgtcgattaaccaaggctcagactggcgacttcgttccgggtcgtcgagaagatattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcggtcgtggtcaagacctcgataagctggagcgctgtatctccgcttgggctgctctggcccctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgctgccgccgctggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgcttagtctcgatgttgctgcccgtgacggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaagccgatgagtttgagccgctgggtgacactccagaagaactgagccaagttactgaacaattaggacagcacgaagaaggctttcaggcgatggtcgagcaggccgttgagcgtggactgagcgcagagtctgtgactcgcatctacgaagagtacgaagccgatggcatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaacaaacccggctgcggctgagtcccttgagactgccatgatgaaccgagacttggcgactgtcaaagcaattatcaatctggctggtgagagttacacgaagaaattcggtaagcctgccaaccgtagtgttaccaagcgtgctactccggttaaaccagtagctcgtcagaaagagggctttacgaatcaggctgagatgattaaagctatgagcgacccgcgctatcgtagcgattctgcctaccgccaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggcgatggcggctgacggtgccgtactggctgaactggctggtctggttaacctgcctgacgcctccaatgagaacatcgagggtctcggtaagcctaccgtactgactctggttaagccgacctctggcgacctgactgacccggttgagctgggtaaagcgattatcgctcagttgaccgttgctcgtgcggctctgaccaagaattacgttccggctgctgaccgtaccttctacaccactcctgataactactctgcgattctggctgccctgatgccgaacgctgcaaactatcaggcattgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgtgggcctgttccagcaccgctctgcggttggtacggtcaaactgaaagacttggctctggagcgcgctcgtcgtgcgaactatcaggctgaccagattatcgctaagtacgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtatagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcaggagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggcatgataccgtttagctctgactatctgtccgtaatggcaacaagcggtcagacccaatatatcaaccgtggtggctatctctatgaccgctctgcgaagaccgacagattcccttctggtgtgcaggtaaacctgattcgtctgagagagttcgatgagatgcctgagtgcttccgaaactatatcgtcaccaaggcttcccgccagtttaacaaccgcttcttcggtgcgccggaggtagacggagtgttgcaggaagaggaacaggaagcgtggcgtgcgtgcttcgagtacgaactagactacggcaactacaacatgctggatggtgacgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgtggtgttcactggtgaagacattaaggtgttcgacctcgatggtaaggagtaccaagtacgtggagaccgctcatatgttcgtacagctaacccacgagaagaccttaggatggtaactgtggctgattatacctttgtgactaaccgcaaggtggttgtgcagagtaacgaccaatcggtcaaccttccgggctttaaagaccaaggcgatgcactgattaatgttcgtggcggacaatatgggcgtagattatcaatcgagttcaacggggttgagcgtgctgctgtgcaactaccagatggttcacaaccagcacacgttaacgaggtggatggtcaggctatcgctgagaagctggcggtgcagttgcggaataacctagggaacccaaacaatgagcaagacccaaataagtggcggttcaatgttggccccggattcatccatatccttgcgcctaataacgataacgtttggggactacagactaaggatggttacgcagaccagctaatcaaccctgtaacccattacactcagtcgttccagaagttgccgattaatgctccagatgggtacatcgtgaagattgttggtgatacctcaaagactgccgaccagtattacgttaggttcgacctcaaccgtaaggtatgggtagaaacaattggctggaacacaaggactcacctacattaccacacgatgccttgggcgctggtacgtgcttctgatgggaactttgacttcaagtaccttgagtggggtgctcgtactgtgggggacgatacaaccaacccatacccatcctttaccggacagacaatcaatgatattttcttcttccgtaaccgtttaggattccttagtggggagaacatcatcttgtctcgcacctcgaaatacttcaacttcttcccggcctccgtgtcaaactactccgacgatgacccaatcgacgttgctgttagccacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtacaagacagggcacgcccacatggtgtaggacgtaatgtatactttgcgtcacctcgcgcttccttcacatccattaaccgatactatgcggtacaggatgtaagctctgtgaagaacgcagaggacatgacggctcacgttccgaactacatacctaatggggtatttagtatctcaggcacaactgctgagaacttcgtggctatccttacgagcggtgcgccgaaccgagtgtatatctataagttcctctacattgacgaggaaatcaggcagcagtcatggtctcattgggactttggggacaacgttacggtgtttgcagcacatgtgataaactcaacaatgactgtattgatgggcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcaacgatttatgggatgaacttcaccaagggtatggtttcggtggtctttcctgatgggaagattgtagagatagacccgccaatcaacgggtggagtagcgacccaatattgagactcgatggaaaccaagagggccaagtggtttacattgggttcaacatcccgttcacttatacgttctcgaagttcctcattaagaagactgctgaggatggctcgacggctaccgaggatattggtcgcttacagcttcggcgtgcgtgggtaaactatgaggattctggcgcgttcaccatccgtgtgaacaacctgtcccgtgagttcatctacacaatggctggcgctcgcttgggttctgacaatctgcgtgttggcaggtcgaacattggcacagggcagtaccgcttcccggttgttggaaacgctcagacgaacatagtaaccatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggtaatcagggagaccgagtgtggttccttacctctaagtacgtcccactgtttaccttgaaggagcgcttagagtttcgtagacttatcattgaatatcgtgatatgatgctgagccagtatgagtccatttggaatttcgtttgggtaggcaataagtcacacattcgtttcctaaagaccataggtgcggtattccataatgagtttaccgctgatggtcaatttcaattattcactatcagtaggaggtaactatgtgctggatggcagcgattcctatcgccatgatgggtgcccaagctctgagtagccagaacagtgctgacaaggcacgagtggcacagacagaagctggacgccgacaggcaatggagatggtcaaagagacgaatatccagaatgccaacgcctcattggaacaacgagacgcccttgaagctgcatcctctgagttgactacacgtaacatgcagaaggtacaggctatgggaacaatccgtgcagctatcggcgagagtatgctagaaggcgaatcaatgaagcgcatcaagcgtatcgaagagggcaactacattcgggaggcaaatagtgtcaccgagaattaccgccgagactacgctagtatctttgcgcaacagttgggacgcactcagtccacagcaagtcaagtcgatgcaatgtacaagagcgaggccaaaggtaagtccggcctgatgcgtgtactagaccctctgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccattggtcgattcgctaaggctggtgccgatatgtacatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaatacctgaagggtttcaacgcgaatatcaccgagcgtaacattgctctgtatggggcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtaactctaaatggcgctacgactacctatcgtgaactgatgggtgatgaacagtggcaggccatgatgattaaggcacagcacactcaattccagaacaacgcgaagttaacagagaagttccgactggatattaactcagcgcttaaccaagcggacactggtaaaggttgggagactcttcaaggtatcaaggccgaactcgataagattcagccgggtgaagagatgactcctgagcgtgagtggttgatttccgcacaggaacagatgcgcacccgcttcaagcaggaacaagctgagacagccaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagtgatatggtcaactacgcgaaccagaagttagcggaaatcgaggcgatggacttaacgcctgaacagaaagacaaactgaaattggactacctacgggcagactccaaggagggtgctttccgtgcagcgtttggtgagatgattactgatgctggaaacgaatggcaggctgcggtgattaacggcaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggccgctatgatgaacgattcaacgaatcctcaaatcaagtacatgccttcgagtgtccaagggtatgccaggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactccagcgtgagtaccagcgtaccgcacagatgcaagctgaggcagcacgagagaaagccctcaaagaggccaacaagcgtgccccaataagccgtgcaacacaggcgcgtgaagaagcgcgtaaacgtgtccaagataaacggaagaagactccgaagtatatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaacaggcccgaagggtctcatgcagttcaccaaaggtacagccactgcgcttggcctcaaggttactgacgctgatgacgatgaccgttacaaccctgagttggctgtggatgcagccgctcgtcacctgagtgacctcattcggaagtacgatggggatgaactcaaagctgccttggcgtataatcagggcgaggggcgcaacggtgctccacagatacaggcttatgacaaaggcgattgggcttcaatctctgaggaaggtcgtgactacatgcgtaacctgatggatgtagccaacagtcctcgcaagggggacttggaggcgttcggcggtatcaccccaaaggctaagggcattccatcgggggatgcatttgctggaatcgggaagaagcagacggtaggcactgacctgccggagtccactggattcaaagtggagggtaaagagcagcaagcgcctaacgtgccttatgctaaggacttttgggaaaagactggaacaacactggacgagtttaattctcgttcaaccttcttcggaatcggagatgccacaagtgcagaacttcacaactccgtattgggtgtggcttttcgtgccgctcgtagtgatgacggttttgatttattcaaggacaccattacgccgactcgctggaacagccatacgtggactccagaagagttagagcgtatccgtaaggaggtgaagaacccatcgtacatcaatgtagtcactggaggctctcctgagaatctggacgccctcattaagatggcgaatgacaactacgagatggacgcgcggtctgccgatgcgggtgttggtgccaaacttactgctggtatcgtcggtgctggtgtagacccgctgagttacgtgccgctagtgggtgtagccgggaagggtctcaaggtggctaacaaggctttcattgtcggtactcaaagtgctggcctagctgttgcctctgagggtatccgcacatcaatagctggtggtgaagcacactacgctgatgctgctttaggtggtctcatgttcggtgccggtatgagtgcaatcagtgacgctatcgctgctggtattcgccgttcccgtgggactgaggtcgttaatgacttcgctcctatggcacaccgcttggaagcccgcgagaccgctctgaactctggtggcgaagacctgacccgtatgcctagcgataaccatgtgttcgaccgtgagcacgctggcgttgagtattcacctctggagaccgagccgggtgcagttgtgttgcctcaaggtcaaatcctgagcgacaccaacccactcaaccctcagactcttagcgagttcgaggcggtcaaccctgagcgtgccgctcgtggtatctctttgggtggtttcactgagattggcttgaagactctccgctctgagaacccgactgttcgctccattgcgagtgaccttgtgcgctctccgactggtatggagtccgggacttctggtaagttcggtgcgacagcttctgacattaaggagcgactccacgcgaacaaccagcgcacctacaatcagctttatgatgctgtgcgtactgcaatgaaagaccctgagttctccaccggtggttccaagatgagccgtaaggaaatccgacaggaaatctacaagcgtgcagccttagcgattgagcggcctgagcttcaagcaaatctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctaactggtcgtgctcgaaggaacccggaaggcgcttggggcacagccctacgctccgtcaatgaccttacgttcttcgctaagaacgcctacatgggtgcgcagaacatcactgaaatcgctggtatgctggctaaaggtaacgtctctgcgataactcatggcatccctatgattaacgattgggtcaaccgtggtaaaccgcttcgtgcctctgagattaaggagctacacgggatggtgttcggtaaggaactcgaccaactaatccgtccgggacgtgaagaccacgtgcgccgactccgggagtctacggacaccagcgctgcggttgccaatgtggtcggtacgattcgtttcggtactcaagagttggctgcacgctccccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagactatgcgactcgtggggaagacggtaagttcaccattcgtgacaaacaggctttcgctaacgacccacgctcaatggacttgtggcgtctggctgacaaggtggctgatgagactatactgcgccctcacaaggtttcctcacaggacgccaaagcgttcggtgctggggtcaagatggtgatgcagtttaagaacttcgtcattaagtcactgaactcccggttcgtccgcagcttctatgaggccacgaagaacaaccgagcgttagaccaagcgctgacccacatcgtctctttgggtctagctggtggttactacgttgcgcaggcgcaccttaaggcctcaagtctacaggagcacaaacgtaaggagtaccttaagaacgcccttgaccctaagatgattgctcatgcgtcaatctctcgtagttcac

SEQ ID NO: 143 - DNA, 38903 bp, Unknown
  source: /note="Description of Unknown: KP2-7c Bacteriophage Sequence"
acccgccgcaggtacagcgtggtaagaaaccactgaaaccttacgagggcgacatgccgttcttcgataacggtgacggtacgactaccttcaagttcaaatgctatgcgtctttccaagataagaagaccaaagagaccaaacacatcaatctggtcgtggtcgatagcaagggcaagaagattcaggacgttccgattatcggtggaggctccaagctgaaagtgaaatactctctggtgccttacaagtggaacacagctgtgggtgcaagcgttaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggagcattccgttccggcctagaagataaagtctcaaagcagcttgagagtaagggaattaagttcgactatgaactttggcgtatcccttacgtcatccctgcgagtgaccacttatacactccagacttcctgctacctaacggtatcttcattgagaccaaagggctgtgggattccgatgaccgcaagaaacaccttttgattcgtgagcaacaccccgaactggacatacgcttggtcttctcaagcagccgctcaaagctctacaagggtagcccaacaagctacggtgagtggtgcgagaagcatggcattctgtttgctgacaagctgataccggtggcgtggctcaaagaacccaagaaggaggttccgttcgataaatttcagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggatggttagacgtaggttatcacttcatcatcaagcgtgatggtactgtggaagcaggccgcgatgaactggctgtaggttcccacgttaaaggttacaaccacaactccgtaggcgtatgcctcgtgggtgggattgatgataaaggcaagttcgacgccaactttacacctgcgcaaatgcaagcgctgcgtagtctgctggtcacgctgctggcgaagtatgagggttcagtccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgcgtaccgtcacgtcagtgtcagtgcaaagacccaatcaaggctgaggaacacaccgaggaataattaacactcactaaagggatagtcgaaaggccgtccctttgttctcgaaggaggctaaaatatgaacaaaccatacaagcagttctatcaggctccgcgaagacacattcaagtgtgggtagcagctaatgggcctatcccggaagggtattacatagaccacattgacggcaatcctcttaacgatgacctgtccaatctccgtctcgctcttccgaaggagaactcccggaacgccaaaacatccaaagcaaacaagtccggcctcaagggtctctcatggagggacgataggcagtcgtggcgtggtgctgtgatggcagacggtaagcaatacacaaccaccagcaaggacttacttgaggtagtagcgtggatttacagaactaggagagaacttcatggacaattcgctagattcagatagcatatttctctatcacatcccatgcgaaaactgtgggagcagtgatgcaaactcgctgttctccgatggtcatacttattgttacgcctgcgagaactggacgcccggtgacggtgagagacctgagcgggaacgtagacaatcaaatgggagaaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgcggattaccgtgaccagaatggttccatcgtgtcacagaaggtgcgcgataaggacaagaactttaagaccactggaagtcacaagagcgatgcgttattcttgaagcacctctggtctggcggtaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttaccgtgtaaggacgccaacgagtgtcacatcatgggtgaagacaaagcaatcttggagcagatctggaacgcgaacccttgggtgcctgatggtgttgtctctgcgttgtcactcaaagaccgcgttaaggaagctatgacctccgaggacgctgtgggtctgctgttcgatggctgtcaaggcctgaacgatagaaccttgggtgcccgtggaggcgaagtcattatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgacgaactatttggagacgatacgttccacctttatgactcctttgcggaggccgaagctgacagactgttagcgaagctggcctacatgcgaacaggcttagggtgtgatgttatagtgctcgaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaagggaaaaccacatgaagaaggacgcgctgtttctattactgacctacgtggtagcggtgcgctgcgtcagttatctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacaagacggacaatcagacttctaaataccagtgccactgcggtcatccagactgtgatggcggaatgtataattgattaaccctcactaacgggaacaacctcaaaccataggagacacaccatgtttaaattcattaacgctttaggtaagctggtagttaaactgtacttcgtcgaagccaagaagctggacaagaaggccaaagctgattcacagcgagccattgagttggcgaaacagtcccgtgagaaatccgatgcggctgttagtggcatccacaagtcggcagcgattgcagccaaagcacaatccatgagcaaattctttgagtaaggagcacaccatgagcaagtcaatcactcacgcaaacaccatccgtctgccggacaccgctgaccagttcgctcgtcgagtacatattaatgtgcgcggtgagaaggtaacgatggtctaccgctggaaagaccacaagtctccgaaagcacacactcaacgcatgaccttgactgacaagcaggtaggccgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttatcctgaaatgaaaggagggcattatgctcgtaagtgacattgaggccaacaacctcttagagaaagtcaccaagtttcactgtggcgttatctatgactaccgcgatggtgagtatcatagttatcgtccgggcgacttcggggcgtatctggatgcgctggaagccgaggtgaagcgaggtgggcttattgttttccataacggtcacaagtatgacgttccggctttagagaaactagcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgccctggaggcatggggttatcgcttgggcgagatgaaaggtgaatataaggacgacttcaaggctatgctagaagagcagggcgaagaatatgttgatggtgctgagtgggtttcgttcaacgagccgatgatggcttataacgttcaagacgttgtggtcactgtcaagctcttagagaaattccttacagacctccactacttccctgcgggtatggacttcacgaagtacgatgcggatttattctggcgagaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacggacaggcaagccgctgccgagttatcctcgcgtggtctatccgaaacagggtggcgtgtacaagaagcctcgtaataaggcacagcgcgaaggtcttgaaccttgcgacttggacacgagggattacatggaaggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaggcgtggttacgttatgttcaagatgatggtaagattcacggagccgttaaccctaacggtgcagttactggtcgtgctactcatagtttcccaaaccttgcacagatacccggtgttcgttctccttacggggagcagtgtcgtagtgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccgacacgcgacaacgccaagactttcatttacgggttcctttacggagcaggagatgagaagattggtcagattgttggggcagggaaggagcgcgggaaggaactcaagaagaaattcttagagaacaccccggcgattgcagcattgcgagaagctatccaacagtctctcgttaagtcttccgcttggattggcggtgagcagaaagtccagtggaaacgccgttggattaaaggtctggatggtcgcaaggttcacgtcaggtctccacatgcagcgctcaacacattgttgcagtctgctggtgctctgatttgtaagctgtggattattaagaccgaagagatgctcattgagaaaggcttgaagcatggctgggatggtgactttgcgtacatggcttgggttcacgatgagattcaggtggcctgccgtaccgagcacatcgctcagattgttattgacaccgcgcaggaagctatgcgttgggtcggagagcattgggctttccgttgtcgtttagataccgaaggtaagatggggccaaattgggccgtctgccactaacagtaggagaaacattatggcaatgaccaaacactttaaagtaaccttcgacgttactgctgtgattgacagtgaatccgagaagaatctgaacgagttgctggtagacctagctaagaaggccgggtctggcgagaagctgaatccgttcaaacaagaactgcttattcaaggtctgacacacgggccggaaggtgcggctgcgttctgcatcaagcaaggtctccgtgagtttatccgcgatggtcacagtgagttaagctctaccgagcagaagcggatgaaattctcacctgcaactgtgcgggaggtgttcaaatgagtgaatacctgaaagtgcttgcagctatcaagggttgccctaagtcctttcagtcgaactatgtgcgaaacaatgcggctctcgtagctgaggccgcgtctcgtggacacattagctgtttgactgttggtggtcgtaatggtggagcgtgggaggtcacatccgctggtgtgcgcttcctgaaacgaatgggaggttgtgtatgattatgccaaagagtgacaccgtaacgatgactcgtgatgcgtggaatgatgttagcgcgtacattgataagctggagaaagacctagagttcctgaatgctcttaaggcgtgtggtgtggataattgggacggatactctgatgcaatcgagatggtttacggggaggaagacctatgagtttgattaccctcaaagacttcgctgagatgcgtgaaggtaaaccgatggagaagggcgtgctggtcatggatggtgactggctggtgtatcagtcgatggctgctgccgaagttgagacggattggggcgatgacatttggactctggagtgtgaccacgctaaggcgcggagcattctggattctgcaatcgaatcgtaccgaacccgtaagaaagcatggcgtgacgctacggttgtgctggcgtttaccgacgatgtgaactggcgcaaggaacttgtagacccgacttacaaggagaaccgcaaggcgacccgtaaacctgtgggctaccgtgacttccttcaagctctgtgggagcgcgatgagttcattcacatcaaagaggacatgcttgaaggtgatgacgttatgggcatcattgggtctggtcacgaggtcttcggcttcaagaaggctgtgttggtctcctgtgataaggacttcaagactatcccggacgttgacttcctgtggtgtaccactggtaacatcttgacgcagaccaaagagaccgctgattggtggcatctcttccagaccatcaagggtgatatgactgatggctactccgggattcccggctggggcgatacggcagaaggtttcctgaatgacccgttcattgtggagcctgtagagtccgtgttgaagtccggtaagaacaaggggcagacagtaaccaagtgggtgaagcgtgctcctgatgcgactgagacgttgtgggactgcattaaatccattggtgccaaagctgggatgaccgagcaggaaatcatcaagcagggccagatggctcgcattcttcgcttcgaggaatacaattacattgacaaggagatttacctatggacgccgcgaagctgattaccgtcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaattatatgtgctggaaaccgaaggtgaaagtccccaagatggacactaaccagattcgcgctgctgaaccagcacctttgactgagccacctaaatctgtggtatggggaggcgatgatgatgaggacaccagcgtgtcttcctctgaggttccaaccacacagagcagcggtaagagcagtcttaaggtaaagctggatgacaacgcagccaagaacaagagtaaatcctccattcgctccaaggcgtttgggtaactgtgacataacataggggacacattatgggattcctcaagaaaatcaagaaagccgttaagaaagttgtgaaggaagttagcagaccagtcgagaaggcaggtaaggaagtcggtaaagccgttggcggtgcgctgggtgcaggtaagcaggagattatccaacaagaggctccagtaccagtagtgactgcgccacctccagcacagattgtagatgtacctgaacaggataaggctgagggtgaggatggggcacaaaccgagagcgcacgtaagaaggcccgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacatatccgactgacgctatgccctacattccggttcgcatggttcgcattgatggcgagtcttatggtcgctcctactgtgaagaatacttaggtgacttaaggtcgcttgagaatctccaagaggctatcgttaagatgagcatgattagtgctaaggtcatcggtctggtcaaccccgctggtattacacaaccgcgtcgattaaccaaggctcagactggcgacttcgttccgggtcgtcgagaagatattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcggtcgtggtcaagacctcgataagctggagcgctgtatctccgcttgggctgctctggcccctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgctgccgccgctggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgcttagtctcgatgttgctgcccgtgacggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaagccgatgagtttgagccgctgggtgacactccagaagaactgagccaagttactgaacaattaggacagcacgaagaaggctttcaggcgatggtcgagcaggccgttgagcgtggactgagcgcagagtctgtgactcgcatctacgaagagtacgaagccgatggcatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaacaaacccggctgcggctgagtcccttgagactgccatgatgaaccgagacttggcgactgtcaaagcaattatcaatctggctggtgagagttacacgaagaaattcggtaagcctgccaaccgtagtgttaccaagcgtgctactccggttaaaccagtagctcgtcagaaagagggctttacgaatcaggctgagatgattaaagctatgagcgacccgcgctatcgtagcgattctgcctaccgccaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggcgatggcggctgacggtgccgtactggctgaactggctggtctggttaacctgcctgacgcctccaatgagaacatcgagggtctcggtaagcctaccgtactgactctggttaagccgacctctggcgacctgactgacccggttgagctgggtaaagcgattatcgctcagttgaccgttgctcgtgcggctctgaccaagaattacgttccggctgctgaccgtaccttctacaccactcctgataactactctgcgattctggctgccctgatgccgaacgctgcaaactatcaggcattgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgtgggcctgttccagcaccgctctgcggttggtacggtcaaactgaaagacttggctctggagcgcgctcgtcgtgcgaactatcaggctgaccagattatcgctaagtacgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtatagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcaggagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggcatgataccgtttagctctgactatctgtccgtaatggcaacaagcggtcagacccaatatatcaaccgtggtggctatctctatgaccgctctgcgaagaccgacagattcccttctggtgtgcaggtaaacctgattcgtctgagagagttcgatgagatgcctgagtgcttccgaaactatatcgtcaccaaggcttcccgccagtttaacaaccgcttcttcggtgcgccggaggtagacggagtgttgcaggaagaggaacaggaagcgtggcgtgcgtgcttcgagtacgaactagactacggcaactacaacatgctggatggtgacgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgtggtgttcactggtgaagacattaaggtgttcgacctcgatggtaaggagtaccaagtacgtggagaccgctcatatgttcgtacagctaacccacgagaagaccttaggatggtaactgtggctgattatacctttgtgactaaccgcaaggtggttgtgcagagtaacgaccaatcggtcaaccttccgggctttaaagaccaaggcgatgcactgattaatgttcgtggcggacaatatgggcgtagattatcaatcgagttcaacggggttgagcgtgctgctgtgcaactaccagatggttcacaaccagcacacgttaacgaggtggatggtcaggctatcgctgagaagctggcggtgcagttgcggaataacctagggaacccaaacaatgagcaagacccaaataagtggcggttcaatgttggccccggattcatccatatccttgcgcctaataacgataacgtttggggactacagactaaggatggttacgcagaccagctaatcaaccctgtaacccattacactcagtcgttccagaagttgccgattaatgctccagatgggtacatcgtgaagattgttggtgatacctcaaagactgccgaccagtattacgttaggttcgacctcaaccgtaaggtatgggtagaaacaattggctggaacacaaggactcacctacattaccacacgatgccttgggcgctggtacgtgcttctgatgggaactttgacttcaagtaccttgagtggggtgctcgtactgtgggggacgatacaaccaacccatacccatcctttaccggacagacaatcaatgatattttcttcttccgtaaccgtttaggattccttagtggggagaacatcatcttgtctcgcacctcgaaatacttcaacttcttcccggcctccgtgtcaaactactccgacgatgacccaatcgacgttgctgttagccacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtacaagacagggcacgcccacatggtgtaggacgtaatgtatactttgcgtcacctcgcgcttccttcacatccattaaccgatactatgcggtacaggatgtaagctctgtgaagaacgcagaggacatgacggctcacgttccgaactacatacctaatggggtatttagtatctcaggcacaactgctgagaacttcgtggctatccttacgagcggtgcgccgaaccgagtgtatatctataagttcctctacattgacgaggaaatcaggcagcagtcatggtctcattgggactttggggacaacgttacggtgtttgcagcacatgtgataaactcaacaatgactgtattgatgggcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcaacgatttatgggatgaacttcaccaagggtatggtttcggtggtctttcctgatgggaagattgtagagatagacccgccaatcaacgggtggagtagcgacccaatattgagactcgatggaaaccaagagggccaagtggtttacattgggttcaacatcccgttcacttatacgttctcgaagttcctcattaagaagactgctgaggatggctcgacggctaccgaggatattggtcgcttacagcttcggcgtgcgtgggtaaactatgaggattctggcgcgttcaccatccgtgtgaacaacctgtcccgtgagttcatctacacaatggctggcgctcgcttgggttctgacaatctgcgtgttggcaggtcgaacattggcacagggcagtaccgcttcccggttgttggaaacgctcagacgaacatagtaaccatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggtaatcagggagaccgagtgtggttccttacctctaagtacgtcccactgtttaccttgaaggagcgcttagagtttcgtagacttatcattgaatatcgtgatatgatgctgagccagtatgagtccatttggaatttcgtttgggtaggcaataagtcacacattcgtttcctaaagaccataggtgcggtattccataatgagtttaccgctgatggtcaatttcaattattcactatcagtaggaggtaactatgtgctggatggcagcgattcctatcgccatgatgggtgcccaagctctgagtagccagaacagtgctgacaaggcacgagtggcacagacagaagctggacgccgacaggcaatggagatggtcaaagagacgaatatccagaatgccaacgcctcattggaacaacgagacgcccttgaagctgcatcctctgagttgactacacgtaacatgcagaaggtacaggctatgggaacaatccgtgcagctatcggcgagagtatgctagaaggcgaatcaatgaagcgcatcaagcgtatcgaagagggcaactacattcgggaggcaaatagtgtcaccgagaattaccgccgagactacgctagtatctttgcgcaacagttgggacgcactcagtccacagcaagtcaagtcgatgcaatgtacaagagcgaggccaaaggtaagtccggcctgatgcgtgtactagaccctctgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccattggtcgattcgctaaggctggtgccgatatgtacatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaatacctgaagggtttcaacgcgaatatcaccgagcgtaacattgctctgtatggggcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtaactctaaatggcgctacgactacctatcgtgaactgatgggtgatgaacagtggcaggccatgatgattaaggcacagcacactcaattccagaacaacgcgaagttaacagagaagttccgactggatattaactcagcgcttaaccaagcggacactggtaaaggttgggagactcttcaaggtatcaaggccgaactcgataagattcagccgggtgaagagatgactcctgagcgtgagtggttgatttccgcacaggaacagatgcgcacccgcttcaagcaggaacaagctgagacagccaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagtgatatggtcaactacgcgaaccagaagttagcggaaatcgaggcgatggacttaacgcctgaacagaaagacaaactgaaattggactacctacgggcagactccaaggagggtgctttccgtgcagcgtttggtgagatgattactgatgctggaaacgaatggcaggctgcggtgattaacggcaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggccgctatgatgaacgattcaacgaatcctcaaatcaagtacatgccttcgagtgtccaagggtatgccaggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactccagcgtgagtaccagcgtaccgcacagatgcaagctgaggcagcacgagagaaagccctcaaagaggccaacaagcgtgccccaataagccgtgcaacacaggcgcgtgaagaagcgcgtaaacgtgtccaagataaacggaagaagactccgaagtatatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaacaggcccgaagggtctcatgcagttcaccaaaggtacagccactgcgcttggcctcaaggttactgacgctgatgacgatgaccgttacaaccctgagttggctgtggatgcagccgctcgtcacctgagtgacctcattcggaagtacgatggggatgaactcaaagctgccttggcgtataatcagggcgaggggcgcaacggtgctccacagatacaggcttatgacaaaggcgattgggcttcaatctctgaggaaggtcgtgactacatgcgtaacctgatggatgtagccaacagtcctcgcaagggggacttggaggcgttcggcggtatcaccccaaaggctaagggcattccatcgggggatgcatttgctggaatcgggaagaagcagacggtaggcactgacctgccggagtccactggattcaaagtggagggtaaagagcagcaagcgcctaacgtgccttatgctaaggacttttgggaaaagactggaacaacactggacgagtttaattctcgttcaaccttcttcggaatcggagatgccacaagtgcagaacttcacaactccgtattgggtgtggcttttcgtgccgctcgtagtgatgacggttttgatttattcaaggacaccattacgccgactcgctggaacagccatacgtggactccagaagagttagagcgtatccgtaaggaggtgaagaacccatcgtacatcaatgtagtcactggaggctctcctgagaatctggacgccctcattaagatggcgaatgacaactacgagatggacgcgcggtctgccgatgcgggtgttggtgccaaacttactgctggtatcgtcggtgctggtgtagacccgctgagttacgtgccgctagtgggtgtagccgggaagggtctcaaggtggctaacaaggctttcattgtcggtactcaaagtgctggcctagctgttgcctctgagggtatccgcacatcaatagctggtggtgaagcacactacgctgatgctgctttaggtggtctcatgttcggtgccggtatgagtgcaatcagtgacgctatcgctgctggtattcgccgttcccgtgggactgaggtcgttaatgacttcgctcctatggcacaccgcttggaagcccgcgagaccgctctgaactctggtggcgaagacctgacccgtatgcctagcgataaccatgtgttcgaccgtgagcacgctggcgttgagtattcacctctggagaccgagccgggtgcagttgtgttgcctcaaggtcaaatcctgagcgacaccaacccactcaaccctcagactcttagcgagttcgaggcggtcaaccctgagcgtgccgctcgtggtatctctttgggtggtttcactgagattggcttgaagactctccgctctgagaacccgactgttcgctccattgcgagtgaccttgtgcgctctccgactggtatggagtccgggacttctggtaagttcggtgcgacagcttctgacattaaggagcgactccacgcgaacaaccagcgcacctacaatcagctttatgatgctgtgcgtactgcaatgaaagaccctgagttctccaccggtggttccaagatgagccgtaaggaaatccgacaggaaatctacaagcgtgcagccttagcgattgagcggcctgagcttcaagcaaatctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctaactggtcgtgctcgaaggaacccggaaggcgcttggggcacagccctacgctccgtcaatgaccttacgttcttcgctaagaacgcctacatgggtgcgcagaacatcactgaaatcgctggtatgctggctaaaggtaacgtctctgcgataactcatggcatccctatgattaacgattgggtcaaccgtggtaaaccgcttcgtgcctctgagattaaggagctacacgggatggtgttcggtaaggaactcgaccaactaatccgtccgggacgtgaagaccacgtgcgccgactccgggagtctacggacaccagcgctgcggttgccaatgtggtcggtacgattcgtttcggtactcaagagttggctgcacgctccccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagactatgcgactcgtggggaagacggtaagttcaccattcgtgacaaacaggctttcgctaacgacccacgctcaatggacttgtggcgtctggctgacaaggtggctgatgagactatactgcgccctcacaaggtttcctcacaggacgccaaagcgttcggtgctggggtcaagatggtgatgcagtttaagaacttcgtcattaagtcactgaactcccggttcgtccgcagcttctatgaggccacgaagaacaaccgagcgttagaccaagcgctgacccacatcgtctctttgggtctagctggtggttactacgttgcgcaggcgcaccttaaggcctcaagtctacaggagcacaaacgtaaggagtaccttaagaacgcccttgaccctaagatgattgctcatgcgtcaatctctcgtagttcacacttaggctcaccattgagtatctacgacatgttcgctgggatggttggtagcgatacctataagtacacacgctctactgtactacctaaagagtccgagaagcgcgaccctaccaaggcagtgacaggtagacaggtggcttcaactatcgcaggtgcagttggtgagcaggttccgggtttaggttttgtgggttctgtgggcgcaacagcaattaacgccgcttccctgctatcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcgactaagaccacaatctccacaacgagagcgttggggccagcggacggttataacatgattgaaatccgtcgattcacctccgctaccgataggctggttgactttacggatggctcaatcctacgtgcgtatgacctgaacatctcgcaggtacagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtctgcgctgaactctgcgaaggctgctgctgcatctcaacaggccgctgctgcatctcaacaggccgctaagtcctcagagaacaactcgaaggtatctgaggacaacgcaaagacctccgagaacaacgcgcatcaatgggcgcagcgtacagaggactctccggttcagggtagcgagttctctgcgtatcactactcacggaaggcctccaagagtgccgccgccgcaagtacgtctgaggggaatgcaaagacctctgagaccaacgctaagacctctgagaccaacgctaagacctctgagactaacgctgcatcgagtgctgctaaggcttctgaggaggctgctaagctgactaacatgaatgactttgctgcttctattgattcagtcaacggtaacaatgttgtcatgaagggtgacttaaccattaaaggaaacggtaaagtatcaatactgaaccacagtgggctataccaagataagaccgtgaatggcgtgaactatgccaacaggatttatatggatgatgctgggggcatgcactttgagaactaccgtgtgtctggtacttcagtcaccttacgtgctggttttgttattacagataccaacaggtttgactttacagggccaacgcgagttaagggtgatatcaccgcatatgtggatgcgccacctaatccagccatcggtcaatacctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattaccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagaggacggcacaacataaggagaacaagaatgttatcttttgacttcaataacgaggtcgttaaggctgcgcctattgttggcacaggggtcgctgatggggcggcccgactcttttggggactatcgttaaacgagtggttctacgttgcagctatcgcctacacagtggttcagattggtgccaaggtagtcgataagatgattgactggaaacgtgcaaataaggagtaacccatgagcgacaagactttaatcaagctgctggagatgctggacacggagatggcacagcgtatgcttgctgacctccagagcgaggagcgccgaacgccgcagctttacaacgcaatcggcaaactgttagaccgccataagttccaaatcagtaagctgaccccggatgagaacatccttggtggtctcgcggctggtctggaagactacaacaaagtggtcggccctaatggtctgactgacgatgagactatcacgctacagtaagtgacatactcaaggttctccacgtggggagcctttatggatgttatttggtgcatctacgtgaagtctaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgagggcagcactgataggatgcttaatgacctgcgtagtaataataagcggctgtcagtccgcatcaagacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagatagatatggcccggtgtctggctaacggagacaacaagaagtttatcctacaggctttccgtggtattggtaagtcattcatcacctgtgcgttcgttgtgtggacgttatggcgtgaccctcagttgaagatactaattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctccgggagcgtgagttggaatatggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcaacgcatcctcgtgattgacccaagtggtcgcggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggcccgtgagaagggcgctgtggcccatgacgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagtgcataaggaatcattgagaccacggatggtcactttaagaaattccttaagaatcaatgagtttgaattaaccctcactaaagggagagaggggacttaaagctactatataggttagtcattcaggttatgcaatgaccctttatgcactttaagtctcctctatgattggtgatattatcattgtataatcaccctaccttagagcaactgaaaggaggtggctcaatgttacgcttgctgattgccctgctgcgtcatagagtcacttggcgatttcttctggtacttactgctgcccttgggtacgcaggtcttaatgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcctaaagagaccctttaagaatttactacaaaaatctgaatgggtatctcacagttcaagaacccaaagtaccccccatagccctcttaaagccacctaaagccagccctacccctagggtttaaccttcggttaaccttgagtgtagcgataactcactacggtatctactcgagtggcctataggatagcctaaagtgttgcctaaagtcaatatctaaagtggtggatggcttaatgagggcttaaagagtgtcctagtgtaccagttcaatagtacatctctatgtgtccctatctgttagcctcctaaagtaaaccctaaagccatcacctaaagccatcacctaaagagcgccgctatcttaaagacaaccagaccgatagacccactgttagcctgtagtgatgccttgtagttgcctatggtgtctatcgtcaattcaattaccctcactaaagggaataagggaataagggatacttaaaggggaattagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatacacagcgtcaaccggacacaaggtgtcttctaggtgacttaagcgcaccacggcacataaagtgaaacaaaacggttgacaacatgaagtaaacacggtacgatgtaccacgaaatgacggaacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgctttacgattgacgagttcggtcgccgctggcaagtacgataagtgttaaactcaaggtcgcacgctgagtgtggcctttatgattaccactaaataaccctgagaggatatgactatgaaacaatacgccatccttattcccggctggtgctactcaatgacctgctacgggtacaacgaaagggacgctcgtgcccgattcagggatcaacaaggcttcggcaagcgtttacctaatggtacggctgtatgggaggttatgtaatgagtaagttactggcaacatccaaaatagcaggccagtgcaccgtaacactgcgtgagtattaccacgggtcaatgggaagcacctacgttgtgcggtatggtaaacaggtcacacattgggtaaacccgattttagcacaagaggattatcaagcctgtgtggtacaccaagcaacatgtgcgggctggaatgattgataacgcgctttgcaatcactggacaacaggcttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctatgcatcgcaatgtactttatgcgagactttaagcgcggtctggcaatacacaaggcaacgctgagttactttaagtggggattcatcccacggtttacggttcgtgaacgtaacggacgctttaaagccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagccaatgctggtggctcttgcggctgctatcgtgaacgatgagactcaggacggcgaactgacgcaggcagcaggaaacacgtcgctcgaagatatggactactggcagacactggctgagcgtatgcgtgatgttggatttgtacgcttgggtaacggtcactttagcgcagcatatgagcacgcactgttaccgggcaaggtcatcaaggtaggctttaagaaagaggactcaggcgcagcctatgcagccttctgccgtatgaatcagggtcgggagggtatccctacggtgtacgacattcagcgtcatgcaggctgctacacggtggtcttggactatctgacaccgcttaacgattggtgctacggtgaaagcgataagattcgccaccacttccgcgctgcaagggaaatcattgaggaggattgcttcaataccgccgaagagtacccgataagtgacgggttcattgagacctgcaaggatatccgcaagttcttcctaggcattgcatcgttcgattgtcacagcggtaacatgatgaaagaccaaatgggccgcttgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggaacctttcaggtagcacgtaaagcccgtgcaaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttgggtgcaccacaataacctaaactttgcagaactggagcgcctcgctgctgcggcaatgatgatgcacgacgaggtgcgcattcagtggggcaaaccgttacacatagacgcgtaccttgacaggagactgcaaggctgatagagtcttttcttacaggtcatcacgaggtggcctgaataggaacgatttattcacaacgaggtaagcaatgaacatcatcgaaactatcgaaaagaatgacttctccgaaatcgaactggctgctatcccgttcaacacactggcagaccactacggtagcgcactggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgtatcgtagagtggctcgaagagtacgcatcgaagaaaggccgcaagcccgtagcctatgcaccgctccagttactcaagccggaagcctccgcgtttatcaccctgaaagttatccttgcgtcactgaccagcacgaacatgacaaccattcaggccgctgctggtatgctagggaaggccattgaggatgaggcacgtttcggtcgcatccgtgacctcgaagcgaagcacttcaagaagcacgttgaggaacagcttaacaagcgccacgggcaagtctacaagaaagcctttatgcaggtggtcgaggccgatatgattggtcgcggtctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcgcaaaacaccgcatggaaaatcaacaagaaagttcttacggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatatggttcccttacaacatggactggcgcggtcgtgtgtacgctgtgccgatgttcaacccacaaggcaacgacatgacgaaaggtctgttgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtctggcaggaataccgcaagccactccagaagcgtcttgatatgattttcttagggcaattccgtctgcaaccgacgattaataccctcaaggattcaggcattgacgcacacaagcaggagtccggcatcgcacctaactttgttcactcacaggatggtagtcacctccgcatgacagtcgtttatgctcacgagaagtatggtattgagtcctttgcgctcatccatgacagctttggtactattccggcagacgctggtaagctctttaaggctgtgcgtgaaacgatggttatcacctatgagaacaacgatgtgctggcagacttctactctcagtttgcagaccagctacacgagacccaactggacaagatgccaccgcttccgaagaaaggaaacctgaacctgcaagacattctcaagtctgactttgcctttgcataacaagcacttagcattaaccctcactaacgggagactacttaaggtctccctctttaagacactttaggtactaagagattaaatttatgattaacattaagactttctttaagaacatctttaagttaaaccgcttgacttccgttaagttctacgcttggatgcccggtagtgatgacctccgcaagaccgaatttaagttaggcttagggccgtgcggtaaggtggtcacgaagttggaatgttactcaacgtcctccgggatggtcatcttccagaccactgaggacaacgaaacgaaatcattctactacccgaagggttcaacgtgtggtcgtatcgaacggacatacagttaaccctcactaacgggagagttaaacttaaggtcatcaccggcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggctgtctcgcgtatccaagttcatcccggcgctggaacacctgaacggtttcgataagcgctggcagcaactactgaacgatgaccgctgcatcttcccggatggcttcatgctggatggcgaactgatggtcaaaggtgtagacttcaacaccgggtctggcctgctgcgtaccaagtggctcaagaagaacaacttcatgtttgaccgtggtggtgttgagccgctgaaaggttccaaagtagcctttgagttagaccccaagctactcagtgttcgcctgtatgcggtcatgccgattcacattgcggagtctggcgaggactacgatgtacagaacctgctgatgccgtatcatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgctaaggcacacggtgaagacttctacaatgggtgggcctgtcaggtcaactacatggaagagactccagatggctccctgcgtcaccctagcttcgagaagttccgaggcactgaggacaaccctcaagagaaaatgtaaccaactcactggctcaccttaacgggtgggcctttcttcgttcagcggtattaaccctcactaacaggagacacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatcaccttgtgttcacctgctgattactcgtggtgagttcgtcaaggcgatgaacaaagagcgtcctcatctggaagccgtggtcacttactggcctcgcattcgtctgttcgttaagtggattaaggaggtgctgtaatgctgcaacatcattggaacaaaccagacttagaggctcgcttcccggttaactctgtggtgcgatactccggcggtggcctcaagcgcatcttagggatgagcggagtggtaactggtcactcgcacacaggtcgcgtcaaggttcgcttcggtactcagcacgctgaggttctcccgaacaacctgattccgctaccgaaagctggcgttaagactccgaacgtggaagcaccgaagacagaagtcaagtctgatgttacccatccgaaccactacatgttgttcgacaacgtggaagccattgaggttatcgcccggtcaatgaccgtcgaggcgttccgtgggtactgcttagggaacatccttaagtatcgcctacgtgctggcaagaagtccgaactggcaactatggagaaagacctcaagaaagctgcattctatcaggaactctttgacaaacaccgggggctgtgttatgacgcttcgtgaatgttgcgattggtgtgccgctaagtggaaccaagctatcgaggatggtgacaaggcgtctgctgacgcttaccaacaactgtacgcgctgtgggagcggcgctttaaggaggccaataaatgagccaatgtaacaacgggtgcaagtatgcgaaggacgtagggatggagaaccactcctgcgcaaatcgctgcatgtactcagaacagaaataccttctgacaatggaaggtaacaccgagtcctttgagattccggtattcgcccggtctcttgaagaggcaacgctacaggctgaacattacgaggacgcagggttcgtagttactcgaatccgtccagaagtgaaagcctaattaccctcactaaagggaacaacccaaactatcaaccaaaggagaaatactatggctggtttcaagaagaaaatctacacatctggtcttggcactgctgagccttatgcttacctgagtaagccggattatggcaacgaagagcgtggcttcggcaaccctcgcggtatctataaggtagacctgactctttccaataaagacccgcgctgtcaggcgatggtcgatgaaatcgtgaagactcacgaagaggcttatgctgctgccgtggaagagttcgaagcta

SEQ ID NO: 144 - DNA, 38903 bp, Unknown
  source: /note="Description of Unknown: KP2-8a Bacteriophage Sequence"
ccagccctacccctagggtttaaccttcggttaaccttgagtgtagcgataactcactacggtatctactcgagtggcctataggatagcctaaagtgttgcctaaagtcaatatctaaagtggtggatggcttaatgagggcttaaagagtgtcctagtgtaccagttcaatagtacatctctatgtgtccctatctgttagcctcctaaagtaaaccctaaagccatcacctaaagccatcacctaaagagcgccgctatcttaaagacaaccagaccgatagacccactgttagcctgtagtgatgccttgtagttgcctatggtgtctatcgtcaattcaattaccctcactaaagggaataagggaataagggatacttaaaggggaattagggatttaataaaagattaaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatacacagcgtcaaccggacacaaggtgtcttctaggtgacttaagcgcaccacggcacataaagtgaaacaaaacggttgacaacatgaagtaaacacggtacgatgtaccacgaaatgacggaacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacatgaactaacatgaggtaacaccaaatgattttcactaaagagcctgctaacgtcttctatgtactggtgtcagctttccgttccaacctcgacgatgaggtgaacatgagtcgccaccgccacatggtaagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgtaatgagtgggagcaagattgcgtactggtatacaaatcacagactcacacggctggtctggtgtacgctaaaggtatcgacggttacaaggctgaacgtctgccgggtagcttccaagaagtgcctaaaggcgcaccactgcaaggctgctttacgattgacgagttcggtcgccgctggcaagtacgataagtgttaaactcaaggtcgcacgctgagtgtggcctttatgattaccactaaataaccctgagaggatatgactatgaaacaatacgccatccttattcccggctggtgctactcaatgacctgctacgggtacaacgaaagggacgctcgtgcccgattcagggatcaacaaggcttcggcaagcgtttacctaatggtacggctgtatgggaggttatgtaatgagtaagttactggcaacatccaaaatagcaggccagtgcaccgtaacactgcgtgagtattaccacgggtcaatgggaagcacctacgttgtgcggtatggtaaacaggtcacacattgggtaaacccgattttagcacaagaggattatcaagcctgtgtggtacaccaagcaacatgtgcgggctggaatgattgataacgcgctttgcaatcactggacaacaggcttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctatgcatcgcaatgtactttatgcgagactttaagcgcggtctggcaatacacaaggcaacgctgagttactttaagtggggattcatcccacggtttacggttcgtgaacgtaacggacgctttaaagccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagccaatgctggtggctcttgcggctgctatcgtgaacgatgagactcaggacggcgaactgacgcaggcagcaggaaacacgtcgctcgaagatatggactactggcagacactggctgagcgtatgcgtgatgttggatttgtacgcttgggtaacggtcactttagcgcagcatatgagcacgcactgttaccgggcaaggtcatcaaggtaggctttaagaaagaggactcaggcgcagcctatgcagccttctgccgtatgaatcagggtcgggagggtatccctacggtgtacgacattcagcgtcatgcaggctgctacacggtggtcttggactatctgacaccgcttaacgattggtgctacggtgaaagcgataagattcgccaccacttccgcgctgcaagggaaatcattgaggaggattgcttcaataccgccgaagagtacccgataagtgacgggttcattgagacctgcaaggatatccgcaagttcttcctaggcattgcatcgttcgattgtcacagcggtaacatgatgaaagaccaaatgggccgcttgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggaacctttcaggtagcacgtaaagcccgtgcaaaatggcgcagaaaggcctctaagcgtgctaaacgtgacgctaaggtactcgctaagatgcgcatggacgccaatcagaatcgcagggatgagcctagggcgcgtatggtgtggggcgataagcactggcgcaacgcttgggtgcaccacaataacctaaactttgcagaactggagcgcctcgctgctgcggcaatgatgatgcacgacgaggtgcgcattcagtggggcaaaccgttacacatagacgcgtaccttgacaggagactgcaaggctgatagagtcttttcttacaggtcatcacgaggtggcctgaataggaacgatttattcacaacgaggtaagcaatgaacatcatcgaaactatcgaaaagaatgacttctccgaaatcgaactggctgctatcccgttcaacacactggcagaccactacggtagcgcactggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgtatcgtagagtggctcgaagagtacgcatcgaagaaaggccgcaagcccgtagcctatgcaccgctccagttactcaagccggaagcctccgcgtttatcaccctgaaagttatccttgcgtcactgaccagcacgaacatgacaaccattcaggccgctgctggtatgctagggaaggccattgaggatgaggcacgtttcggtcgcatccgtgacctcgaagcgaagcacttcaagaagcacgttgaggaacagcttaacaagcgccacgggcaagtctacaagaaagcctttatgcaggtggtcgaggccgatatgattggtcgcggtctgcttggtggtgaggcgtggtctagctgggataaagaaaccacgatgcacgtagggattcgcctgattgaaatgctgattgaatccacgggtctggtggaattacagcgccacaacgcaggtaacgcaggctctgaccatgaggcactacaactggcccaagagtacgtggacgtattagcgaagcgtgcaggcgctctggcgggtatctctccgatgttccagccatgtgtcgtaccgccgaaaccttgggtagcaatcaccgggggcggctattgggctaacggtcgcagacctttggcactcgttcgcactcactctaagaagggcttgatgcgctacgaagacgtttacatgccagaagtctacaaggctgtgaacatcgcgcaaaacaccgcatggaaaatcaacaagaaagttcttacggttgtcaatgagattgttaactggaagaattgcccggtcgcagacattccatcgctggagcgccaagagttaccgcctaagccggacgacattgacaccaacgaggcagcactcaaggagtggaagaaagccgccgctggtatctaccgcttggacaaggcacgagtgtctcgccgtatcagcttagagttcatgctggagcaggccaacaagttcgcaagcaagaaagcaatatggttcccttacaacatggactggcgcggtcgtgtgtacgctgtgccgatgttcaacccacaaggcaacgacatgacgaaaggtctgttgaccctcgctaaaggcaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggcgttgcgcaccacggtctgagctacaactgctctctgccgctggcgttcgacgggtcttgctctggtatccagcacttctccgcgatgctccgcgatgaggtaggtggtcgtgcggttaacctgctgccaagcgaaaccgtgcaggacatttacggcatcgttgcacagaaagtaaacgagattctcaaacaggatgcaatcaacggcacacctaacgagatgattaccgttaccgacaaggacaccggggaaatctcagagaagctcaagctgggaacctcaacgctggcgcaacagtggctggcatatggtgtaacccgtagcgtaactaaacgttcggtcatgacgctggcttacggctccaaggagttcggctttcgtcaacaggtactggacgacaccattcagcctgcgattgacagcggtaagggcttgatgttcacccaacctaaccaagcggctggttatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgccggacggcttcccggtctggcaggaataccgcaagccactccagaagcgtcttgatatgattttcttagggcaattccgtctgcaaccgacgattaataccctcaaggattcaggcattgacgcacacaagcaggagtccggcatcgcacctaactttgttcactcacaggatggtagtcacctccgcatgacagtcgtttatgctcacgagaagtatggtattgagtcctttgcgctcatccatgacagctttggtactattccggcagacgctggtaagctctttaaggctgtgcgtgaaacgatggttatcacctatgagaacaacgatgtgctggcagacttctactctcagtttgcagaccagctacacgagacccaactggacaagatgccaccgcttccgaagaaaggaaacctgaacctgcaagacattctcaagtctgactttgcctttgcataacaagcacttagcattaaccctcactaacgggagactacttaaggtctccctctttaagacactttaggtactaagagattaaatttatgattaacattaagactttctttaagaacatctttaagttaaaccgcttgacttccgttaagttctacgcttggatgcccggtagtgatgacctccgcaagaccgaatttaagttaggcttagggccgtgcggtaaggtggtcacgaagttggaatgttactcaacgtcctccgggatggtcatcttccagaccactgaggacaacgaaacgaaatcattctactacccgaagggttcaacgtgtggtcgtatcgaacggacatacagttaaccctcactaacgggagagttaaacttaaggtcatcaccggcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagtcattcagctatgaaaacccagcgaagatgtgcaggtcatccggtgaggttctccgcgtgttcacacgctcagggcatccggtggcatccagaaccttcgagcatagcgacagcgatgtacaaatcaacgcgcagactgcatggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgcaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgccaagtttggtacggtcagtgtcgaagaggcaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctgattgctgacattaagtacgatggtgtgcgcggtaacattgtggttgacaacgtggctgaggccgcatggctgtctcgcgtatccaagttcatcccggcgctggaacacctgaacggtttcgataagcgctggcagcaactactgaacgatgaccgctgcatcttcccggatggcttcatgctggatggcgaactgatggtcaaaggtgtagacttcaacaccgggtctggcctgctgcgtaccaagtggctcaagaagaacaacttcatgtttgaccgtggtggtgttgagccgctgaaaggttccaaagtagcctttgagttagaccccaagctactcagtgttcgcctgtatgcggtcatgccgattcacattgcggagtctggcgaggactacgatgtacagaacctgctgatgccgtatcatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaggcacacggtgaagacttctacaatgggtgggcctgtcaggtcaactacatggaagagactccagatggctccctgcgtcaccctagcttcgagaagttccgaggcactgaggacaaccctcaagagaaaatgtaaccaactcactggctcaccttaacgggtgggcctttcttcgttcagcggtattaaccctcactaacaggagacacacacaccatgtggcttatcctattcgctatcgtcgcaacgctgggattaatggctgccgacgacaacatttggcctgattgttaaggagataacatcatgcgtttacatttcaacaaatccaacggtatcttttcggttcgccgtaaagaccgctcgaccgtattggcctctgagcgcaacgccaagctgccgctgattggttcggtcgccacgctatcaccttgtgttcacctgctgattactcgtggtgagttcgtcaaggcgatgaacaaagagcgtcctcatctggaagccgtggtcacttactggcctcgcattcgtctgttcgttaagtggattaaggaggtgctgtaatgctgcaacatcattggaacaaaccagacttagaggctcgcttcccggttaactctgtggtgcgatactccggcggtggcctcaagcgcatcttagggatgagcggagtggtaactggtcactcgcacacaggtcgcgtcaaggttcgcttcggtactcagcacgctgaggttctcccgaacaacctgattccgctaccgaaagctggcgttaagactccgaacgtggaagcaccgaagacagaagtcaagtctgatgttacccatccgaaccactacatgttgttcgacaacgtggaagccattgaggttatcgcccggtcaatgaccgtcgaggcgttccgtgggtactgcttagggaacatccttaagtatcgcctacgtgctggcaagaagtccgaactggcaactatggagaaagacctcaagaaagctgcattctatcaggaactctttgacaaacaccgggggctgtgttatgacgcttcgtgaatgttgcgattggtgtgccgctaagtggaaccaagctatcgaggatggtgacaaggcgtctgctgacgcttaccaacaactgtacgcgctgtgggagcggcgctttaaggaggccaataaatgagccaatgtaacaacgggtgcaagtatgcgaaggacgtagggatggagaaccactcctgcgcaaatcgctgcatgtactcagaacagaaataccttctgacaatggaaggtaacaccgagtcctttgagattccggtattcgcccggtctcttgaagaggcaacgctacaggctgaacattacgaggacgcagggttcgtagttactcgaatccgtccagaagtgaaagcctaattaccctcactaaagggaacaacccaaactatcaaccaaaggagaaatactatggctggtttcaagaagaaaatctacacatctggtcttggcactgctgagccttatgcttacctgagtaagccggattatggcaacgaagagcgtggcttcggcaaccctcgcggtatctataaggtagacctgactctttccaataaagacccgcgctgtcaggcgatggtcgatgaaatcgtgaagactcacgaagaggcttatgctgctgccgtggaagagttcgaagctaacccgccgcaggtacagcgtggtaagaaaccactgaaaccttacgagggcgacatgccgttcttcgataacggtgacggtacgactaccttcaagttcaaatgctatgcgtctttccaagataagaagaccaaagagaccaaacacatcaatctggtcgtggtcgatagcaagggcaagaagattcaggacgttccgattatcggtggaggctccaagctgaaagtgaaatactctctggtgccttacaagtggaacacagctgtgggtgcaagcgttaagctgcaactggagtccgtgatgctggtcgaactggctaccttcggtggtggcggtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggagcattccgttccggcctagaagataaagtctcaaagcagcttgagagtaagggaattaagttcgactatgaactttggcgtatcccttacgtcatccctgcgagtgaccacttatacactccagacttcctgctacctaacggtatcttcattgagaccaaagggctgtgggattccgatgaccgcaagaaacaccttttgattcgtgagcaacaccccgaactggacatacgcttggtcttctcaagcagccgctcaaagctctacaagggtagcccaacaagctacggtgagtggtgcgagaagcatggcattctgtttgctgacaagctgataccggtggcgtggctcaaagaacccaagaaggaggttccgttcgataaatttcagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggatggttagacgtaggttatcacttcatcatcaagcgtgatggtactgtggaagcaggccgcgatgaactggctgtaggttcccacgttaaaggttacaaccacaactccgtaggcgtatgcctcgtgggtgggattgatgataaaggcaagttcgacgccaactttacacctgcgcaaatgcaagcgctgcgtagtctgctggtcacgctgctggcgaagtatgagggttcagtccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgcgtaccgtcacgtcagtgtcagtgcaaagacccaatcaaggctgaggaacacaccgaggaataattaacactcactaaagggatagtcgaaaggccgtccctttgttctcgaaggaggctaaaatatgaacaaaccatacaagcagttctatcaggctccgcgaagacacattcaagtgtgggtagcagctaatgggcctatcccggaagggtattacatagaccacattgacggcaatcctcttaacgatgacctgtccaatctccgtctcgctcttccgaaggagaactcccggaacgccaaaacatccaaagcaaacaagtccggcctcaagggtctctcatggagggacgataggcagtcgtggcgtggtgctgtgatggcagacggtaagcaatacacaaccaccagcaaggacttacttgaggtagtagcgtggatttacagaactaggagagaacttcatggacaattcgctagattcagatagcatatttctctatcacatcccatgcgaaaactgtgggagcagtgatgcaaactcgctgttctccgatggtcatacttattgttacgcctgcgagaactggacgcccggtgacggtgagagacctgagcgggaacgtagacaatcaaatgggagaaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgcggattaccgtgaccagaatggttccatcgtgtcacagaaggtgcgcgataaggacaagaactttaagaccactggaagtcacaagagcgatgcgttattcttgaagcacctctggtctggcggtaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttaccgtgtaaggacgccaacgagtgtcacatcatgggtgaagacaaagcaatcttggagcagatctggaacgcgaacccttgggtgcctgatggtgttgtctctgcgttgtcactcaaagaccgcgttaaggaagctatgacctccgaggacgctgtgggtctgctgttcgatggctgtcaaggcctgaacgatagaaccttgggtgcccgtggaggcgaagtcattatggtcacttccggttccggtatgggtaagtcaacgttcgttcgtcaacaggcgctggcttggggcaagcgaatgggtaaacgtgttggcctagcgatgctggaggaatccgttgaggataccattcaggatatgatgggtctgaacaataaggttcgtctgcgtcagtctgatgaagtcaagaaggctatagcagaggacggacgtttcgatgaatggtatgacgaactatttggagacgatacgttccacctttatgactcctttgcggaggccgaagctgacagactgttagcgaagctggcctacatgcgaacaggcttagggtgtgatgttatagtgctcgaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaagggaaaaccacatgaagaaggacgcgctgtttctattactgacctacgtggtagcggtgcgctgcgtcagttatctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacaagacggacaatcagacttctaaataccagtgccactgcggtcatccagactgtgatggcggaatgtataattgattaaccctcactaacgggaacaacctcaaaccataggagacacaccatgtttaaattcattaacgctttaggtaagctggtagttaaactgtacttcgtcgaagccaagaagctggacaagaaggccaaagctgattcacagcgagccattgagttggcgaaacagtcccgtgagaaatccgatgcggctgttagtggcatccacaagtcggcagcgattgcagccaaagcacaatccatgagcaaattctttgagtaaggagcacaccatgagcaagtcaatcactcacgcaaacaccatccgtctgccggacaccgctgaccagttcgctcgtcgagtacatattaatgtgcgcggtgagaaggtaacgatggtctaccgctggaaagaccacaagtctccgaaagcacacactcaacgcatgaccttgactgacaagcaggtaggccgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttatcctgaaatgaaaggagggcattatgctcgtaagtgacattgaggccaacaacctcttagagaaagtcaccaagtttcactgtggcgttatctatgactaccgcgatggtgagtatcatagttatcgtccgggcgacttcggggcgtatctggatgcgctggaagccgaggtgaagcgaggtgggcttattgttttccataacggtcacaagtatgacgttccggctttagagaaactagcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgccctggaggcatggggttatcgcttgggcgagatgaaaggtgaatataaggacgacttcaaggctatgctagaagagcagggcgaagaatatgttgatggtgctgagtgggtttcgttcaacgagccgatgatggcttataacgttcaagacgttgtggtcactgtcaagctcttagagaaattccttacagacctccactacttccctgcgggtatggacttcacgaagtacgatgcggatttattctggcgagaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacggacaggcaagccgctgccgagttatcctcgcgtggtctatccgaaacagggtggcgtgtacaagaagcctcgtaataaggcacagcgcgaaggtcttgaaccttgcgacttggacacgagggattacatggaaggtgctccatatactccggtcgagttcgttacgttcaagccaagtagccgtgaccacattcagaagaaactacaggaggccggatgggttcctgagaagttcaccgagaagggtgcgcctgtggtggacgatgaggtcttggagcatgtacgagtggatgaccctgagaagcaggcgtgcattgacttgattaaagagtacctgatgattcagaagcgaatcggtcaggcggcagaaggtgacaaggcgtggttacgttatgttcaagatgatggtaagattcacggagccgttaaccctaacggtgcagttactggtcgtgctactcatagtttcccaaaccttgcacagatacccggtgttcgttctccttacggggagcagtgtcgtagtgcttttggtgctgaacatcatttggatgggattactggcaagccgtgggtgcaagcggggatagacgccagtggcttagagttgcgctgtctggcacacttcatggctcgcttcgacaacggagagtatgcgaatgagattctcaacggtgacattcacaccaagaaccagaacgctgcggaactcccgacacgcgacaacgccaagactttcatttacgggttcctttacggagcaggagatgagaagattggtcagattgttggggcagggaaggagcgcgggaaggaactcaagaagaaattcttagagaacaccccggcgattgcagcattgcgagaagctatccaacagtctctcgttaagtcttccgcttggattggcggtgagcagaaagtccagtggaaacgccgttggattaaaggtctggatggtcgcaaggttcacgtcaggtctccacatgcagcgctcaacacattgttgcagtctgctggtgctctgatttgtaagctgtggattattaagaccgaagagatgctcattgagaaaggcttgaagcatggctgggatggtgactttgcgtacatggcttgggttcacgatgagattcaggtggcctgccgtaccgagcacatcgctcagattgttattgacaccgcgcaggaagctatgcgttgggtcggagagcattgggctttccgttgtcgtttagataccgaaggtaagatggggccaaattgggccgtctgccactaacagtaggagaaacattatggcaatgaccaaacactttaaagtaaccttcgacgttactgctgtgattgacagtgaatccgagaagaatctgaacgagttgctggtagacctagctaagaaggccgggtctggcgagaagctgaatccgttcaaacaagaactgcttattcaaggtctgacacacgggccggaaggtgcggctgcgttctgcatcaagcaaggtctccgtgagtttatccgcgatggtcacagtgagttaagctctaccgagcagaagcggatgaaattctcacctgcaactgtgcgggaggtgttcaaatgagtgaatacctgaaagtgcttgcagctatcaagggttgccctaagtcctttcagtcgaactatgtgcgaaacaatgcggctctcgtagctgaggccgcgtctcgtggacacattagctgtttgactgttggtggtcgtaatggtggagcgtgggaggtcacatccgctggtgtgcgcttcctgaaacgaatgggaggttgtgtatgattatgccaaagagtgacaccgtaacgatgactcgtgatgcgtggaatgatgttagcgcgtacattgataagctggagaaagacctagagttcctgaatgctcttaaggcgtgtggtgtggataattgggacggatactctgatgcaatcgagatggtttacggggaggaagacctatgagtttgattaccctcaaagacttcgctgagatgcgtgaaggtaaaccgatggagaagggcgtgctggtcatggatggtgactggctggtgtatcagtcgatggctgctgccgaagttgagacggattggggcgatgacatttggactctggagtgtgaccacgctaaggcgcggagcattctggattctgcaatcgaatcgtaccgaacccgtaagaaagcatggcgtgacgctacggttgtgctggcgtttaccgacgatgtgaactggcgcaaggaacttgtagacccgacttacaaggagaaccgcaaggcgacccgtaaacctgtgggctaccgtgacttccttcaagctctgtgggagcgcgatgagttcattcacatcaaagaggacatgcttgaaggtgatgacgttatgggcatcattgggtctggtcacgaggtcttcggcttcaagaaggctgtgttggtctcctgtgataaggacttcaagactatcccggacgttgacttcctgtggtgtaccactggtaacatcttgacgcagaccaaagagaccgctgattggtggcatctcttccagaccatcaagggtgatatgactgatggctactccgggattcccggctggggcgatacggcagaaggtttcctgaatgacccgttcattgtggagcctgtagagtccgtgttgaagtccggtaagaacaaggggcagacagtaaccaagtgggtgaagcgtgctcctgatgcgactgagacgttgtgggactgcattaaatccattggtgccaaagctgggatgaccgagcaggaaatcatcaagcagggccagatggctcgcattcttcgcttcgaggaatacaattacattgacaaggagatttacctatggacgccgcgaagctgattaccgtcgctgtgctggtaggtatgctggcgcgaggtctctggatgctcgctctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctggatactctgagtctttcattgctggtgtgatgcatggtctgtaccttgcctctcgaacacttgatgagattgaggtgcgtaaagagcaactgagacaggagtaattatatgtgctggaaaccgaaggtgaaagtccccaagatggacactaaccagattcgcgctgctgaaccagcacctttgactgagccacctaaatctgtggtatggggaggcgatgatgatgaggacaccagcgtgtcttcctctgaggttccaaccacacagagcagcggtaagagcagtcttaaggtaaagctggatgacaacgcagccaagaacaagagtaaatcctccattcgctccaaggcgtttgggtaactgtgacataacataggggacacattatgggattcctcaagaaaatcaagaaagccgttaagaaagttgtgaaggaagttagcagaccagtcgagaaggcaggtaaggaagtcggtaaagccgttggcggtgcgctgggtgcaggtaagcaggagattatccaacaagaggctccagtaccagtagtgactgcgccacctccagcacagattgtagatgtacctgaacaggataaggctgagggtgaggatggggcacaaaccgagagcgcacgtaagaaggcccgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacatatccgactgacgctatgccctacattccggttcgcatggttcgcattgatggcgagtcttatggtcgctcctactgtgaagaatacttaggtgacttaaggtcgcttgagaatctccaagaggctatcgttaagatgagcatgattagtgctaaggtcatcggtctggtcaaccccgctggtattacacaaccgcgtcgattaaccaaggctcagactggcgacttcgttccgggtcgtcgagaagatattgacttcctgcaactggagaagcaagctgactttaccgtagcgaaagctgtgagtgaccagatagaagcacgcttatcgtatgcctttatgttgaactctgcggtacaacgcactggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcggtcgtggtcaagacctcgataagctggagcgctgtatctccgcttgggctgctctggcccctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgctgccgccgctggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgcttagtctcgatgttgctgcccgtgacggcgatgatgcaatcgtacttagcgaggaaccgagttcccataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaagccgatgagtttgagccgctgggtgacactccagaagaactgagccaagttactgaacaattaggacagcacgaagaaggctttcaggcgatggtcgagcaggccgttgagcgtggactgagcgcagagtctgtgactcgcatctacgaagagtacgaagccgatggcatctctgagaaatcctacgcggaactcgaagctgctggctatagtcgtgcctttgtggactcctacatctccggtcaggaagcccttgtagaccagtacgtcaatcaggtagttgcctttgctggtggtaaggagcgctttagcgcaatccatacgcaccttgaagcaacaaacccggctgcggctgagtcccttgagactgccatgatgaaccgagacttggcgactgtcaaagcaattatcaatctggctggtgagagttacacgaagaaattcggtaagcctgccaaccgtagtgttaccaagcgtgctactccggttaaaccagtagctcgtcagaaagagggctttacgaatcaggctgagatgattaaagctatgagcgacccgcgctatcgtagcgattctgcctaccgccaaatggtagaacagaaggttatcgactccagtttctaattaaccctcactaaagggagagaccatagatgactacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgctgagtacaccgcacagttgggtgaatctctggcgatggcggctgacggtgccgtactggctgaactggctggtctggttaacctgcctgacgcctccaatgagaacatcgagggtctcggtaagcctaccgtactgactctggttaagccgacctctggcgacctgactgacccggttgagctgggtaaagcgattatcgctcagttgaccgttgctcgtgcggctctgaccaagaattacgttccggctgctgaccgtaccttctacaccactcctgataactactctgcgattctggctgccctgatgccgaacgctgcaaactatcaggcattgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgtgggcctgttccagcaccgctctgcggttggtacggtcaaactgaaagacttggctctggagcgcgctcgtcgtgcgaactatcaggctgaccagattatcgctaagtacgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtatagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcaggagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggcatgataccgtttagctctgactatctgtccgtaatggcaacaagcggtcagacccaatatatcaaccgtggtggctatctctatgaccgctctgcgaagaccgacagattcccttctggtgtgcaggtaaacctgattcgtctgagagagttcgatgagatgcctgagtgcttccgaaactatatcgtcaccaaggcttcccgccagtttaacaaccgcttcttcggtgcgccggaggtagacggagtgttgcaggaagaggaacaggaagcgtggcgtgcgtgcttcgagtacgaactagactacggcaactacaacatgctggatggtgacgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgtggtgttcactggtgaagacattaaggtgttcgacctcgatggtaaggagtaccaagtacgtggagaccgctcatatgttcgtacagctaacccacgagaagaccttaggatggtaactgtggctgattatacctttgtgactaaccgcaaggtggttgtgcagagtaacgaccaatcggtcaaccttccgggctttaaagaccaaggcgatgcactgattaatgttcgtggcggacaatatgggcgtagattatcaatcgagttcaacggggttgagcgtgctgctgtgcaactaccagatggttcacaaccagcacacgttaacgaggtggatggtcaggctatcgctgagaagctggcggtgcagttgcggaataacctagggaacccaaacaatgagcaagacccaaataagtggcggttcaatgttggccccggattcatccatatccttgcgcctaataacgataacgtttggggactacagactaaggatggttacgcagaccagctaatcaaccctgtaacccattacactcagtcgttccagaagttgccgattaatgctccagatgggtacatcgtgaagattgttggtgatacctcaaagactgccgaccagtattacgttaggttcgacctcaaccgtaaggtatgggtagaaacaattggctggaacacaaggactcacctacattaccacacgatgccttgggcgctggtacgtgcttctgatgggaactttgacttcaagtaccttgagtggggtgctcgtactgtgggggacgatacaaccaacccatacccatcctttaccggacagacaatcaatgatattttcttcttccgtaaccgtttaggattccttagtggggagaacatcatcttgtctcgcacctcgaaatacttcaacttcttcccggcctccgtgtcaaactactccgacgatgacccaatcgacgttgctgttagccacaaccgggtgtcaaccttgaagtatgccgttccgttctccgaagagttgctcctgtggtctgaccaagcgcagttcgttctgacagcctctggtatcctttcgagtcgctccgtagagttgaaccttacgactcagttcgacgtacaagacagggcacgcccacatggtgtaggacgtaatgtatactttgcgtcacctcgcgcttccttcacatccattaaccgatactatgcggtacaggatgtaagctctgtgaagaacgcagaggacatgacggctcacgttccgaactacatacctaatggggtatttagtatctcaggcacaactgctgagaacttcgtggctatccttacgagcggtgcgccgaaccgagtgtatatctataagttcctctacattgacgaggaaatcaggcagcagtcatggtctcattgggactttggggacaacgttacggtgtttgcagcacatgtgataaactcaacaatgactgtattgatgggcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcaacgatttatgggatgaacttcaccaagggtatggtttcggtggtctttcctgatgggaagattgtagagatagacccgccaatcaacgggtggagtagcgacccaatattgagactcgatggaaaccaagagggccaagtggtttacattgggttcaacatcccgttcacttatacgttctcgaagttcctcattaagaagactgctgaggatggctcgacggctaccgaggatattggtcgcttacagcttcggcgtgcgtgggtaaactatgaggattctggcgcgttcaccatccgtgtgaacaacctgtcccgtgagttcatctacacaatggctggcgctcgcttgggttctgacaatctgcgtgttggcaggtcgaacattggcacagggcagtaccgcttcccggttgttggaaacgctcagacgaacatagtaaccatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggtaatcagggagaccgagtgtggttccttacctctaagtacgtcccactgtttaccttgaaggagcgcttagagtttcgtagacttatcattgaatatcgtgatatgatgctgagccagtatgagtccatttggaatttcgtttgggtaggcaataagtcacacattcgtttcctaaagaccataggtgcggtattccataatgagtttaccgctgatggtcaatttcaattattcactatcagtaggaggtaactatgtgctggatggcagcgattcctatcgccatgatgggtgcccaagctctgagtagccagaacagtgctgacaaggcacgagtggcacagacagaagctggacgccgacaggcaatggagatggtcaaagagacgaatatccagaatgccaacgcctcattggaacaacgagacgcccttgaagctgcatcctctgagttgactacacgtaacatgcagaaggtacaggctatgggaacaatccgtgcagctatcggcgagagtatgctagaaggcgaatcaatgaagcgcatcaagcgtatcgaagagggcaactacattcgggaggcaaatagtgtcaccgagaattaccgccgagactacgctagtatctttgcgcaacagttgggacgcactcagtccacagcaagtcaagtcgatgcaatgtacaagagcgaggccaaaggtaagtccggcctgatgcgtgtactagaccctctgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgaacaaccaagagcgagtcttctggactccattggtcgattcgctaaggctggtgccgatatgtacatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagaccgggcgtaacgctgcgttcctcgttgacgatgaggttcaacaggccatcaaagagggtcgcttccgtactcgtgaagagatggagcagtatcgtcactcacgcctacaggagcactcgaagtcgttcgctgagcagttcggcatcaatgagatggacgaggaatacctgaagggtttcaacgcgaatatcaccgagcgtaacattgctctgtatggggcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgaccgacaatcaggctcaacaggttatctcttcgtccctgaatgacgtgctacagcgtccgggtggtgccgccttcttgcagaacattgagaaccgcaaggtaactctaaatggcgctacgactacctatcgtgaactgatgggtgatgaacagtggcaggccatgatgattaaggcacagcacactcaattccagaacaacgcgaagttaacagagaagttccgactggatattaactcagcgcttaaccaagcggacactggtaaaggttgggagactcttcaaggtatcaaggccgaactcgataagattcagccgggtgaagagatgactcctgagcgtgagtggttgatttccgcacaggaacagatgcgcacccgcttcaagcaggaacaagctgagacagccaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagtgatatggtcaactacgcgaaccagaagttagcggaaatcgaggcgatggacttaacgcctgaacagaaagacaaactgaaattggactacctacgggcagactccaaggagggtgctttccgtgcagcgtttggtgagatgattactgatgctggaaacgaatggcaggctgcggtgattaacggcaagatgcctgagagcacaccagcgatggacaaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggccgctatgatgaacgattcaacgaatcctcaaatcaagtacatgccttcgagtgtccaagggtatgccaggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactccagcgtgagtaccagcgtaccgcacagatgcaagctgaggcagcacgagagaaagccctcaaagaggccaacaagcgtgccccaataagccgtgcaacacaggcgcgtgaagaagcgcgtaaacgtgtccaagataaacggaagaagactccgaagtatatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaacaggcccgaagggtctcatgcagttcaccaaaggtacagccactgcgcttggcctcaaggttactgacgctgatgacgatgaccgttacaaccctgagttggctgtggatgcagccgctcgtcacctgagtgacctcattcggaagtacgatggggatgaactcaaagctgccttggcgtataatcagggcgaggggcgcaacggtgctccacagatacaggcttatgacaaaggcgattgggcttcaatctctgaggaaggtcgtgactacatgcgtaacctgatggatgtagccaacagtcctcgcaagggggacttggaggcgttcggcggtatcaccccaaaggctaagggcattccatcgggggatgcatttgctggaatcgggaagaagcagacggtaggcactgacctgccggagtccactggattcaaagtggagggtaaagagcagcaagcgcctaacgtgccttatgctaaggacttttgggaaaagactggaacaacactggacgagtttaattctcgttcaaccttcttcggaatcggagatgccacaagtgcagaacttcacaactccgtattgggtgtggcttttcgtgccgctcgtagtgatgacggttttgatttattcaaggacaccattacgccgactcgctggaacagccatacgtggactccagaagagttagagcgtatccgtaaggaggtgaagaacccatcgtacatcaatgtagtcactggaggctctcctgagaatctggacgccctcattaagatggcgaatgacaactacgagatggacgcgcggtctgccgatgcgggtgttggtgccaaacttactgctggtatcgtcggtgctggtgtagacccgctgagttacgtgccgctagtgggtgtagccgggaagggtctcaaggtggctaacaaggctttcattgtcggtactcaaagtgctggcctagctgttgcctctgagggtatccgcacatcaatagctggtggtgaagcacactacgctgatgctgctttaggtggtctcatgttcggtgccggtatgagtgcaatcagtgacgctatcgctgctggtattcgccgttcccgtgggactgaggtcgttaatgacttcgctcctatggcacaccgcttggaagcccgcgagaccgctctgaactctggtggcgaagacctgacccgtatgcctagcgataaccatgtgttcgaccgtgagcacgctggcgttgagtattcacctctggagaccgagccgggtgcagttgtgttgcctcaaggtcaaatcctgagcgacaccaacccactcaaccctcagactcttagcgagttcgaggcggtcaaccctgagcgtgccgctcgtggtatctctttgggtggtttcactgagattggcttgaagactctccgctctgagaacccgactgttcgctccattgcgagtgaccttgtgcgctctccgactggtatggagtccgggacttctggtaagttcggtgcgacagcttctgacattaaggagcgactccacgcgaacaaccagcgcacctacaatcagctttatgatgctgtgcgtactgcaatgaaagaccctgagttctccaccggtggttccaagatgagccgtaaggaaatccgacaggaaatctacaagcgtgcagccttagcgattgagcggcctgagcttcaagcaaatctgacaaagggtgagcggaatgtgatgaacatcctcaagcagcactttgacctcaaacgcgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaacaacaacttcttggaagcccgtaacatgttcgacagtgacatggcggtgactctccctgatggtaacacgttctctgtgaacgacctgcgtacatatgacatggctgaaattctgcctgcatacgaccgacgagtagatggtgatgttgcaatcatgggtggttccggtaagactaccaaagacctgaaagatgaaatcatggcgctggataagcagtcagagggcaacggcacactgaaaggtgaagtggaagccctcaaggataccgtgaagattctaactggtcgtgctcgaaggaacccggaaggcgcttggggcacagccctacgctccgtcaatgaccttacgttcttcgctaagaacgcctacatgggtgcgcagaacatcactgaaatcgctggtatgctggctaaaggtaacgtctctgcgataactcatggcatccctatgattaacgattgggtcaaccgtggtaaaccgcttcgtgcctctgagattaaggagctacacgggatggtgttcggtaaggaactcgaccaactaatccgtccgggacgtgaagaccacgtgcgccgactccgggagtctacggacaccagcgctgcggttgccaatgtggtcggtacgattcgtttcggtactcaagagttggctgcacgctccccttggacaatgctcctaaacggaacatcaaactacattcttgatgctgcccgtcagggtgtgcttggggatgtggctggagcggcccttgctgggaaagcctctaagttcggtaaggcaaactaccttaagtctgcctctatcagccctgagcagtggaatggaatcaagcagttgttcagagactatgcgactcgtggggaagacggtaagttcaccattcgtgacaaacaggctttcgctaacgacccacgctcaatggacttgtggcgtctggctgacaaggtggctgatgagactatactgcgccctcacaaggtttcctcacaggacgccaaagcgttcggtgctggggtcaagatggtgatgcagtttaagaacttcgtcattaagtcactgaactcccggttcgtccgcagcttctatgaggccacgaagaacaaccgagcgttagaccaagcgctgacccacatcgtctctttgggtctagctggtggttactacgttgcgcaggcgcaccttaaggcctcaagtctacaggagcacaaacgtaaggagtaccttaagaacgcccttgaccctaagatgattgctcatgcgtcaatctctcgtagttcacacttaggctcaccattgagtatctacgacatgttcgctgggatggttggtagcgatacctataagtacacacgctctactgtactacctaaagagtccgagaagcgcgaccctaccaaggcagtgacaggtagacaggtggcttcaactatcgcaggtgcagttggtgagcaggttccgggtttaggttttgtgggttctgtgggcgcaacagcaattaacgccgcttccctgctatcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcgactaagaccacaatctccacaacgagagcgttggggccagcggacggttataacatgattgaaatccgtcgattcacctccgctaccgataggctggttgactttacggatggctcaatcctacgtgcgtatgacctgaacatctcgcaggtacagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtctgcgctgaactctgcgaaggctgctgctgcatctcaacaggccgctgctgcatctcaacaggccgctaagtcctcagagaacaactcgaaggtatctgaggacaacgcaaagacctccgagaacaacgcgcatcaatgggcgcagcgtacagaggactctccggttcagggtagcgagttctctgcgtatcactactcacggaaggcctccaagagtgccgccgccgcaagtacgtctgaggggaatgcaaagacctctgagaccaacgctaagacctctgagaccaacgctaagacctctgagactaacgctgcatcgagtgctgctaaggcttctgaggaggctgctaagctgactaacatgaatgactttgctgcttctattgattcagtcaacggtaacaatgttgtcatgaagggtgacttaaccattaaaggaaacggtaaagtatcaatactgaaccacagtgggctataccaagataagaccgtgaatggcgtgaactatgccaacaggatttatatggatgatgctgggggcatgcactttgagaactaccgtgtgtctggtacttcagtcaccttacgtgctggttttgttattacagataccaacaggtttgactttacagggccaacgcgagttaagggtgatatcaccgcatatgtggatgcgccacctaatccagccatcggtcaatacctcaattctgtggcagttcgctcacagcttcggggccgtggtgctaagaatgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattaccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagaggacggcacaacataaggagaacaagaatgttatcttttgacttcaataacgaggtcgttaaggctgcgcctattgttggcacaggggtcgctgatggggcggcccgactcttttggggactatcgttaaacgagtggttctacgttgcagctatcgcctacacagtggttcagattggtgccaaggtagtcgataagatgattgactggaaacgtgcaaataaggagtaacccatgagcgacaagactttaatcaagctgctggagatgctggacacggagatggcacagcgtatgcttgctgacctccagagcgaggagcgccgaacgccgcagctttacaacgcaatcggcaaactgttagaccgccataagttccaaatcagtaagctgaccccggatgagaacatccttggtggtctcgcggctggtctggaagactacaacaaagtggtcggccctaatggtctgactgacgatgagactatcacgctacagtaagtgacatactcaaggttctccacgtggggagcctttatggatgttatttggtgcatctacgtgaagtctaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgagggcagcactgataggatgcttaatgacctgcgtagtaataataagcggctgtcagtccgcatcaagacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagatagatatggcccggtgtctggctaacggagacaacaagaagtttatcctacaggctttccgtggtattggtaagtcattcatcacctgtgcgttcgttgtgtggacgttatggcgtgaccctcagttgaagatactaattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggcacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctccgggagcgtgagttggaatatggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagcttcctaacgtgggccttaagggtgatgatattcatagctatcattcgtgcagccagaacactggacagtaccagcaacgcatcctcgtgattgacccaagtggtcgcggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggcccgtgagaagggcgctgtggcccatgacgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttacctctatggttgacggtatggaactctattgggaggatgacgatgtgaatagcaacaggttcattgactggtagttatgcatattgagtgcataaggaatcattgagaccacggatggtcactttaagaaattccttaagaatcaatgagtttgaattaaccctcactaaagggagagaggggacttaaagctactatataggttagtcattcaggttatgcaatgaccctttatgcactttaagtctcctctatgattggtgatattatcattgtataatcaccctaccttagagcaactgaaaggaggtggctcaatgttacgcttgctgattgccctgctgcgtcatagagtcacttggcgatttcttctggtacttactgctgcccttgggtacgcaggtcttaatgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcctaaagagaccctttaagaatttactacaaaaatctgaatgggtatctcacagttcaagaacccaaagtaccccccatagccctcttaaagccacctaaag

SEQ ID NO: 145 - DNA, 38961 bp, Unknown
  source: /note="Description of Unknown: KP2-8c Bacteriophage Sequence"
gctgttgcttgtggcgtttcttcatgcggtcacggcgctcttgccactgttcgccatgctcgttgaccactgaatcgcgcttggtaaatttctcaaagttggtacgcatagtatcttacctcatgttgatgtgtattgaaagttaatcacaaaggccaccgttgttgatgaccttaagtttaactctcccgttagtgagggttaactgtatgtccgttcgatacgaccacacgttgaacctttcgggtagtagaaggatttcgtttcgttgtcctcagtggtctggaagatgaccatcccggaggacgttgagtaacattccaacttcgtgaccaccttgccgcacggccctaagcctaacttaaattcagtcttgcggaggtcatcactaccgggcatccaagcgtagaacttaacggaagtcaagcggtttagcttaaagatgttcttaaagaaagtcttaatgttaatcataaatttaatctcttagtacctaaagtgtcttaaagtgggagaccttaagtagtctcccgttagtgagggttaatgctaagtgcttgttatgcaaaggcaaagtcagacttgagaatgtcttgcaggttcaggttccctttcttcggaagcgggggcatcttgtccagttgggtctcgtgcaattggtctgcaaactggtcatagaagtctgccagcacatcgttgttctcgtaggtgagaaccatcgtttcacgcacagccttaaagagcttaccagcgtctgccggaatagtcccaaagctgtcatggatgagcgcaaaggactcaatgccatacttctcgtgagcataaactactgtcatgcggaggtggctaccgtcctgtgagtgaacaaagttaggcgcgatgccagactcctgcttgtgtgcgtcaatgcctgaatccttgagggtattaatcgtcggttgcagacggaattgccctaagaaaatcatatcgagacgcttctggagtggcttgcggtattcctgccagaccgggaagccgtccggcgtagtccagtgaaccgcacaacggtggcgcagaatctccttggtcttcttgtccttgacctcagcagccagcagcttagcggcagacttgagccagttcatcgcctcaaccgctgcgactacggtcacgctcaccgcgtcccaaatcagcttagccatataaccagccgcttggttaggttgggtgaacatcaagcccttaccgctgtcaatcgcaggctgaatggtgtcgtccagtacctgttgacgaaagccgaactccttggagccgtaagccagcgtcatgaccgaacgtttagttacgctacgggttacaccatatgccagccactgttgcgccagcgttgaggttcccagcttgagcttctctgagatttccccggtgtccttgtcggtaacggtaatcatctcgttaggtgtgccgttgattgcatcctgtttgagaatctcgtttactttctgtgcaacgatgccgtaaatgtcctgcacggtttcgcttggcagcaggttaaccgcacgaccacctacctcatcgcggagcatcgcggagaagtgctggataccagagcaagacccgtcgaacgccagcggcagagagcagttgtagctcagaccgtggtgcgcaacgcctgcatactcgaagcagaacgcgaggaaacagaaaggtgaatcctgctcggcccaccaagtgttattgattgggtctttagcgcaagccagaatgtcgtctacgtgcttctcaatgaacgcgatgcgctcagggaaaggaaccttatcgacacccgcacagttcgcaccgtggattttcagccagtagaaaccttcctcaccgattggcttgcctttagcgagggtcagcagacctttcgtcatgtcgttgccttgagggttgaacatcggcacagcgtacacacgaccgcgccagtccatgttgtaagggaaccagattgctttcttgcttgcgaacttgttggcctgctccagcatgaactctaagctgatacggcgagacactcgtgccttgtccaagcggtagataccagcggcggctttcttccactccttgagtgctgcctcgttggtgtcaatgtcgtccggcttaggcggtaactcttggcgctccagcgctggaatgtctgcgaccgggcaattcttccagttaacaatctcattgacaaccgcaagaactttcttgttgattttccatgcggtgttctgtgcgatgttcacagccttgtagacttctggcatgtaaacgtcttcgtagcgcatcaagcccttcttagagtgagtgcgaacgagtgccaaaggtctgcgaccgttagcccaatagccgcccccggtgattgctacccaaggtttcggcggtacgacacatggctggaacatcggagagatacccgccagagcgcctgcacgcttcgctaatacgtccacgtactcttgggccagttgtagtgcctcatggtcagagcctgcgttacctgcgttgtggcgctgtaattccaccagacccgtggattcaatcagcatttcaatcaggcgaatccctacgtgcatcgtggtttctttatcccagctagaccacgcctcaccaccaagcagcccacgaccaatcatatcggcctcgaccacctgcataaaggctttcttgtagacttgcccgtggcgcttgttaagctgttcctcaacgtgcttcttgaagtgcttcgcttcgaggtcacggatgcgcccgaaacgtgcctcatcctcaatggccttccccagcataccagcagcggcctgaatggttgtcatgttcgtgctggtcagtgacgcaaggatgaccttgagtgtgataaacgcggacgcctccggcttgagtaactggagtggtgcataggctactggcttgcggcctttcttcgaggcgtactcttcgagccactccacgatacgtgcggttaacttagggagaagagtagcgagtaatggcttagcggctgcgttgtctgcaatctcaccagctttagcttgacgctcaagcatcttgaggaagcggcgctcgcctagctcataagactcatgctctaaagccagttgttcacgagccaatgcgctgccgtagtggtctgccagtgtattgaacgggatagcagccagttcgatttcggagaagtcattcttttcgatagtttcgatgatgttcattgcttacctcgttgtgaataaatcgttcctattcaggccacctcatgatgacctgtaagaaaagactctatcagccttgcagtctcctgtcaaggtatgcgtctatgtgtaacggtttgccccactgaatgcgcacctcgtcatgcatcatcattgccgcagcagcgcggcgctccagttctgcaaagtttaggttattgtggtgcatccaagcgttgcgccagtgcttatcgccccacaccatacgcgccctaggctcatccctgcgattctgattggcgtccatgcgcatcttagcgagtaccttagcgtcacgtttagcacgcttagaggcctttctgcgccatttggcacgggctttacgtgctacctgaaagtctcctttagggtcacggcgtgccttacgtgccttgcagcggtcaatcgcttcctgcgctctcagcgcctcaatctcagcgatgagttcatccgggtcacagtggaactcacccggctttaacttgtcgtctgcgctgaacgataccgggtctgtgataatcaggcgtcccatctggtctttcatcatgttcccgctgtgacaatcgaacgatgcgatgcctaagaagaacttgcggatatccttgcaggtctcaatgaagccctcgcttatcgggtactcttcggcggtatcgaagcaatcctcctcaatgatttcccttgcagcgtggaagtggtggcgaatcttatcgctttcaccgtggcaccaatcgttaagcggtgtcagatagtccaagaccaccgtgtagcagcctgtatgacgctgaatgtcgtacaccgtagggataccttcccggccttggttcatacggcagaatgcagcataggcagcgcctgaatcctctttcttaaagcctaccttgataaccttgcccggtaacaatgcgtgctcatatgctgcgctaaagtgaccgttgcccaagcgtacaaatccaacatcacgcatacgctcagccagtgtctgccagtagtccatagactccaagccccaattacctttggcctgcgtcagttcgccgtcttgagtctcatcgttcacgatagcagccgcaagagccaccagcatgggctggcgttcgttcaggcgctcaatcggcaggttgcggatagcttcgagtgcggcttgtgcttcggtgaaagtcatcgttcagtgtcctgttatctgtaagaagagtaaagagtaaattcagcccatttgacagcgcttgcagcctgtcgtgcggtcatcttgcggtgtctcgttaagatgcgtttgaccttgcgtttcgatgcaccatacgccatcgcatacagtgcggtctttacgtgctttgagttagtgcgtagcaatgtagaatactcctaccttgttggccttaaatcgtccgttacgttcacgaaccgtaaaccgtgggatgaatccccacttaaagtaactcagcgttgccttgtgtattaccagaccgcgcttaaagtctcgcataaagtacatagcgatgcacagatagaccagtgcgataaagagaatcatcatgcgtgtttcaccagttcgatagcctcgcagcctcgcccttctgcgtccaagtgttccatgagtttaaccatcttgcgatgatagcgagcggccttgcgtgactcagagtaccagccagcgaccgcaaagagtgcgatagtgataaatataaccattgctaatcctcctgtaatgtcaatcataaaggccactcgcatggagcgaccttgagtttaacacttattgtacttgccagcggcgaccgaactcatcaatcgtgaagcagccttgcagtggtgcgcctttaggcacttcttggaagctacccggcagacgttcagccttgtaaccgtcgatacctttagcgtacaccagaccagccgtgtgagtctgtgatttgtataccagtacgcaatcttgctcccactcattacaagctaagcgtgcaacattgagtgcctgcgccttgtccttgcagcgtacacgaaccgttttttcctcagtcggtgcgcttgcgattgcctcacgatagcacccggtcaaatcggttgactcaacggagccataaagacccggtgcggcacgtaaagtgcttaccatgtggcggtggcgactcatgttcacctcatcgtcgaggttggaacggaaagctgacaccagtacatagaagacgttagcaggctctttagtgaaaatcatttggtgttacctcatgttagttcatgttaagtgaatatcataaaggccacgctttcagtgcgaccttgagttattcgcttatacgtcggtacactcaagagctattatccagattgttaaagaactttaggctacagtttcgtcgagccgaggctatttcagtgttagccgtcacttgcattataagtgcgacaagctctttattatcgtggtcgcttgtgctttcgccatctatccactatgtcgcgtttttacacctacgacactcggtgtctttcatgtggtacatcgtaccgtgcttacttcatgttgtcaaccattttgtttcgctttatgtgccgtggtgcgcttaagtcacctagaagacaccgatttgctggttgacgttacgttgtgcatcttactacttgttaccttgcgttgtcaatgcctgtttttcgtatgacttatcaggctgtctacttatccggttgactccggtatctcagggagtggctttaaggccgttgtcccgttgacgagatgaataatagccttaagggttacttaaagtcaaccattaattttaatcttttattaaatcccttattccctctttaagtatcccttattccctttagtgagggttaacgaaataactacagataactacaaggcgtcactacaggctaacagtgggtctatcagtctggttgtctttaagatagcgtcgctctttaggtggaggctttaggtagtggctttaggtagtggctttagggtttactttaggaatggctaacagatagggacacatagagatgtactatcgaactggtacactaggacactctttaaggcctctctaagtcctccttaagccaccaaccactttaggtattgactttaggcaacactttaggctatcctataggccacttgaggagatacccaaggttaaccgaaggttaaaccagaggggtagggctggctttaggtggctttaggagggctatgggggtactttgggttcttgaactgtgagatacccattcagatttttgtggtaaattcttaaagggtctctttaggaaaccactttaggtaaggccacaccataggtgagaccataggcgcatcccgaagggatagctaggagacaccagaagaccctgtaagaccattacgaactacagggcatctttaggtataacctttagggttgactctacagggatgagttggtgtagtgaaactatacctacgaatccctcagagccgcttgtcggtcatcaacaacaatttaatccccacaagagagtatagagcaaaaggccacttccagttgaccgaggtggtcagtaagacctgcgtacccaagggcagcagtaagtaccagaagaaatcgccaagtgactctatgacgcagcagggcaatcagcaagcgtaacattgagccacctcctttcagttgctctaaggtagggtgattatacaatgataatatcaccaatcatagaggcagacttaaagtgcataaagggtcattgcataacctgaatgactaacctatatagtagctttaagtcccctctctccctttagtgagggttaattcaaactcattgattcttaaggaatttcttaaagtgaccatccgtggcctcaatgcttccttatgcactcaatatgcataactaccagtcaatgaacctgttgctattcgcatcatcatcctcccaatagagttccatcccgtcaaccatagcggtaactacgtgaccagccgaatggattgggtgctccatgtgttcctctaagaacgcctcaagcacctcagcttccaccttcacggcgtccagttccatcgtagagcgtaagaactctacacccaatgctaacgcatcaagtcggtcatcgtgggccacagcgcccttctcacgggccatacgggtcaactggtagaacagcgaatagcgaacgtcatgcttgccatcagcgtcacgggcagtctggtagtcctcacgaatcacctcgtcacgaatcacaaggcggtgcgtagagagtacaggctccagcgtatcacaaatgcgtagttccttcataccgcgagcacgaatctcttcaagttgcgctgcatggtgtttcaggagcacagggctgaataccttaccaaacataccatccccgaagttactctcgaagaccactgtctgaaccttccactgcttcgctttcttagcgagggactcaagggtcttatcggaataaccatcgcggaacccgccagcttccatcagatagatgtagccgttcagggtgaacaacactgcgtaaccagtctcatccttgccgcgaccacttgggtcaatcacgaggatgcgctgctggtactgtccagtgttctggctgcacgaatgatagctatgaatatcatcacccttaaggcccacgttaggaagctcttcattgcgattctgacggttcggaagccactggtaatgcattggggctttctcgaagtccagaccgcacacgatagcgtcacggaggcgtaaggggtacttctcggcatcactcaggttcgggttgagcatgaactgcaaagtgaagccagccttaccgtattccaactcacgctcacgcaggtcttccatatcgaagcgcacggggtcagtcggttgaccttggagcatctcgaacccatcgttgaactcttcgcggagcatcggggccagacggtcgccatagtacaagtcttcctcacggctacgcggatagagcgcaggccagatgattgtggtgtacccacggttatcttcgagttccttgtacaaggtcatttcggtttgaggcgtgccaaggtagataacgcgagaagtcggcagtggtttcagaagcgcagcaaattcctgcaccagagtccacagcttctcacgggcaccttgagttgcggagttagacggaatctcaacgtcatccgctatgatgatatcagcacgactaccagtcaactgaccagtgatacccaccgacttcacagacggagagtggtcaggcttggcagggccaacatcgaaactaatcacagagtcacgctgaccggggcgaggctttagctcagccaagaagggcagcaggtcaatgatgttcttgatgaagatggagttagcgtccgcacgttctttggatgcagagacaatcagtatcttcaactgagggtcacgccataacgtccacacaacgaacgcacaggtgatgaatgacttaccgataccacggaaagcctgtaggataaacttcttgttgtctccgttagccagacaccgggccatatcaatctgacacttagttggcggcgggagagccaaagccttccacaatacgaacaggaaggccacgaagtcacccttaagctgcgcgatgattagcgcattacggtttgcttgggtgtcgctcattctgcatctccttaatagtacgctggagcgctcttacgtgagcatcagcagcttgggttattccgataatacgcttagcatctgactcgtgtagttcggctcgaccattaaactcgcatctaccgttatcttctggtagtccggtaagggttttgatgcggactgacagccgcttattattactacgcaggtcattaagcatcctatcagtgctgccttcaatggctgcaatctcttcttggtactcacgggatacccgactgacctctgcctgagttgctgcggttgcctttgttttcgcaatgtattcattttggattacctccttccagtttgctctctcatgggttgaccctaagtgccagccacccataaagagtgtcccggcgagtacccaagggagtgcgctgcgtaaaagttttagcataacacctcccatcaatttttagatttcacgtagatgcaccaaataacatccataaaggctccccgcgtggagaaccttgagtatgtcacttactgtagcgtgattgtttcatcatcagtcagaccattagggccgaccactttgttgtagtcttccagaccagacgcaagaccgccaaggatgttctcatccggggtcagcttactgatttggaacttatggcggtctaacagtttgccgattgcgttgtaaagctgcggcgttcggcgctcctcgctttggaggtcagcaagcatacgctgtgccatctcagtgtctagcatctccagcagcttgattaaagtcttgtcgctcataggttactccttgtttgcacgtttccagtcaatcatcttatcgactaccttggcaccaatctgaaccactgtgtaggcgatagctgcaacgtagaaccattcgtttaacgatagtccccaaaagagtcgggccgcaccatcagcgacccctgtgccaacaatcggcgcagccttaacgacctcgttgttgaagtcaaaagaaagcattgtgttctccttatgttgtgccgtccgctggctttgttgattatccttcgagttctttaacgcgttgacgcagtgcttgaagctcagttattacgtcagcaagcaacgccctgtcgttggtattcaaaagactaccttctgcggtggtcgtgaggtatgtgtacagcgggtcaatcgtgtcaagctgttgggccagccacccacgtttacgttccccggtggcaatctctgtgtattccactataccaattgcgtcaatacgctcaccagcaccatcaagaggtttagtgatatcatccttgattctaatatcagaacccgaagtcatcacatcaccaagtggtgtagatattttaccattggagaatagctgccagttagtatccttgctataaccattgaggttaaggattatcgcgtggtctgtaccaacgtgctcctgaatatacataccacagtacgcaccaagtggatcattcttagcaccacggccccgaagctgtgagcgaactgccacagaattgagatattggccaagatatggattagggggagcatccacatatgcgatgatatcaccattaactcgcgttggccctgtaaagtcaaacctgttggtatctgtaataacaaaaccagcacgtaaggtggatgaagtaccagacacacggtagttctcgaagtgcatggcccctgcatcatccatataaatcctgttggcatagttcacgccattcacggtcttatcttggtatagcccactgtggttcagtattgatactttaccgtttcctttaatggtgaagtcacccttcatgacaacattgttaccgttgactgaatcaatagcggcagcaaagccattcatgttggtcagcttagccgcctcatccttagctgtctgagcagaggccgcagcgttggtctcagaggtcttagcgttggtctcagaggtcttcgagttattctcggacaccttagcattatcttcagaaacactcgcggcggcagcactcttagcggatttgcgggagtagtgatacgcagagaactcgctaccctgtaccggagagtcctcagcacgctgcgcccattggtacgcgttggtctcagaggtcttagcgttggtctcagaggtcttagcgttggtctcagaggtcttagcgttggtctctgaggtcttggcagcggcctgagaggtagcagcggcgttcttagagttcagggcagactcgttccaccgagtgacttgacctaaattgatagcatccccgaggtcaataccatcagctacgtttacgatacgacgaccacgagcatcaaggttgccatcgttgttcacaccaatggtatcagccgttaagtcacgagcctcttctgcaacgtgaagggtttgaacctgagagatgttcaggtcgtatgcccgaaggattgaaccatcggtgaagtcaaccagcctatcggtagcggaggtaaatcgacggatttcaatcatgttataaccgtccgctggcccccacgctctcgttgtggagattgtggtcttagttgcaaaacgatagtcttgattcaagatgagttcctttcggtcaacaccgataagggtcactcggacgaacttacgagccagatactcaaacggaatattgaagtccgtagtggagccatccagcgggtaagtcatcacggtcttaatagttgtagccatgtgacctcctttgtaaattagcattaggagagaagaggccagaatgtgacctctctccctttagtgagggtttattgtttcttcggcgtctcctttatacggataccgttggcctcgtagattttcataatgagttgctgcgatagcgggtcattagggatcaactcacgagaggtgttgaagagtcctgtacggaactccagagcggtagccttgtttggagaagacagtagggaagcggcgttaattgctgttgcgcccacagaacccacaaaacctaaacccggaacctgctcaccaactgcacctgcgatagttgaagccacctgtctacctgtcaccgccttgttagggtcacgcttctcggactctttagggagtacagtagagcgggtgtacttataggtatcgctaccaaccatcccagcgaacatgtcgtagatactcaatggtgagcctaagtgtgaactacgagagattgacgcatgagcaatcatcttagggtcaagtgcgttcttaaggtactccttacgtttgtgctcctgtaggcttgcggccttaaggtgcgcctgcgcaacgtagtaaccaccagctagacccaaagagatgatatgcgtcaacgcttggtctaacgcacggttgttcttagttgcctcgtagaagctacggacgaaccgggagttaagggacttgatgacgaagttcttaaactgcatcaccatcttcacccctgcaccgaacgctttggagtcctgtgatgaaaccttgtgagggcgcagtatagtctcatccgccaccttgtcagccagtcgccacaagtccatcgaacgagggtcgttagcgaaagcctgtttgtcacgaatggtgaacttaccgtcttctccacgagtcgcatggtctctgaacaactgcttgattccattccactgctcagggctgatagaggcagacttaaggtagtttgccttaccgaacttagaggctttcccagcaagggccgctccagccacatccccaagcacaccctgacgggcagcatcaagaatgtagtttgatgttccgtttaggagcattgtccaaggagagcgtgcagccaactcttgagtgccgaaacgaatcgtaccgaccacattggcaaccgcagcgctggtgtccgtagactcccggagtcggcgcacgtggtcttcacgtcccggacggattagttggtctagttccttaccgaacaccatcccgtgtatctccttaatctcagaggcacgaagcggtttaccacggttgacccaatcgttaatcatagggatgccatgagttatcgcagagacgttacccttcgccagcataccagcgatttcagtaacgttctgtgcgcccatataggcgttcttagcaaagaacgtgaggtcatttacggagcgcagggctgtaccccaagcgccttccgggttcctacgagcacgaccagtcagaatcttcacggtatccttgagggcttccacttcacctttcagtgtgccgttgccctctgactgcttatccagcgccatgatttcatctttcaggtctttggtagtcttaccggaaccacccatgattgcaacatcaccatctactcgtcggtcgtatgcaggcagaatttcagccatgtcatatgtacgcaggtcgttcacagagaacgtgttaccatcagggagagtcaccgccatgtcactgtcgaacatgttacgggcttccaagaagttgttgttctcgatacccaccagaccctcaatgttatcctcaatgacagaggaggcagagaactggtcggtgtgtgaaataccatacgccttatccatcgcgtgcttctgcaccatctcaggtgtaacttcctgcacggatttgagaccgttaagttccatcaggtactcatcgaccctcgccttgacttctggacgagcacgataagacgtcaaccatgactccgcgattgctcgctgtaagccatcattaccgtagcgtttaaccatctcaatcttgattgctcggtcgtacacgtttggcacgtaggttcccttgtggcgtgagccggggaagatactgaccgccttggtgttgccgaagattgacgggttctccatgatttcgcgtttgaggtcaaagtgctgcttgaggatgttcatcacattccgctcaccctttgtcaggtttgcttgaagctcaggccgctcaatcgctaaggctgcacgcttgtagatttcctgtcggatttccttacggctcattgtggcaccacctgtggagaactcagggtctttcattgcagtacgaacagcatcataaagctggttgtaggtgcgctgattgttcgcgtgtagcctctccttaatgtcagaagcagtcgcaccgaacttaccattagagcctgattccatccctgtcggagaacgcacaaggtcactcgcaatggagcgaacagtcgggttctcagagcggagagtcttcaagccaatctccgtgaagccacccaaagagataccacgtgcggcacgctcagggttgacagcctcgaactcgctaagagtctgagggttcagcgggttggtgtcgctaaggatttgaccttgaggcaacacaacggcacccggctcggtctccagaggtgaatactcaacgccagcgtgctcacggtcgaacacacggttctcgctcggcatacgggtcaggtcttcaccaccagagttcagagcggtctcacgggcttccaagcggtgtgccataggagcgaagtcattaacaacctcagtaccacgggaacggcgaataccagcggcgatagcgtcactgattgcactcatcccggcaccgaacatcagaccgcctaaagcagcatcagcatagtgggcttctccaccagcgattgatgtacggagaccctcagaggcaacagcgaggccagcactctgagtaccgacaatgaaagccttgttagccaccttgagacccttcccggctacgcctactagcggtacataactcagcgggtctacaccagcaccgacgataccagcagtaagtttggcaccaacaccagcatcggcagaccgcgcgtccatctcgtagttgtcattcgccatcttaatgagggcgtccagattctcaggagagcctccagtgactacgttgatgtacgcggggttcttcacttccttacggatacgctctaactcttctggagtccacgtatggctattccaacgggtaggcgtaatggtgtccttgaacaaatcaaaaccatcgtcgctacgggctgcacggaaagcaactccaagtacagagttgtgaagctccgcacttgttgcatctccaattccgaagaaggtagagcgtgagttaaactcgtccagtgttgttccagtcttttcccaaaagtccttagcataaggcacgttaggtgctttctgctctttaccctccactttgaatccagttgactccggcaggtcggttcctaccgtctgcttcttccctattccagcaaatgcatcccccgatggaatgcccttagcctttggggtgataccgccgaacgcctccaagtcccccttgcgaggactgttagctacgtccatcaggttacgcatatagttacgaccttcctcagagattgaagcccaatcacctttgtcgtaggcctgcatctgaggggcaccatttctgccctcgccttggttgtacgctagggctgccttaagttcgtccccatcgtatttacgaatgaggtcactcaggtggcgagcggctgcatccacagccaactcagggttgtagcggtcatcatcgtctgcatcagtgaccttgagtcccagcgcagtggctgtacccttggtgaactgcatgagacccttcgggccagttggtgatttggcctttggattgaagctggactcattgaatgctaatttacgaagcaggtcataggagaccccatgtttgtctgccgctttttgaaataacccatcgaactcgctaggtttgttcttatcgtagctcatggagcctccttatcactgttagtcttctttacgtccatagatgtacttcggagtcttcttccgtttctcttggacacgtttacgcgcttcttcacgcgcctgtgatacacggctgattggggcacgcttgttggcctctttgagggctttctctcgtgctgcctcagcttgcatctgtgcggtacgctggtactcacgctggagcaactcttggtcataccgaatgcgaacctgtccggttgtgtccatcaggtagattgaatcaccttgctggtacaccgacagttgcttgttggtaatccaagggttcgccgctgtgattcccttaatggcttcgtccagaatgttcttcccctgctcccacgacttagggtcatccgaaacagtcaggatgttcttcggtaggacgccgtaggtatcaccctcaacatcgctactggagaacgtggtcgtcgaatcggagaggaactttgcgacctgttcggttgccatgtcagggttccctgtccggtacttcacggaatcataaatcttccgggcatacccttggacactcgaaggcatgtacttgatttgaggattcgttgaatcgttcatcatagcagcccacgctcggtcatcctcaaactgcatctccttggtcttctgtgcacgggccttatcagcgtcgataagaacctgcgtgtcgatgccttggttatccaacatgtccatcgtcaggaacaactcggccttgtcaggatacagagaggcaatcaggtcagggtcagtgttgcggatgcgacgaaggttgtccatcgctggtgtgctctcaggcatcttaccgttaatcaccgcagcctgccattcgttacccgcgtcggtaatcatctcaccaaacgctgcacggaaagcaccctccttggagtctgcccgtaggtagtccaatttcagtttgtctttctgttctggcgttaagtccatcgcttcgatttccgctaacttctggttcgcgtagttgaccatatcgctatgggtaaactcaccagtgttctcgttggtcggcatgtccttatagttggtcgagacgtattcaccattgaggcgcttctggaactgcttgtcgatgaccagagatttattcatggtcttctgttgcttgtccatcagcttggctgtctcagcttgttcctgcttgaagcgggtgcgcatctgttcctgtgcggaaatcagccactcacgctcaggagtcatctcttcacccggctgaatcttatcgagttcggccttgatgccttgaagagtctcccagcctttaccagtgtccgcttggttaagcgctgagttaatatccagtcggaacttctcggttaacttcgcgttgttctggaattgagtgtgctgtgccttaatcatcattgcctgccactgctcatcacccatcagttcacgataggtagtcgtagcgccattaagagtcaccttgcggttctcaatgttctgcaagaaggcggcaccacccggacgctgtagcacgtcattcagggacgaagagataacctgttgagcctgattgtcggtcatccctgtcaccaaggagttgtcgatgtagttctggaagaactcaccggactcaggacgagacagcaggtcagggtcagacaggacgccattgagttcaaccttcgagttcaggattgcacccttctgcgcttggtcactcaggaaggtatcatgtgcgccgtacagagcaatgttacgctcggtgatgttagcattgaaacccttctggtattcctcgtccatctcattgatgccgaactgctcagcgaacgacttcgagtgctcctgtaggcgtgagtgacgatactgctccatctcttcacgagtacggaagcgaccctctttgatggcctgttgaacctcatcgtcaacgaggaacgcagcgttacgcccggtcttgaacttcaaggcctgcattgcgtatgggtcatcctgatacagcagtgtaccattctggatagcctgtcggcgttgctcaggggtcagcttacggataatctcgttggaacgctcatcggctcgttgcctatcacgttcatctttcgccatgtacatatcggcaccagccttagcgaatcgacctagggagtccagaagactcgctcttggttgctcagcctgaatggttgctgcccggtagtccatgcctttgacgccccggagtcgttccataccgggagtcgccatgttgcctaaaacactatttagtttactagccattattacctcccggtcttggttcctttggcggcactgataggtgctgcttggtttccacctttcttgtcaaatccaccagccgcatattgacttgcagcttcctgacccataattgacagagggtctagtacacgcatcagaccagacttacctttggcctcgctcttgtacattgcatcgacttgacttgctgttgactgagtgcgtcccaactgttgcgcaaagatactcgcgtagtctcggcggtaattctcggtgacactattagcctcccgaatgtagttgccctcttcgatacgcttgatgcgcttcatggattcgccttctagcatactctcgccgatagctgcacggatggttcccatagcttgtaccttctgcatgttacgtgaagtcaactcagaggatgcagcttcaagggcgtcccgttgttccagcgaggcgttggcattctggatattcatctctttgaccatctccattgcctgtctgcgtccagcttcggtctgtgccacccgtgccttgtcagcactgttctggctacttagagcttgggcacccatcatggcgataggaattgctgccatccaacacataatcatttccctcctaggtatgttattgccttccgaagacgctcggtgtcgtcctcgaacttcccaagagcgatgttacaggcagagcaaaggagaccacgaacagcgccagtggcgtggcaatggtcaaccgctaacgcccgtccctcaactctctcggtaagaccgcagatagcacacactccgtcttgcttaaggagcatcgcttcgtattcttccagagtgattccgtacagacgcttaaggttcatctctcgcgcctttgagtagtccttcttgtaatacgtgtagtgacatggcttacagtgacttcgtaggccgtccttactcttcttgtccttatagaactcggagacagctttcatctctccgcatttcttacagttcttcacgttgcctccttgagattgtgaatagttggaaccgaccatcgagagtgtactcgttgtggaataccgctccgattgtctttaggaaacgaatgtgcgacttattgcctacccatacgaagttccaaatggactcgtactggttcagcatcatatcgcgatattcgattattaacttacgaaactctaagcgctccttcaaggtaaacagtgggacgtacttagaggtaaggaaccacactcggtctccctgattgccaccaattgccaacacagcgttatcgctaagcattgccacagtgttatcatcaggaattacctttggttcgacacccaatgcctcagcttccagaatgtcctctacggacggctgaaagttgtcagcgtggctttgtaaacactttgtaatatacataatgctttaaccctcgtatctattagtgtctccctttagtgagggttaattcaccgcagggagactttaagttaaatgccagaagaacgacgaaggtagttcccctcccagccgcacccaatgatgttcagtggagttgacgcatctgactcgatagttactatgttcgtctgcgcattacccaccaccgggaagcggtactgccctgttccaatgttagacctgccaacacgcagattgtcggaacccaatcgagcaccagccattgtgtagatgaactcacgggacaggttgttcacacggatggtgaacgcgccagaatcctcatagtttacccacgcacgccgaagctgtaagcgaccaatatcctcggtagccgtcgagccgtcctcagcagtcttcttaattaggaacttcgagaacgtataagtgaacgggatgttgaacccaatgtaaaccacttgtccctcttggttcccatcgagtctcaatattgggtcgctactccacccgttgactggcgggtctacctctataatctttccatcagggaagaccacagacactctacccttagtgaagttcattccataaatcgctgcgaggcttatggacgtctggtaggtatcatcattatatgccccggtagggatgatgtatttcctcttagcgtcgatgtataatctgtaaggctctcccggaatgtctatagagttcttcgtgaagtgtaagcgtcccatccacacagcatgttcattgcccatcaatacagtcatagttgagtttatcacctgtgctgcaaacaccgtaacgttgtccccaaagtcccaatgagaccacgactgctgcctgatttcttcatcaatatagaggaacttgtagatatacacccggttcggtgctccgctcgtgaggatagccgcgaagttctcagcggttgtacccgatatactgaatactccattcggtatgtagttcggaacgtgagccgtcatgtcctctgcgttcttcacagagcttacatcctgtaccgcatagtatcggttaatggatgtgaaggaagagcgaggtgacgcaaagtatacattacgccccacaccgtgtggtcgcgccctgtcttgcacgtcgaactgagtcgtaaggttcaactctacggagcgactcgaaaggataccagaggctgtcagaacgaactgcgcttggtcagaccacaggagcaactcttcggagaacggaacggcatacttcaaggttgacacccggttgtgactaacggcaacgtcgattgggtcatcgtcagagtagttagacacggaggccgggaagaagttgaagtatttcgaggtgcgagacaagatgatgttctccccgctaaggaaccccaaacggttacggaagaagaaaatatcattgattgtctgtccggtaaacgatgggtatgggttagttgtatcatcgcccacagtacgagcaccccactcaaggtacttgaagtcaaagttcccgtcagaagcacgtaccagcgcccaaggcatcgtgtggtagtgcaggtgagtccttgtgttccagccgattgtttctacccataccttacggttgaggtcgaacctaacgtaatactggtcggcagtctttgaggtatcaccaacaatcttcacgatgtacccatctggagcgttaataggcaacttctggaacgactgagtgtaatgggttacagggttgattagctggtctgcgtaaccatccttagtctgtagtccccaaacgttatcgttatttggcgcaaggatatggatgaatccggggccaacgttgaagcgccacttattcgggtcttgctcgttgttggggttccctaggttattccgcaactgagccgccagcttctcagcgatggcctgaccgtcaacctcattgacgtgtgctggttgtgagccgtctggtagttgaatagcagcacgctcagccccgttgaactcgattgagagcctacgcccatattgcccaccacgaacattaatcagcgcatcgccttggtctttaaagcccggaaggttgaccgattggtcgttactctgcacaaccaccttgcggttagtcacaaaggtatagtctgccacagttaccatccgaaggtcttcccgtgggttagctgtacgcacataagagcggtctccacgtactagatactccttaccatcgaggtcgaacaccttaatgtcttcaccagtgaacacaacgaaatactgctcgaactcatcacggttgatgaggtgaacgtaaggttgcgcacccacatacccagcagcgccaagggtcttaaggtgaatcatcggtgggcgcttctggagaccctcggactcagaagaccaaccgttaatctgtacgctaccctgttcagcgaaccggagaatatctggctgttggctgataccacccttgaggtttttgattgattggctaataagagccatagagcctccttatgattagcggttaagtagaccagaggtgaatgcgtcaccatccagcatgttgtagttaccgtagtctagctcgtactcgaagcacgcacgccacgcttcctgttcctcttcctgcaacactccgtctacctccggcgcaccgaagaatcggttgttgaactgacgggaagccttggtaacgatgtagttacggaagcactcaggcatctcatcgaactctctcagacgaatcaggttgacctgaacaccagaagggaatctgtcggtcttcgcagagcggtcatagagatagccaccacggttgacatattgggtctgaccgctggttgccattacggacagatagtcagagctaaatggaatcatgccagagaacgcatccggtagaagagtcacaccttcctcaatgttgaatgtccatcctcgtgattgaatctgtcggttaatcttattgagtacacgtcgagcattcgcaacgtcagcattcgcatcaccctcaagggttgatactggtggctcaccgatggaagccagaatgtcgttgacggctgatagctcttctgcggtctcaatgttcatctcataagagcgcatggtgttacctcctgttagtgagggtttaaagcaaaaaacccctcagataccctcagagggcacccaaggggttcataaagtaatgaaggaaagtaaatccccggtaaagaccttagccttctacgggaggctctactgctttcacagtgaccttgcagacagccgtcaggccattcacagtagtagcagtgatgtcagcggagccagcgcccacagcagttacagtaccagaggcatcgaccgtagcaatcttcacatcggaagacgtaaaggtcactgtctgtactgcatcagccggagttaccgtagcagtcagggctttagaagccccaacgactaagctcatagtcttctgactaagagtaactccagtggggtcgggaattactccgacacctttgggagaacgatagcgccagcagcttctggacgcagaccgccgtgacccatcgcatatttagcgataatctggtcagcctgatagttcgcacgacgagcgcgctccagagccaagtctttcagcttgaccgtaccaaccgcagagcggtgctggaacaggccaacaacgttatccagagcaaccttaacggtagtgctggaagtcgccgggaaagcgtgcttctggccagccggagtgtcctcacggtcatcaccagcaccaccagcagtcaggtgcggaacctcaaccacttcgaagcccatcacgttacggatagtgccgcgctcagggtcaatcagtgcctgatagtttgcagcgttcggcatcagagcagccagaatcgcggagtagttatcaggagtggtgtagaaggtacggtcagcagccggaacgtagttcttggtcagagacgcacgcgcgatagtcaactgagcgataatcgctttacccagctcaaccgggtcagtcaggtcgccagtggtcggcttaaccagagtcagtacggtcggcttaccgagaccctcaatgttctcattggaggcgtcaggcaggttaaccagaccagccagttcagccagcacagcaccgtcagccgccatcgccagagattcacccaactgtgcggtgtactcagcgcgaacgtcatagtggttcatcgcgtcctcaatgtcgtaaatcagcacgtccgcagtcagcaggccatcaatgtggattaccttctcggtgtgtttgatatccttacgtttgtcatcgaggttctcacccggtttcaggtaagcagctttggtgcgaccaatcacagggaactgtgcggacttaccagaagcaatagagcgcagcatgtgacgaggcatggtcacggaggtgcgagcgaaagccgtcaggacttcaccgccgaacactttcaggaacagcgccaatttgtccgctgcggactgacccttaccctgattagtaccaatttgctgtccgccttgaatgttagccatgttgaatctccttatgttgatttaaagaaaagtttggttactacttgaatcgagttggttctcaatgtttcacctacgggagtgaccacaaagttctgtgctcaggtgattcaaccattgtagtcatctatggtctctccctttagtgagggttaattagaaactggagtcgataaccttctgttctaccatttgacggtaggcagcatcgctacggtaacgcgggtcactcatagctttaatcatctcagcctgattcgtaaagccctctttctgacgagctacaggtttaaccggagtagcacgcttggtaacactacggttggcaggcttaccgaatttcttcgtgtaactctcaccagccagattgataatcgctttgatagtcgccaagtctcggttcatcatggcagcctcaagggactcagccgcagccgggttggttgcttcaaggtgcgtatggattgcgctaaagcgctccttaccaccagcaaaggcaactacctgattgacgtactggtctacaagggcttcctgaccggagatgtaggagtccacaaaggcacgactatagccagcagcttcgagttccgcgtaggatttctcagagataccatcggcttcgtactcttcgtagatgcgagtcacagactctgcgctcagtccacgctcaacggcctgctcgaccatcgcctgaaagccttcttcgtgctgacctaattgctcagtcacttggcttagttcttctggagtgtcacccagcggttcaaactcaacgtccgcaccttcggtctccacctcagcgttatcgctaccagtgtcgaactcggcttcattaccatcttcactgatacgaacctgaatgcggccctcatcgtcttcaccatcagcgaacgggtctacaccggatgcatatgggtcatcgttatgggaactcggttcctcgctaagtacgattgcatcatcgccatcacgggcagcaacatcgagactcagcatattctgttcgtgttcagtaggtgtacttccggtcattaccgcgttgttcacaccgaaggacgcataaacgtctgcattagattcagccattgttaaatctcctaagttgttaaagataaagggaaaccaaaggactccaacctttagtcatcgctcatttcaaagatgaggtctccctttagtgagggttattaggtggcgtcgaggccagcctgtgctgcggcaccctgcatagcgtctggacttgaggtcgctagggcacccacgccagccccaccagttgcggcagcgttctcgatacctgtttgggccgcatcctgcatcatcagggcttgcttctgctcgtccgtcagtaggataccagaagtatcaataccaatggcgttcgcaatgcgcagcttaatgacagcgaggttaatgtccgggtctccctgcataggagccagagcagcccaagcggagatacagcgctccagcttatcgaggtcttgaccacgcccgattgcttccagacctgtactgatagtaggctcaacggcttctttcggtagctcaggaatctgcgaggttgcttggagttgcttcaagagcacacgaaccagaggcaattgcagttcttgagacagaatcgaatagacgccaccaagcgtatcttccagttctgacgcaacgtaccgaatctcttcggcggtcacacgttcaccagtgcgttgtaccgcagagttcaacataaaggcatacgataagcgtgcttctatctggtcactcacagctttcgctacggtaaagtcagcttgcttctccagttgcaggaagtcaatgtcttctcgacgaccgggaacgaagtcaccagtctgagctttggttaatctacgtggctgcgtaatgccagccggattaactagaccgatgaccttagcgctaatcatgctcatcttaacgatagcctcttggagattctcaagagaccttaagtcacctaagtattcttcacagtaggagcgaccgtaagactcgccatcaatgcgaaccatgcgaaccggaatgtagggcatagcgtcagtcggataggtggcatcggagccatcaatctcaacatcctctacttcctcatacttgaggtaatcgccggactcttcatcgagatacacatgggtgtacacatcgaccatttcgtccatcttcttctcaccaccagctttctctaccgcagaccgaacgtcttccgggagagcaccaaaggctatctggtcacgagtgacaatctgtaacacattgccgtatgcgtctctttggacaacataagaagacaatcggtacagcttcatcggattgtagctaccttcgggttccggtaagtaaagcagtgcattacctgccacgatcaactgcttgaggcactcaaagagcgtcacacggtagctgttggattcgatataattcatgataatacgctcaaccatagacagaccttcgtccaccttagcgagtccatcagggtctccaacaagctgcttcgcctcatactcactaatggtcagcttcatccacgactgcatcgggaatagtgccagcattaatttagaggccagattgttaagaccccgcgcacctacagcctgccacggagtcgtgtagtcggtagattcgttatcggactccttcgggaacaaggacggaatggtgtattgcgcacagttttccgcacgagtctcataggctctacggtcgttcgttaggcggtcataggtagctttagcaccgtcttcgcccaatcctgtacgttttgaatcagccattcagtcctccttagatgttgatgccaccgccggagctacgggctacactcagagacttcttaccgccagcgcgtgctttcttacgtgcgctttcggtttgtgcctcatcctcaccctcagccttatcctgttcaggtacatctacaagctgtgctggaggtggcgcagtcactactggtgcaggagcctcttgttggataatctcctgcttacctgcacccagagcgcccccaacggctttaccgacttccttaccagccttctcgatcggtttgccaacttccttcacgactttcttaacagccttcttgattttcttgaagaatcccatgatgtttctccctatgttatgactcagttacccaaacgccttggagcgaatggaggatttactcttgttcttggctgcgctgtcatccagctttaccttgagactgctcttaccgctgctcggtgaggttggcacctcagaggaagacacgctggtgtcctcatcgtcatcacctccccataccacagatttcggtggctcagtcaaaggtgctggttcggcagcgcgaatctggttagtgtccatcttagggactttcaccttcggtttccagcacatatcattactcctgtctcagttgctctttacgcacctcaatctcatcaagtgttcgagaggcaaggtacagaccatgcatcacaccagcaatgaaagactcagagtatccagcagcgcgtagcgcacggtactccccggactccatcacataggcctgattgaagcgcacctgtagatactctttggctgcacgcggcatactaggaatatcatcgggatgagttaaaacatgattaattggttgtaacataatttcacctcttaaggttaagtcttaaagtaataatcataaaggctccctcttccctttagtgagggttaatacagagagccttgagtttatcacttaatctcggagtctcgcttcacgtctcggactatgagagcgagcatccagagacctcgcgccagcatacctaccagcacagcgatggtaatcagctttgcggcgtccataagtaaatctccttgtcaatgtaattgtattcctcgaagcgaagaatgcgagccatctgaccttgcttgatgatttcctgctcggtcatcccagctttggcaccaatggatttaatgcagtcccacagcgtctcagtcgcatcaggagcacgcttcacccacttggttactgtctgccccttgttcttaccagacttcaacacggactctacaggctccacaatgaacgggtcattcaggaaaccttctgccgtatcgccccagccgggaatcccggagtagccatcagtcatatcacccttgatagtctggaagagatgccaccaatcagcggtctctttggtctgcgtcaggatgttaccagtggtacaccacaggaagtcaacgtccgggatagtcttgaagtccttgtcacaggagaccaacacagccttcttgaagccgaagacctcgtgaccagacccaacgattcccataacgtcatcgccctccagcatgtcctctttgatgtgaatgaactcatcgcgctcccacagcttcgacaggaagtcacggtatcctacaggcttacgggtcgccttacggttctccttataggtctcatcaaccagtaccttacgccagttcacatcgtcagtatacgccagaacaaccatagcgtcactccaagccttcttacgggttcggtacgattcgattgcagaatcgagaatgctccgtgccttggcgtggtcacactcaagagtccaaatgtcgtctccccaatccgtctcaacttcggcagcagccattgactgatagaccaaccagtcaccatccatgaccagcactcccttctccataggcttaccttcacgcatctccgcgaagtctttcaatgtgattaggctcattcgtcatcctccccgtaaaccatttctactgcatcagagtatccgtcccaattatccacaccacacgccttaagcgcattcaggaactctaggtctttctccagcttatcaatgtacgcactaacatcgttccacgcatcacgggtcatcgttacggtgtcactctttggcataatcatacgcaacctcccattcgtttcaggaagcgcacaccagaggctgtgacctcccatgctccaccattgcgaccacccacagtcaaacagctaatgtgtccacgagaagcggcctcagctacgagagccgcattgtttcgcacatagttcgactgaaaggacttagggcaacctttgatagctgccagcactttcaggtattcactcattagaacacctcccgtacagtagcgggagacagcttgaagctgtccttatcggcatactcttcgtgcatatctttaatggcctcacggaaagacgttcgcacaaggaaggccatcagcccctccatgccatacgtcaggaactggacaatcatctctttctgtttaccagtggggacaatagcgcctgagccaacctgcttacacaggtgcagaatgtctttctccaagatttcctgaacgtcagatgccatcttagcggtaacgtcgaatgacactttaaatttcttggtcatagccataataatttctcctatagaattagtggcagacagcccaattcggccccatcttaccctcggtatctaaacgacaacggaaagcccaatgctctccgacccaacgcatagcttcctgcgcggtgtcaataacaatctgagcgatgtgctctgtacggcaggccacctgaatctcatcgtgaacccaagccatgtacgcaaagtcaccatcccagccatgcttcaagcctttctcaatgagcatctcttcggtcttgataatccacagcttacaaatcagagcaccagcagactgcaacaatgtgttgagcgctgcgtgtggagacctgacgtgaaccttgcgaccatccagacccttaatccaacggcgtttccactggactttctgctcaccaccaatccaagcggaagacttaacgagagaatgttggatagcttctcgtagtgctgcaatcgccggggtgttctctaagaatttcttcttgagttccttcccgcgctccttccctgccccaacaatctgaccaatcttctcatctccggctccgtaaaggaacccgtaaatgaaggtcttggcgttgtcgcgcgttgggagttccgcagcgttctggttcttggtgtgaatgtcaccgttgagaatctcattcgcatactctccgttgtcgaagcgagccatgaagtgtgccagacagcgcaactctaagccactggcgtctatccccgcttgcacccacggcttgccagtaatcccatccaaatgatgttcagcaccaaaagcgctacgacactgctccccgtaaggagaacgaactccgggtacttgtgcaaggtttgggaaactatgagtagcacgaccagtaactgcaccgttagggttaacggctccatgaatcttaccatcatcttgaacataacgtaaccacgctttgtcaccttctgccgcctgaccgattcgcttctgaatcatcaggtactctttaatcaagtcaatgcacgcctgcttctcagggtcatccactcgtacatgctccaagacctcatcgtccaccacaggcgcacccttctcggtgaacttctcaggaacccatccggcctcctgtagtttcttctgaatgtggtcacggctacttggcttgaacgtaacgaactcgaccggagtatatggagcaccctccatgtaatccctcgtgtccaagtcgcaaggttcaagaccttcacgctgtgccttattacgaggcttcttgtacacgccaccctgtttcggatagaccacgcgaggataactcggaagtggtttgcctgtccgtgggtgcttgaagagttccttaccacctttcggctgataccacgagccaaacgtttcggttaactttcgcagaagttcggcgcgtttcgctgccagttctacataaagttcctcaatggcctgtgtgttgaacgggaagccgttacgctcctgcttcgctaacagccacgctgcacgatgttcaatatccacagactcgccagcttcacgccagaataaatccgcatcgtacttcgtgaagtccatacccgcagggaagtagtggaggtctgtaaggaatttctctaagagcttgacagtgaccacaacgtcttgaacgttatacgccatcatcggctcgttgaatgaaacccactcggcaccttcaacatactcttcgccctgctcttccagcatagccttgaagtcgtccttgtattcacctttcatctcgcccaagcgataaccccatgcctcaagagcgtgagacccgaagcgacgaccgggtagtttcccggaacgaagaagccccatgtctgtgtctttaaggttcgcatgaagtaaacgcgagagtaccaatgtgtcaatacaattctcacgtggtaacttgaagtcacgattgagttgcagctttgcgagtttctctaaagccggaacgtcatacttgtgaccgttatggaaaacaataagcccacctcgcttcacctcggcttccagcgcatccagatacgccccgaagtcgcccggacgataactatgatactcaccatcacggtagtcatagataacgccacagtgaaacttggtgactttctctaagaggttgttggcctcaatgtcacttacgagcataatgccctcctttggtttcgtgctaaatgataatcataaaggccacccttgggcgaccttgagtttatcacttctcgataatctcttgcataccagcgccgaactctaccagacgctcacggttatctccgaccaccttgtcagcagccatagtcagggcacccataaggcgaccgacctgcttgtcatccaatgtcattcgttgagtgtgtgctttcggagacttgtggtctttccagcggtagaccatcgtgaccttctcgccacgtacattgatgtgtactcggcgggagaactggtcggcggtgtctggaagacggatggtgtttgcgtgagtgattgacttgctcatagtgttcgctccttactcaaagaatttgctcatggactgtgctttggctgcaatcgctgccgacttgtggatgccactaacagccgcatctgatttctcacgggactgtttcgccaactcaatggctcgctgtgaatctgctttggccttcttgtccagcttcttggcttcgatgaagtacagtttgactaccagcttacctaaagcgttaatgaatttaaacatgatgtgtctcctatggtttgaggttgttcccgttagtgagggttaattagtggtacattccgccatcacagtctggatgaccgcagtggcactggtacttagaagtctgactgtccgtcttgttcagtccagccagtatctccttctccttcttcgccagtgtagctagacggttcaagccacccggtttctctgttgtattccatgtatccggcaattccagtgtcgccagtgaaacgacacttaagcaggcgaaccaacaccaagttaggcatatcaccttgctggttacgctccaaggcgatgatagtatcagataactgacgcaaggcaccgctaccacgtaggtcagtaatagaaacagcgcgtccttcttcatgtggtttccccttctccgggttcttcaagtgacaaatcactacgagcacaacaccagttgacttagcgaacccttttagcttagtcatgaggcggtcaatcatcttacgctcatccgattcctcagaggcagacacgacgattgatatgtggtcgagcactataacatcacaccctaagcctgttcgcatgtaggccagcttcgctaacagcctgtcagcttcggcctccgcaaaggagtcataaaggtggaacgtatcatctccgaatagttcatcataccattcatcgaaacgtccgtcctctgctatagccttcttgacttcatcagactgacgcagacgaaccttattgttcagacccatcatatcctgaatggtatcctcaacggattcctccagcatcgctaggccaacacgtttacccattcgcttgccccaagccagcgcctgttgacgaacgaacgttgacttacccataccggaaccggaagtgaccatgatgacttcacctccacgggcacccaaggttctatcgttcaggccttgacagccatcgaacagcagacctacagcgtcctcggaggtcatagcttccttaacgcggtctttgagtgacaacgcagagacaacaccgtcaggcacccaagggtttgcattccagacctgctccaagattgctttgtcttcacccatgatgtgacactcattggcgtccttacacggcaacacggcaacacgaaccttaccagccgggagaacctgtgcggcctcttcgactgccttacgtcctgcgtcatccatgtcgaacatcaagataatctgctcgaactggtcaaagtattcatagttagcggcgcatgtcttcttagcagcagaggcaccgtgacccaatgatacgaccgggtacttacagtcttggagttccatcacagtgagcgcatcaatctcgccctcagtgaccacaatcttcttaccgccagaccagaggtgcttcaagaataacgcatcgctcttgtgacttccggtggtcttaaagttcttgtccttatcgcgcaccttctgtgacacgatggaaccattctggtcacggtaatccgcaacctgatacattcggttgtccactttcgccagccagtagccagccttttggcacgtctcctttgagatgccacgggcagtcaggtcagagtaccgaccgttgctgtcaccgaaattccatacgtcatagctcataggcttgctgcctcctgtacgtcttctcgttgataactttgcttcacgctcttcgtttgcgggtactcgatgttcacacacgaagcaccattcatgcccgtcagagtacacagagttaccatcagaagacccacagttttcacatggagcatgaaacagaaagatactatcgtcttctcgttccattgtacattccttaatcagttgcgagaacaaagggaaaccgttaagtctccctttagtgagtgttaattattcctcggtgtgttcctcagccttgattgggtctttgcactgacactggcgtgacggtacgcgactcttcaacggcttatcacagcgaatacaaatcatcctcatggtatcaccctcggtcagatgtaaccagttcgttcttctcccaccagcgcttcaaatcgaaggacgggcaggctttgggtgcaacgtcatggtgagcacgaaggattgaaccctcatacttcgccagcagcgtgaccagcagactacgcagcgcttgcatttgcgcaggtgtaaagttggcgtcaaacttacctttatcgtcgatgccacctacaaggcatacgcctacggagttgtggttgtaacctttcacgtgggaacctacagccagttcatcgcggcctgcttccacagtgccatcacgcttgatgatgaagtgatatcctacgtctaaccagccctgctctttgtgccactgacgaatctcacgaacgccaatgttctggcttggcttggttgctgagcaatgcacaaagattgcctccgtggttgctcgtggtttgaattgaactttagccatttactttttctcctttacacgaattagtttctcccacggtacgtcccgcttaggctccttgagccactcgacgggtatcagtttgtcggcaaagagaatccctttcttctcgcagaactcggcgtaagaagttggagaccctttgtagattttggtacgactcgaagagaacaccagacgaatgtccagttcaggatactgctcacggattagcaagtgcttcttccggtcatcagcttcccacagtcccttggtctcgacaatgattccattgggtaaaataaaatctggtcggtacgtgtgattactggctggcacaacatatggaatcttccacatttcatattcagcctttataccacgagcctccagttgtttatgtactttgtcctccagtcctgaccggaaggttcctacttttcgtattccttttgcaccatatgctgccatgctgcacctctctttatgttccagattaatctctgagatacaccatagagttcagcgagttttctttgtgacagcttagaatcataaatctcctgtgcttcctccagtgtcagcttgcgctttattggggagcggtgcaaggcatccttcatgttgtcaaccctagttcccgctcgaagatgtgccgggttgcagcacttcctgttgtcgcagctatgtaggacaatcagacccttgggtatctctccgttaaacacttcatgagacacccgatggacggtctcatttcgaccgccaccagtgcctatgttaccgtacccatgagaaccgaaggacttctgccaaatccagcagtcgccatccagttctacattggcacgaatcttagcttgcagttgttcgcggctcaggcgactcaaaagtcctcatcctcatccggggtttcttcgtgctcgtcttcctgccactcctgctcatcgcgggactgacgggattcactcgcagtgtaaccaccatcttcgacttcatcggcccactcatcttcaccgccaccaccgaaggtagccagttcgaccagcatcacggactccagttgcagcttgacgcttgcgcccacagcggtgttccacttgtacggcaccagagagtatttcactttcagcttggagccgccaccgataatcggcacttcctgaatcttcttacccttgctatcgaccacgaccagattgatgtgcttggtctctttggtcttcttatcttggaaagacgcatagcatttgaacttgaaggtagtcgtaccgtcaccattatcgaagaacggcatgtcgccctcgtaaggtttcagtggtttcttaccacgctgtacctgcggcgggttagcctcgaactcttccacggcagcagcataagcctcttcgtgagtcttcacgatttcatcgaccatcgcctgacagcgcgggtctttattggaaagagtcaggtctaccttatagataccacgagggttgccgaagccacgctcttcgttgccataatccggcttactcaggtaagcataaggctcagcagtgccaagaccggaggtgtagattttcttcttgaaaccagccatagtatttctcctttgtggttaatgattgggttgttccctttagtgagggtaattaggctttcacttctggacggatgcgagtcactacgaaccctgcgtcctcgtaatgttcagcctgtagcgttgcctcttcgagagaccgggcgaataccggaatctcaaaggactcggtgttaccttccattgtcagaaggtatttctgttcacgttgctccactttgggcctccttaaagcgccgctcccacagcgcgtacagttgttggtaagcgtcagcagccgccttgtcaccatcctcaatagcttggttccacttagcggcacaccaatcgcagcattcacgaagcgtcataacacagccccttatgtttgtcaaacagttcctgatagaaagccgctttcttaaggtctttctccatcgttgccagttcggatttcttaccagcacgcaggcggtatttcaggatgttcccaaggcagtacccacggaacgcctcgacggtcattgaccgggcgataacctcaatggcttccacgttgtcgaacagcatgtagtggttcggatgggtcacgtcagacttgacttctgtcttcggtgcttccacgttcgggccgactttaggtagcgggattagtacggatggatgcacctcagcctcacgaataccgaagcgaaccttgactcgaccagtgtgagagtagccctgcactgttccggtcagacccttgaacaaagggttcgctcctgaataacgaacggcagagttaaccgggaagcggctacgcatatcataatattcctgtaacattacagtacctccttaagccatttaacgaacagacgaacgcgaggccagtaagtgaccacggcttccagatgcggacgctctttgttcatcgccttgacgaactcaccgcgagtaatcagcaggtgaacgcaaggggatagcgtggcgaccgaaccaatcagcggcagcttggcgttgcgctcagaggccaatacggtcgagcggtctttacggcgaaccgaaaagataccgttggatttgttgaaatgtaaacgcatgatgttatctccttaacaatcaggccaaatgttgtcgtcggcagccattaatcccagcgttgcgacgatagcgaataggataagccacatggtgtgtgtctcctgttagtgagggttaattcccccccggaacgaagaaaggcccacccgtgaaggtgagccagtgagttggttacattttctcttgagggttgtcctcagtgcctcggaacttctcgaagctagggtgacgcagggagccgtccggggtctcttccatatagttgacctgacaggcccacccgttgtagaagtcttcaccatgggctttaacgttggctgtgaactcgtccatcagtgcgcgagagatgttgttggcgtctactaaacgaccagtctcaagaagcacactaaagccaatcactttgccctcgttggctaaaccttcggttccccaattgacaccctgaatgatgccatcagcttcacattctggtttgagcttgaaccagccagacttcttgcctcgcttgtagatgccttgcgggtctttcacaatgagaccctcgtgaccttcggcacgcttggcctcgtacagttcagtcagcgaatccatatcgtagacctcataggtctcagcaataagccactcgatttctgggaagtattcaaccagaagagagcgcatggcttccacatgatacggcatcagcaggttctgtacattgtagtcctcgccagactccgcaatgtgaatcggcatgacagcatacaggcgcacactcaggcgcttagggtctaactcaaaggctactttggaacctttcagcggctcaacaccaccacggtcaaacatgaagttgttcttcttgagccacttggtacgcagcaggccagaccctgtgttgaagtctacgcctttgacaatcagttcaccatccagcatgaagccatcagggaaaatgcagcggtcatcgttcagtagttgctgccagcgcttatcgaaaccgttcaggtgttccagcgccgggatgaacttggatacgcgagacaaccatgcggcctcagccacgttgtcaaccacaatgttaccgcgcacaccatcgtacttaatgtcagcaatcaggtagccggaggtctccagcgctttcttaacggcagactctacgaatgacacagccttatacgggacggttttgaaaatcatcataattaatttcctctttgagtttctctaaaagttctgccgcctgttccttcgtggagcaaccagcggtgataaatgttttgttgcctcttcgacactgaccgtaccaaacttggcggtgtttgtgccagtagacacctttgattcctgacttgttgttccggtgtactgaccgatttctgttgttctcagagcgggtcacaagtctaaggttactaggcgcgttgttaagtttgttacggtcaatgtggtctacttccattccctccgggactgcaccgttgaagtgttcccaaatgagtatgtgatggtttaaccacttaccttcataacgaacccttctatagccgttgcgaatagagccgccagtgtgacgacccgtatcccatgagagaaaggaaggactcattaagtcaaatgaaattctcataatgtttcctcctttcgttctccctttagtgagggttattacttccagtgtttcaaatcgctgtgaaccttacggagccatgcagtctgcgcgttgatttgtacatcgctgtcgctatgctcgaaggttctggatgccaccggatgccctgagcgtgtgaacacgcggagaacctcaccggatgacctgcacatcttcgctgggttttcatagctgaatgactccaccttcacggtcacgtcatggtcttcctgtagacgcgctaccgcatctttgtaatcgttcaggttgccgctatagatacgtcccatcattagttccactcccgtttctgtgagttaccgc

SEQ ID NO: 146 - DNA, 177950 bp, Unknown
  source: /note="Description of Unknown: KP2-9a Bacteriophage Sequence"
tgattttctggcaacgtgtccagacgttcgcagaactgcaattcaggaatatatttcttttcttccttcggcggttcttcgtgcgtctgttttaaatctttacgatccttgaaagattccatcaaatacgcggtataatcatccgggtaatagtctttcagaaacacagaaaacggcttgctgtagttgcagttaaaacaaccacacatcatgtgtgtgcctcgttttgacgggaatatccagaaacgttttttgtgcttatccttcatggagtcgccacaaatcggacaacgggaatggatactgaattctccaccccgtcgaacgatttcgctttgtggtaatgatcccatgatacgagttgcgaactctatatcaagatacatgtttacctctatcggctaacttctttctctgtgccgtctaaagtgattttccattcatagaatatcttataaaacggataaggtctaggaatatcaacacccgatgatgtttttctttcgttcgtgtacacgatcgctgtgtcgctcatgtacttgatacggataggaaaccaggtgtaattgttcgcagtaacccagatccgataattcaatggcggtaatggtttcattcttcactcttcatgattttacgtttgcgtttatgcggacgtgtagaacccagaaccttcggccctttgttcgtgatcgcgcctgtagtcacacccgaagcaatattatccacacttccgcctgaatcacctgcaaccatttcttcgttgagtctttcgcgaagttctgggaggttcatcatgatttcttcgtgatcttgctcggtcaggttccagcggctccgtaacgagtcataagcacttgtaaggttcatgaacccagacatataaggaaccgcgtttaaacggcgcttgatgtgtctcacagagcgatggaatggggaatatgcttccagttcttccttcgttttcgggtttttcaatacttccccttgaccgtcgatgatacccagcttgtaagccgtccattcagtccagggctttttcagtaggcgaatcattcgcacactgtaggttaaatccatgtttttgattaattgatcgctcatagtctttactctattgtgaaagtgaaaaggttttgcgcgggttctggctccggttcggggaattccatacagacaacttcacacatcggtttcacgcctttccattcttccagataatatccggtatcaatgccgcaacctggttgcatttcaaggccagtttcatcaagaaactttttgcatttcgatgttgtcgttgattcgtcctgttggaaataacgccgtccagagtaacgaaaattcgcggacatctgcgggagaatgaacgtacccgcacgggcaatctgtgaagcacgttcaatcactttatattcaaattccgcgcccgtatacttacccttaaaattggatgtctttatcttgccgaaaggaggattgctgatcgccatatcaaacagagtatcaaactccgtcgttaacgcgtctgcgttaatccaggtcgcttccggtacgatacgcttacccaacttatagtatgtatggtttaactcaacacagacgatttcacgcggtttggcgtacatcatcatatgaatcatcgcgaaggatagtccaccgatacccgcgcacaggtcaacaacgcttccactggtacaagcatcaatagtgaaatcgcgagcaagtccgatcggggtaaagaatgcacccagttcagagttattcgtaaatgcaccttcatggaagttttcgataatgaataatttttcgtcgtaggttagcgccttgtcagactccaccagatccattatcttgttgtgttgcttcgtttccgctttcgttaactttgccattgtcccagctatacagtaatgttgattcattagggtagaattcccacccgtccacgtatccggtttcccagtcagtagtttgttcaaaaccacagatccattcgtacacacctggcggcagttctacggaatcaggaagcccgatatcttccgcactgcgtccacactcaaaaaatgcatcgtgaatgaacggacgagataataccgtaacataaccttcatcgtcaacagctacgatccagcgcgaactgtgaggactatcgaacttcggttcttcttcgtctgcatcagcttttatttcagccttacaaaaatctaaattcatcatttcactaaaccttctttaacgccctctttcatggctttcagaacaccgataaaagcgtctttgccaccgatagcgccgatgataagcatcaggacaccaacacaacccgccaaaccgattctgaacaggttccatgcaaacgggatagccagaagcaccaaccacgggaacggaaatcccataagtgcgtttagaaccagtaagataaaagcgattgcaagtttcatgatgtcctcctttgtttgtttagaataaggtatcacctttcgtgaaggattgcaatacctatagatacaaaaaagcccctttcggggcttaatttttatgctttgttgataagataccgaagaacgtttttggcctgaacttcgttacagcagagtttgaattctgggtcgattgggaggaagccccagaggaaatcaacgctaccttcaacatctgctttcccacttttcagcatttcaaccagcaaacctctgtttactacgctgttcactactgcatcgaaataacccgcgctgaaatccagttctgggttcatcacttcgtcgtatgggttgttcagtaagttcatttggtatctcctttaatccgtttcgttgtctacgggagtcatattatcacaatcataactcccgtcaacccctaatcaggattattttgcgttttttgcaatccagagagtcagtttagggaatacatttgccattgccaccacaaacagcacccagaaagccagcttaatcacaccgatcacgatcagaggtgcaaacacaagccaccatgaagcatttgccataaccccgattgctgccagtttcagagacaggaggatcaggaacacaataacgagaatctttttcatttcactatacctttggagggggccgaagccccgttaaaattgaatgtctgtactgtttgctacttcggctaacttactgcttcggttagtctcggcttgttttaccatagcaccttgtgcttcttcaagcgttttcggcatctgacgacctttataatcagattggaacccgatatcgctgttgtcggtatccatccagcgttgattacccttgcgcacttcgagtttgaagtggttaaagtggttcttatcgccgtaacgggatttgatctgcttgaacaactgcaatccctgatcagctaactcgtcggtctcaatcacagctaacataaagtcagcggtagctggaagaccagcagattcggcaacgtcgcccatgctgatatcagaagcatcccacgcggcgcgggtagtctgcgcaccagtccacattacggtattcgtttcaacagccaaaccgcgaagttcttcggcaatcgctttaaccaggatgtatgtgttttccgccccgcgtacacgggtagaagcacagatccccaggtagtcaacaataatcacatcaggtacgaaactcttcttcaatttaagctctttaatcagcgctttgaagtggttcgcgttcgcccctgctgttgggtattgcttaacgattaaacgcccgaccttcgactgtttgaggcgttccatacggttcttatagtccgcataggtgatgtttccgttgtcgatatcgtccatcgcaacatcaagcaggttagcgtcaatacgtttagaacaaacgtgttcagccatttccatactgatatacaggacgtttttacctgattgcaggtaatcagcagcgagagaacaaagccccagagatttaccaacgttaacaccagccattaagatgttcaatgttccacgttctgcgccgcctttagtaatggcgttcaggatcgggatattgaaagcaatcttcatcgctttggactggtaaagcatccagcgtttttcatagtcttcgaagtaatcatgaccgaccgaactatcgaagctaatcgctaacgcttccgccatgatgtcagggattgccccaacgtcagggattttgttgttgcgttcgccagcaggtttttcagcattcgcctggatctcaattgcacgggacagagcgcgatacattgccttgtcacgacaataggtttccgtttctttcatcaaccattccagatcttccggcgcatttttcatgctgcggatcatctttttggtatcttcgtagactacatcactcaggctctttttgtccagagctacttctaaagcagtttgtgaaggaatgctgttgaattcctgtacgtgcttatccatcaaatcaaagagaatctgcgcgttcccttcgaaatattcacggcgtaaatggggccacgcctgaacaaaatacgtaccattaaaaaccagatttgaaaatattgtttcgacgatcattattacctcttaaaccagattagcgaacatctgaaagaaattatacagctttactttcaacgccgcccataaggtcttttcaggctttgggagattgggcttgatctgcgcgtagattgcatcgtgaaccagcggaatcagtttttctttgtcttcgtccggcgtactaaattcgactttcaggccgttatcccaatacaccttatggatgtacactaagtgtgcaacatcgttttcatcgttgatcaacagttcttgaataacgtcctgcattgcttcatcaagaatgttttttgttttttgttcaatgtccatgattcacctattaaaagggggcaaagcccccagttgtttattactcttctgacatatccacatcatcagggatatcgtcatcgagatcaaatttatttgacggttctacttcatcgtcagaataaagatcttcgagtgctgccccgtcagtgatctctttgtcaggaatacggtacttatcctgaatagcatcaaggaatggttggtgagtgaacagaggtttccagaactcaatagagttggtttccgattcacgccatttcttttcttccagttcaagttcgcctgtttccgtgttcaggaacgcacgaccgcgccagcctttcgttggagtctgaacgaagttcatttccatagccagatccagaagaccagagaacatactgataccgccctcataggtaacatgaagcgggaatttggatttctctttcacgaaacgagatttctcgatgttcatgatgaagtcataaccgacaacttccgtaccttctttcacctgctgtttgcccaggatgatcgcggtgtctgcggaatacatcagaccagtaccaccggaaatgactttcttgctgtacatttcttgtgtgtcgtatgtgtgacagatacacaccattggaatatccagatccgccaggtaaggcgtaaccatacggaacatacctttaagtgctttagcgcgggtcatgtcctgtttgtcgttgtcagacagggcatcagccagttcttttttactcgcggtgttgcctacagagtccacgaaaatgatcactttgtcgccacgttccagcgcgttaagctggctcacaacgtcatttcgaagttgctcaactgtcgtgatacgagtatacaccacacgatctgggtcaacgcccattgatttcaggtaagacttagttacgcctttctctgaatcgtagaacagacacacagcatcctcattcgctttgaggtacgccgcaaccgtcaccagccccagattcgatttaaagtgttttgacgggccagcaaacagagttaagccggaagtcagaccaccatcgaaagcgccggacagcgccaggttcaggatcggtacacgggttcgagttttggtgatgttattgaaaacatcgctttcagatagaattgacgcagattgactattcgagtttttgatcagttttttcaggagtgctttattagacatttatttttccggtttatatacacgcataatattttcctcacaaatttatataaatggggcatttctgccccgtcaggtcttaccagtcatcaccaaacagagtgttcagggatgcgcgtttttcgtaatcaattttacatgcttccgtgatgttttgcaacgggctaatcacatgtttttcaaataatccgccgtagtctacccacttcaaaatatcttcttcgatctcagttggtaaacgcgtaccggattgccatgcaatgcaatcagcttgccacgggtttttatctcgcaacggcagaaccataaccttttcaccttccataatcggggtgattccttgaataccctttgtatggcggttgaagaacagaacgcctttgatgtggtttggtgtccctttgattgggtatccaaaatcatcacgatattttgagatattgttagcagatgatacaccagctatttctcggtagtcaagtgccttatactcttcctcaaatactttgaagtgttcgtgtaaggattcttcaccttcttgcaggatgcgacggatcgcttctttcaagaactttttaaccgctgtcggtgtactactgcgctgggtttccattcccatgatctttaatttaggcttctcgtaacgggttccttcggagtcccacacgttagccgcatatcgtttctttgccgtccagaaactacccagacctttcgatcccagtggtggcccagaaatgatttcgcgatccataaacatcagatgttcgacgttgttcatgtactcacacagttcgcggtagcccttatcaatgataggttccatgcgttctttactgaacttatccaggaaatcaacccaatggttgttatccctgaacttgctttcaccgccgactttcgcgatcacgttatccatacaaacataaatggagtcggtgtcacagtagcgcacgtatgcgtaatccgtggtgttgcacagttcgttaaggtattcgttaaccttacgttcaatccactgaatagccaactgaccgaacatggtgatcgcgcttgcgtttcgaatatcgaagtaccggaagtgttcattacccaacgcaccataaagggagttgatactgattttacggttaagctgtgcggtgtttgcttgtgcgatcttcttctcacaaactttcttcacggctttaagcatttgcttagacagcgttttcagtacagcttttgattcatcactgaaatcttcgtagaactcgaaatcagggttgatcatttgattgtgcgcgtccgtcaggtgttcaagttcgtgcttaatcagttcgagatttcgctcacccgccatcattcgttttttccacgtcttacgctgatcaaatactttcttgatctcgaccggaatcacgcctttaacatcgcgtcggaacatccacccgttaggagagcagctaaattcatcgctagggcgcggcgcagtcttattgatgtattcgtgcatcggacgcactgcaaagctgttagcgattgtctcagggcttatattcacctgtcggatgatagatggatacagactggttaagtcgaacgatacaatgtaacggtatggagcgacaacaggatctttaacgtatgcaccatcatactgcgttttcgtgtggcgtttattttctgggattactttcttctcttcacgcagagagttgtaaatgatcgcgtcccacgttttaagcggagacataaccccagggaagtttattttcgcatagtacgctacagacagaaccagttcgataaagttgcgtttcccgtcgatatccaacacgcggataacgtcaacgatgttatacgtgatgtatttctggtgatccgcttgacgcagttcagacagtgaaccttcgtaatcaactttgtttttgcctgtttcgaactcagcgattgcgcccagagcgtaagacggttgcggggtgaaactgaatttcttatagagatccattccatccatttgagaaacgccgtaaatctcgtatcccagttgttcattcccataatggtcggttgttgtcttcgcagtcactttcccgaacgggctgaaatgacgaacaacgttttgcccgaagatgttcaggtaacgggtgatgatatacgcgatatcgaatttgttcgagttccagcccgtaacaataacaggtgtccgctctttccagtctttgatataagccgacatcagcgacttttcggtctggaatgaacggtaaacaattttcttcaaatcttcttcgctgatctctttttcggtatcaactttcgacgctacccactcgtctaacccgccctcgaccagatcatacacaaagaatttatcttcaacgctgtcatagtgggtgattgcgtcgatagcatattttgcttcgcgtggatcagggaattcaggcgcggtaacttcgatatcaagtgaagcaatgcggatcttgtcgcgatcgtattcgatttcctttctgtaggaatcggagatatacgccagcctgaaatcatccatgcctagcgcttccatgcctacatctttcattcgctgcatccagttttttgcttccttgatgctttcgaagttctttttgatgcaggtcttgccgtaaatgtcgcgatatggcgagtctacacccgccatagcgtgttgaaacattgtaggcgcatattttgttttgcgaacctgttcgcgtccctcagagtcaatgaagcgctcgtagatgtgatcgcccatttgctcaacggatagataaaattcattcattacggttttctttctccgtgtttaatcgtgacaggaatgataccccagccagcttgatcagatcaagcgagcgttgcgctaatttgtgatagcgttgggtgtcaggccgatttagttgttcaaccagcacggtatattcttccatgatgcgggtatagaacttagggaagtgatcccgcgcgtatgcgtaggtgcgcagatcagagagattgcaagtaagagacagtttgatgtcttcgctatgcagacggttgatcaagtgatcaccggattcaatagctttgatgatttcttcaatacgaattttcataatttagtcctcacaagtggtgtacaaccaatataacaaagcccctgcatttctgcaagggcttttgattaatgtccgatccggtacttgtatttcaaagtccattcagctttttgtgcgtgagtcaatacgcggaagttgttctcttcggagaatttcagatccggcgtaaggatggaaaccataccccactcttccagaagtcgcgcaatgttattgcggcgcagttcgtcatcttcggtcatgtcaacctggcgaccgtccagcttcaacagttctttgaagtgtacgataaaataacgcccttgtttctgtaggatgtggcaagactgccacagcattttctttttgttatttgcgatcccgatacgggtcagcgtttcgcgaattttcaggaaactgtcatcgctggacagtttaatttcgagcatgttcatacatcaccatttctttattagttgttcaacctttttctggtcggttttatttttcacaacatcagccaacacagataaagcaactttcatatttttccgcttccactcgtccagtttttcaagctgtttgagttcttcgtaatattccattgctatacgtgtatttacaccgtatcgtttttggagaacatgaaggataactttcatttcgttatcttcggtgagtttagcccacgccccgaaccgcttacctttgcgcaccgtatgcaggtaataatcaaagtgcgcctggtctggtaaaccggaaccgatcatattcatcgtgtatgcaggtatcagcgtttcgatatgctggctcattgcattgtcgatgaaaaacttatcgtatgaatcaagggcagagatccgtaatggtgtcttcccgttgttcagttcttcgagcaccataaacaaggtgttttccttgtctttggtgtactctttcacaagttcttcgatcttgtcccagtctttagaacgccaggccgcttcatgttcgttcagttcttcttcatcgagaaaagcagccagtgacatttttaagcctcccacgcgagggtaagcattaagcccatgaacaggtattgcaggtgaatctctttgttcactgccagcccgtactgtgcgttgttttcgcctactgcctgaatgagtgcaaccttagattcgttggtgacgatcgggtataccgcatccagaagtttagccaggaaagtttcatactcaggcgcgtacttgattgcttcggctcgcagtgctttgaagttcttcgctttaagcccctcaatcactggtgtgatgtccgaaccaacaatctcagacagaataccagcatcaattttgccacgcttagaatagaacccaagagctttaacgatggatcgcgcgtctgggtagtgcttcttaacgaatccggcgatcacctgctggtcatattcgattttctcgatttcgaggataccgaaacaacgtttgatcatttgcttcatcagttcaacgcgttcttccttcgacggggaaccgaacttgactaccggacagcgggagatcagcgcagggtgaatcccgttgatgttgttcgcggtaatgataacagtaacgttcttgctgtacgcttcgataaagctacgcatgtgcttctgtgcttctgccatgccagggcgatcgaattcgtcaatcagaatgattttaccgcctttcttctgcgtcatagaggacgcgtaacgatccagttcgttacggatgaagttcacaccacaatcggaaccgttgacaaacatcacttccgcatcaacttcgttagccagaaccagcgccagcgttgttttacccgtacctggggaatcagaaaccagagtcatgttgtcgatgcgtccagacttgatgaagccgcgcatcgtcgctttatcagcagcagggagaatgcattcatcgatcgtcgtcgggcgatagcgctgatcccatgcgaattcttcgggagactgggagattttgccgtatttggtttcgattaactgtacgttttcactaagttccataatattaccttcaattgattatcaaaaaggggcttaacgccccttgtgtactactttgtttatcttacttgaactggctggttgcttcaagtaccactacatacgcaacgccgttttcggacgagaatttcgcagcgccgcgagaagagatttcaactttgtaatcgctgttgatgaactgcatgttgtcaatcttcatatcgaagttgaacatgttatcaccttcgtaatcgcccacttctacagagaaggttgactggctttctttacttttcgcggtgattaccagcttaccgttgattggctcaacagacaggtcggtcagtttcatcatgcgtgacgctttgatcagtttttcgaaatcgttcgcgctaatctggaaaatcagatccgcaactggcatttccagacgcttcttaggctgtacgattgtggttggatcgcttgaacgctcaacgattttcattttctcaccacgaatgacgatttcgccagtggacagatcgtgagttacttcggcatcagtgcctacaacgttcagcatgttcaggaatgagttcagatcgtagatacctacatcttcgtcaattacgtcagaaatcgttgcttctgcgtaaactacgctgttaatggatttcgtcataatgaacgaaccctttttcagcattacagatgggttgatctgggagaagtttttcaggatgtcgatcgtttgtttagagaatttcatattcaacctatagttttcaattaggcaaaagtgccgttaatcagggattctacaacgcgatccgccgcattgtcaaggaattctttgcttttggattctgtgattttcgtacccgcttcgcgagcgtcgtgaatcagtccggtatgtactgcgcttactgcttcgtcgatccgtttgtaatgctcaaagcgttcagcttgaggcatcgcacggaaaatctctttgatgttttccggcactttacctacccaggatttgcgaacgttgttcagatgcgctacatatacgttttgttctaaattcatatctacctcaaactttcaaaattgggggctttcgcccccgtaagcattacagatccagcagtttatccaggtcgtcatcaccggaaccaccttccaggtcaaacggaggtgtattatcatcttccggtacgcttccgcctacgttcagttgacttacgccaccagattctttagcaccgttggaatggttgccattatcgaagtttttcagttcgttgtcaaatgagttcagttctgaatccagatccacaccagcgcttgcgccagcacccattgcagcaccaccgaatactttggtgaacttcgcggtcagttccgcagttggtttgaactggtctggagcagtgattggacgcagatcgctcataccttcgaagatttctttctgacgcgcttcgtcttcgatgcctttgattgggccaggaacaccaaatttgctgtcgtcgtagttaggccagtcgcctactttcttcgcggtcagggtgaagttagcgccaccaaacggacaggttacagcaacacctggttcatccagatctgggttccccgcgatagccgcagtgattttatccatgatctttttaccgaagcggaacttaaacaccttaccttcgttttctgggtgcattggatctttaaccaccagaatgttcgcccagaacgattgtttacgtccgatcatacccagtgttttttcggcttcgctgcctttcactttcgctttttcgaacagatcgttttcagagatatactgacacacagggcaagcatcgtaatcgccgtgggtagacgggcagttttcgatgaaccactggttattctttttgaatgaatggttgacgatacgcacgaacgccagttcatcatcagatcggttaggcaggaagcggatcaccgcagaaccgtttttctgtgcatcgacaccgagtttccactctttttcatctttctggaagccggatgaacctttcagagcggcgacttgttcttgcagtttggttggatcttgacgtttaaagaatgacatatgttatttctcgtttaagttaattaaggtttgtttcattaagtttcggtattttacgatttcttcgttactgatttcaactaattttctgtatgcgtttagttttttgctaaattcattccagacgaaatccgttgcgatttcatcgtgtttatttatgatgtctaaaaacgagtcgaggatcaagaatgattcataagaaatcaccccagaaagtacgagcttgctgatatacgaggttgatgatttgacgctatactgaaacaccgttgagaggggaatacctttcatgcgggaaaattcatacaggttttttacatcgtccacgaaaatattatcaattcgcctcaacttgcctatgtattgacgataaaacacgatcgtatcttcgtctacatccccgacccagaagtcggggttagctaccatgttggagagaagtataagatatatttctttgaatgtaaacctttcggctaactttttgaaaaaatacttatctcttctcttttcgaacgctttttcagtgatctttatttcccatttgtacttgatcgcgtcatacttcccagcaaagtgatttttcatcaccagatacagtttgtataccgcgatcggtttcaaacgggaattagcgtctgaactgtcaaacggggttttaaatttcacatgaaatcatccagtgtttgcgtcgtcgcgtggtctttagccacagaaggacgcagcagattgtttttaatggcttcgtcgctaatcttgtcgatgatcgctttcggtactgttttggacagcatagcataatcaatgctgttttcgtccatccattgtaacgtagcttccatgtaggttgccccctcagaggcaaccagattttcgatatacaagccgacttcggttttgtttccgatttcgctcatattacgccttatcgatcacatcgtacagttcgataagttcgttgttctgttcttcgaacgcggtacgtgcctgttcgtgatacagtttgaacagcttgccgaaggttttaccgtcgataccataatccgttttcgctttggatttgatgtctttgaaagaaccctggaaatgttcgatctgagttttcacgttcgacgcttctttgatcagttctttaaccgctttagcgatgtctgggttttcttgcagtaattctacactcattttgttacctcaaaagtcacttagtttttcatacatacgggtgagtttgcattccatgaagtatttctccatttttgctttgttcccgatttttggagcattatacgcttcttcgattgccgttgcaacatctttcggaataaaatcaaagtcgcgaagttcttcgttttctctgtatcggatcgcccactcttcgggcatacccacggtcggatcgtccgcttccagccaggcttcgagttcagcagccctgatttgtggggcgcgttctccttcaaccttcgtaacaatatagtcatttcgcattttaatgcaagcgatactatcttttttatcgcccttgatgatcttcatgcgcaaatcgttacgaggtgaaccatatttcggtgtaacccatttcttttgggttggcgaccactgacgcacaccctgatatttttgaagggctgcaaagtcaccatcagcagaaacgatcaggacacgtttaccttcggataccgctttacgcgtcaccacaccgatcacgtcatcggcttctgcgaagtcaacgcggatacctttgtacggtaaattagcacggatttcatcgtatgtcgggtgaaggaaaccattcaggcgatcccagtcccaatcagatgcttcttgttccatttttcgtttctttttgtagtaccaggctttacttctgcgccaatacttgttatcatcaaaggctagaacaatttcagggtactcgcctttgaatttaaccacattgtgacgaatggtgtcaagcactatgtgacgaacaatttgttggttgatgtcattctggtctttcggcttgaagttgttcatcaacgttgctaccgaaaggtttgaaatatctatacacatcacatcaacaggatcatcgtcattgctcattaagctgttcaggttgaacatacttgcaaatgaagacatttcaatacctcgttgttgttgaatgaaactgattatagtgatcactttttcaaagtcaatagatcatttcaaaaatctgagcgaagcgaaggacacgaacgtagtgagtgtctatgtactgaatgtacgttttaatatttttatattttatatatagagaaaacagtacatttccgtatactttttaaccagtttaactatccgtttcgcttcgctcacggaagcgcttcgcgctgattttattaaataatatagattggaagtaggtttgaaacacctgattcaatcggctataatgaatgtattcaatttggagaatataatgactacaaagatttatgcagataatgataagctgtatccagttatgtgtaagtggaaacagcaaatccgtgaaactggtgatcgtaagatgccggatgaactcggtattgcgattatgaacattgctcacggtttggcacgtcgatacaacttcaaccgttattccgaagactggaaaatggatatgatcgacgatggaatttcggcaacgatttccggccttcataactttgatgaaaccaaatatacaaacgtctacggttacatcaacaaggcttgctggcaagcgtttgtaactcgtattctctacgagaagaaagagaacgcgaagaaatacaaatacttcctggaacatgtctatgacagcgatgatactgatatgaccacgatagccgatgaaactttcattcaggatatccatgacaaacttaatcagtatgaagagtccgcgaaaaaacccaaagataaaatcgaggttgtggacgaatcgccaacattggaaatgtttctatgaaaattaaaattgacctgaacaaaattttagcagatgctaacgacgaaattgatctgcttccttaccttgtgaaattagagttgcagaacgtcggggttccgattatcatcgaccctacagatgtacgagatccagacttccagatagcagaaggtcgtctggactatgtaataaacgccgaaacaatgatcatggagatcacctactatgaacgtgcagcatgaagtaatcgacgaagtacaccaaaaatcagcgctggatcttcgtgaagaagaactggaatccatcaagggtacacgcattgaacaggaagccctacgcaaagcacaaaagttcatgcggaagaacaaagcggaatggaagcgactgcataaacacgcagagaacgcactcttcgaaggtaacaaagagcagtacgtatacgcgatcaaaaagatgcgtgatatgctcaagcaaccatacaacgatgaactgattgaaacgatgtggatcacttcgaaccagcagttgaaagacctgttcatcatggcttctgaaaaatacggcaaataaaccccttcgggggttttgaggtttatatgaactatgttttaattggggatacccatgccggacttcgccaggataacccctggaacgaagaaaacctgtatacggtattcaaacagatcgtagagtattgcaaagaacacgggatcacgcgcggcttccatgctggcgacttcttcgacgttcgaaaagcaaccacacaaacgacaatgaattttgttcgtgaaaagctggttcctcttctgattgaggcggggatcactctggatgttcttgtcggcaaccacgattgtcaatttaaggacaaaatacgccccaacgcgccacgcgagatactaagtcaatacgaatgctttaatgtcatcgacgaaccgaccacggttgatttaggtggcggaaattcgattgacctgatcccgtggatttgtcaggaaaacagccagcgtatttttgactacatcaaacaatcgaaagctaacttttgtttgggacacttcgaactgtctggttactatttctacaagaacagcaaagccgatcatgggctggaacctgatttcttgaagaagtacgatcgtgtttactctggacactatcaccacgctaacgagggtgataacgtgttttatatcggtacgcctctgactatgagcgcaaacgacgaagacgaaacacgcggattctatgtgttcacgggcaagcctgaattgactttcatcgctaaccctgtgtgtcaccatcgccggatcatgtatccagcacagaaagatgttgatctcgaacagttccgcaactgcgcggtgcgtctgattgtcagtgaaattgatcaggggcttgcaaagttccaaaccaaaattgaagaaattgcctatgaaatcaatatcatagacaaagttcaaacagattcggatgtcgataccgactttgaaatcaaaaccgttcgtggccttatcactgagtatatcgccaacatgcagatcaccgacgatgaaaaagaggaagtgaataagctgatcagcgaactatacgcggaggtgtcaagtgcatagccgttatgatgaatatttcggggaaaatccccgatattctcacctgttgcgtatgttgggaatgaaacacatcatttccacatccgacgaagcaggggaaaccagcgcagtttgtttgaccatcatgaagggtgcatggcattcatcacgaacatggtcaatattcatgcttgatacactggacgacgatactctatcatatagtattgattcatcagttgttcaaatgatcactgaattatgtgaacggattttaaatgaaactaaacttcaaaaaaattaagtatcaaaatattctgtcggttgggaacaccccgatcgaactggaatttgatacggcaaagaaaaccctgatcacggggaaaaacggtggcggtaaatcgacactgatcgaggcgttaacctatgccctgttcggtaagtcattccgcgatctaaaagtcgggcagttggtgaacagcgtcaacaaaaagaaatgcctggttgaactggaaatcgaatacgggaaagactcgtacaaagtggtgcgcggacaaaagccgaaggtattcgagatctggaagaacggcgagaagttgccggaagactccgcagcgggtgattatcaggcacagcttgaatctatgctgaacatcaaccttgtgggcttcaaacaggttatcgttctgggtacagcgggttacactccattcatggaactgaaaacccccgaacgccggaaactggttgaagatttgctgtctctgtccgtcatcagtgaaatggacaagttaaacaagtcatacattcgcggtgttaatcagcagttggatacactctcaatgcagggtaatcacatccagcagcagatcgcaacacaccagcgcttcattgacgaacagcgagcgaaagcaaaccagaacaacgcccgatacaaagagatctacgatagccacgtagaaaccgcaaagaacatcaaagcacagcttatgcagttgcaagcggagattgcggaatcggtgatcactggagaagaccggacggaagatatcaacaaactccgtgacggttattctcggctctcaatgactgtagaacagtttaaaaagctggaggtgatgtatcagaaaggcggtgagtgtccggcctgtaagcaagcgattaaacccactcctgagcgtatggcggagatcgcagagaacatcaaagcgggtacacagcgtttaaccctgatcaaaaccaaacaggacgagttacaagggatcatgaatgacttgcttcaacagcaacgcgcactcaatgccctgaaaaccaaatatgaagccctgaaaggtacactgcaaaacgaagttgccaacgctaaacgcgcacaggcgatcatggaacaggcaagcgcggaagtagtcattgatgaagaacccgtgaagcagttgcaacagcaggaagcagaactgaacgaaaaacgacaaggctacgtcaaggaaaaatatattcgtggtattgttacggatatgttgaaagattccggcgttaaagcgagcatcgttaagcgttatattccgtacttcaacaaacagatagcatattatctggatctgttgggtgctgattatcagttcactttagatgacgagttcaacgaatcgatcaaatcactggggcgcgatgatttcagttatgcgtcattcagtcaaggcgaacgcgctcgcatcaacttgtctattctgttcacatggcgtgacgtgacaagtaaagtatcaggcgtggatctgtctctgctggtacttgatgaatgtttcgacggcccccttgacaaagacggctcttttgctgtaaaaggattgcttgatggtgttaacgggaatttgattgtgataagtcatcaggatttagatccagaagattttgaccgacacatcgttatgtcgaaggtcggtcgattctcgaagatggaaatcaagaagtcttaaacttgcagttgtcaaaatgccatcgtttcatattggtggcatcaccaactttagcgcaatgggggcaagttaattgctcccttttcttttgtgtttttctgtctgggttctgagtacaatatggaatatgactgttcaagtaatgcactgtcgattctgtaccgcaatgaggacaagaaccgcgctccgatactacgttgctgtttttatgtgctcgcatgactcctgcaaatgcattcactttcccttcattgcctggcttgtgcttgcagttgtcgaagtgccagcggttcatattacctactaagccggacgtattgcaatgaggacacgtaaccctgttctgttgaagtttggcctgtctcatgcgtaagcgtgtctcttcgctgaactctttttgtttctgggcttcaagtgctttctctttcaaccatccatagcggcggtttgctgtacgcgcagacgatcgagaagtaccgactgtaagcatgttagcagcataaattagtttatggttgcctggatacatcttaactaatagcagatgtgctatgaagtgttgacgtgctgacagttcaaccagattttcgggatcgtccgatcctcccatacattttggaacgatgtgatgtttctctttgtattctgcatccgttccggtagtcatgagttgttcgtaaatcttatgataattcatgatgataaatcctgtttgatagtccgctagatacccctatttaggaacatgattatgttagaaagagagtttgaactgataacaaccccagaaattgagaggttttatctccacaacgagttacacgaaacgaaacatgtagttacaatggcagatgttgaggaagcattcaaggataaccccattgaattgacccgcatcaagaacaataaatcttcggtgtggttcctcgaaaaaatctattgacagcaaaacataaataccttaaagttgcccgtgtactgagttacatgggcttttattttgaggaacggaaaatgattaacgaacaaatgtcacacagcgaagcattgaagattttgggcgctactggcgacgaatctaaagctgaactgtcaaaactctttaaacgtgcttctctgcgcaatcaccccgatcgtggtggtagcactgaactcatgcagaaaatcaaccaggcgtatgacgttgtaaccaaaacaaacagcgctggtaaaacttacagtgatgttcgcgcagaacacgcagcaaacaaaaaagcatgggaagaaaaatttgcagcgtatttcgtggttgcgaaaaactatttcagcacgaaattcaacgcgcaagagttcgcggaatacttcacgaaattcaccggacaaccaacaacctatactcagtcaatcagcgaagttcgcggtcatactgttcacgcaacctatcgtttcacttctggtgatgcgttctttgacttctctttctcttgtcaaccgcctaacggtcaaggtttagcagcgccggacgcgtccgcactgggtagcgtatcagttaatactctggttctggttggtacgaagaaacacaaaatggcaagccgtgattaccaatggggcaagaacccagacaaaatcacgccggaaagcctgttccctactaagaaactggaatccatctttagcccgactaagaaggatctcaagttcaaacgcgcggactacatgacatcctttgcccgtatcctgggtgcgaaggttagcggtaacgatgttattgttgatgttggacactataaagttcacttctaccgtcacgtattcatgcgtaaaggcgcgtatgtgttccagtatgttgttgacccaactgtgaacaaattcaaacctgctgaacgtctgaaaggtactatgctggaagacgaagacggcgcgtgtttggatatgatcatcgacactttcaaagaaatgcagaaagtgaaaccagacgcaagcggcatcgcagcggtaatcgaccggatgaacgcagagtttgcagcggggcatcgttcagcatcttttgttaaacgtaccgcacagcaagcagcagcgccagcgccggaagagaaaccaaaacgcaccgttaaccgcatcaataaagatgactatttcaacgcactgaaacaggcgggggcaacattccgcagtaactacggtgagtttgataacggcgcgggtttgactttccacttcaaacgcgagatcagcaaccgtaaaggtttctggagtttcagcagctttgatttcatgcactccggtcagaaacatgttgaatggttgaaagatatcgacattgacgaggatagcaaaggcgcaagtatcggtttgttggttgataccctgaaacaacttcgtggtgttgctgactggtacacagcccgtaagatcctggaaggtatgcgtgataacttcaaggctggtaaattctccgcacctcatgtgaagaaagaagccgaacagaaacgcactgaaacgcaagctaaggacgagttaggcgcacagcctacgaaaccacaggcagcgaagaaagaatccccagcggttgataaggcgcatcaggcacagatggatcgtgagaaatcacagatgaatgcaaccattcgttctatgctctctgccctggttaaagccggacgcaaagacacgccggaagaaattaaaaaagcagttgatgaagcaatcgctctttggcgcttgaaacactaactgattatgctataatgggaactgttgaaaagcagttccctttttttatgaggtgagtatgattattcaggtatcggttcagggcaacaccctgacagtaacaaattccattatgaccgctatggctgcatgtcgtgatcatgtgatgtcaaaccctccggtaacggaaattctggaaattgatgtatgggaagacggtgtgatcgaagaatcatttggtttcactccgttagaggaagatttacgtaaaatggaacaatggctatggcaaactgtaccccaatgaaactaccaaaacacacaaccctgttaacccgcgaaaaacttcattctgttgaatggagtccgttagatgtgatggttttcgatctggaatccaaaatcattaacgcgcatgttaacggattgagtatcttttctgttgaatttgaaaagattcgcgggtacaatgaagcctgtaaagacaaattgcgcgtcatggttgaagctatgggctacatcgtgactattgaagacaacaaaatgtggatcgcgctatgagcaaagtaaaagcagttttcgccgttggtcatgatatgtacgaagtggactatgcgtttggttatgaacagggtttaccgtggggccactgcaaagaggatttgcagaacttcaaagcagaaaccgcagatagcgtcctgatcatgggtgcgaacacttttacttctcttcctggtaaattgccaggacgaattcactgcgttatgtctgcatccggtcaacgtctggtaacaaagaacgggaataccgctgattatgtcatccacggtggcgggttgtctgctgcaatcgacgtaatgaaagaaacgcatccagatcgtgatgtgtgtctcattggtggtaagtggttgcttctgcaagcaatcaataatacaatggttgatgaagtggttgtgacgcacatttacggacatcatgtatataatgcaccagcttttaaacgtgatgtttcattcacggttcctgaattctgtgaagcggttctgaaatatgaactgactgatttcaaaattcagcagatcgaatcaaacgaacgcgtcagaaaaattatcgtcgatcgacatacgaaaaaggcataaaatgaaacaatatcttgatatcgtcaacaccgttctaacacacggtactgaatcaaccgatcgtactggtgttggtacactgcgcatcttcgggatgcaagcacgttggaacctcgcagaaggtttcccagctactaccagcaaacagctattcttcaaaccgtgtaagcatgaattacaatggttcctcgaaggttctaccaacgtggaaacactgcgtaaaatgacgtggggtgaagatagcgataagcggacgatctgggacgataactacgaaaatcaggctaaagcgctgggttatacgcatggttatctgggaccgatctacgggcatcaatggcgctcatttggtgcggaaggttcttattatggtgttgaccagattaagaaagtcatcgaacaactgaaaaccacaccagacgatcgcgggatcatcgtttctgcctggaacccgatggatctggatgatatggctttgcgtccgtgtcactgtttcttccagttcgtcgtaatcaacggtaaactgtctctacagtggtatcagcgttcagttgatgtcttcttagggttgccgttcaatatcgcctcctacgctctcctgacgcatattatcgcggatatttgcgggtatgaagtgggtgatctggtttggactggcggtgatgtccatatctacaaaaacgcagtagaacaagcgaaagagttgttgaagccggaacgcgcaccgcttccacttccgaccctttatatgccgaaggtaaatagcttacttgatttggatcaagaattctttgactccatccatttgaaagactataatcaccacggctcgctaaaagcagctatggcagtataaacaaagggggcgaaagcccctttcttaacaaggtaagataatgagtgatattaaaacagtagtgaagtcttctggcgtaagtcaaacgttcgaaaaagaaaaactgttcaaagtccttaattgggcgagtattggaagaaatattgatgttaacgcattccttgaaagtgtcgttgacctgcttcgtgatggtatgactaccaaacagatccaggctgtagcgatcaagtatgcagcggatcgaatctccgcaaaagaacctgactggcagtatgtagcggctaacctcgaaatgttcgcccttcgtaaaaccgtttacgggcagtttgacccgattccgttctacgaacacatcactaagctggttgaggctggaaaatacgataaagaaatcctgacaaaatggactccagcggagattgattatctggaatcgaaaatcaatcacgataaagattttgaattctcgtatgctggcgttcagcagttgatcgggaaatatctgttacaggatcgcacgtccggcgacatctacgaaacaccacagtatgcattcatgctgatcgcgatgtgtctgcatcaggacgaaaaacacgctgataaaatcagtcatgttgttgacttctataacgtgatttcggatcgtaaactgtcattacctacgcctattatggcgggtgtgcgtactcctacgcgtcagttctccagttgtgttgtaatcgaatccggtgattctctgggttctctgaacgctgttacgtccgcgatcgtgaagtatatctctcaacgtgcgggtatcggtgtcaacgccggacacattcgcgctatgggttcaaaaatccgtggtggtgaagcagtccatacaggcgttatcccgttctggaaacacattcagacggcggttaaatcctgttcacagggtggtgttcgtggtggtgcagcaaccctgtattatccgatctggcatcttgaagttgaaaacctgctggttctgaaaaataaccgtggcgttgaagaaaaccgtattcgtcaccttgactatggcgtacagcttaacgatttgatgtataagcgtttaatcaataacgattacatcaccctgttcagccctgacgttgcgaatgatcgcctctatgacgcattctatcaagcggatcagagtgagttcgaagaactgtataccagtctggaaaaagacccaacggtacgcaagaaacgtattaaagcggtagatctgttccagttgcttgttcaggaacgcgcacagaccggacgcaaatacattttcaacagtcatcacgtaaaccagcagggtagtttctctgttccggttcgtatgtcgaacctgtgctgtgaaatcgcgatcccaacttcaccgctggacgacgatgataaactggctggcgaaattggactgtgtacgcttatggcgatcgttctcgataatgccgatataagcgaattcccagcccttacacgcatcgcagtacgcgcactggataacttgctggattaccagaactaccctgttgcggcggctctgaaagccaaacagcgtcgttctctgggtgtgggtatcaccaactatgcatcatggctggcaagcaactattgcgactactccgaagcatacgccggaaacgttcatgagttgatggaagcgtttcaatttaacctgctggttgcctctatggaactcgcacaggaacgcggtgcatgtggactgttccacgaaacgaaatatgcacaagggctgttgcctattgactggtactgcaaaagcgttgatgaactggcatcacctgtgtataactgcgattgggaatggttgcgcggtgaaattaaaaaacacggcttgcgtaactcaacactttctgctttaatgccttgtgaaagtagctcgcaggtgagtaactcaaccaacgggattgaacctccgcgcggccctgtgagtgtgaaatcttcgaaagaaggttcattcaatcaggtagtaccaaaccagaataatcagattgacttctatgattatctctggacaatggcaaaacgtggaaacaaaggttatctgtcgcacgtagcggttatgcagaagtttgttgatcaggctatctctgcaaacaccaactatgatccggctaacttcccagatggtaaagtgaaatctgaaatcatccttgaagatctgctgtatgcaaactatttcggcatcaaaacgctgtactaccacaacacccgcgacggtgcaggtgaggaagaagcggaagattgcgaaggttgcaaaatttgattcaatgccccttcgggggctttttataaggtaaatccatgttaactgtaatgaacacaaacccagatcacaaacacttagaacagcctatgttctttggtgaggatacgggcgtagcacgatacgaagaacagaaacaccgtgtattcgaaaccctgactgaaaaacaactgtcattcttctggcgaccggaagaagtggatctgtctatcgaccgtatgcagtacgcgaaaatgccggaacacgaaaaaatcattttcgattcgaacctgcaatatcaaaccctgctggataccattcaggggcgcggcccgaacctggcgttcctccctatcgcttccgatgtctcaatggaaacgtggatcgaaacatgggcgttcagtgaaacaatccatagccgcagttatacgcacattcagcgcaacctacacatcgacccgtcgaaagagttcgataaaattctgcgcaacgaagcgatcatgaaacgttcggcttccatgacaaaatactacgatgatctgatcgcagaatgtcacgaactgaaaaacattgtgctcaaaatcgaaatgttaacgtcccacggatatccagacgaatcgatcgcagagtacgagaagaaacgcaaagagcaaatgcgtaaatgcaaaatcgctctgtatctgtgtatgcacgctgtcaacgctctggaagcgatccgcttctatgtgtcgtttaccttcacgttcaactttgccgaacaaggcaagatggaaggtaacgcaaagatcatgcgtctgattgcccgtgatgaagcacttcatcagaaaggcactcaaagcaagatccgactctggcagatgggtaaagatgacccagaaatggcggaaatcgcttaccagtacgaagaggaagcgacaaagattttcctggaagtatatgaacaggaaaaagaatgggctgaacaccttttctctatcggtgatgtagacggcgtatccctgaaaagtacgatcgcctatatcgaacacctgacagatcagcgtatgcgcgcggttggcttgcagtctccatttaaaccaacgccgaacccgtatccgtggatgaacaaatggttgaagtctgacaacgtacaggtagccccacaggaagtagaagtgagttcttacctggttggcaacctcaacaccgagatcagcgacgaagcctatgcaaaatggcgacaaaaatacgcgtaaggacataacatgattgatgcgattcccgtttatacgggagtccatcacaatctatacgcatacctggcgggttgtgttgattgtgatggatggattagtgaaaaaggaaagaatggttatctggttgggcttacacagcatattcaactatgggatgatatggttagcattcaatctgatttgattaacgatggtgttgatgcaaaattatatgaaagaaccagtagaacaggattaggtaatacgttgatgtgcaacctaattattcaaaaatcatcggatctcttgattctgttaccgagaatcattccataccttcgatttaaaaagcaaaaagcagttgacgcatattttaatttgtgtaaacattcagatcttaatgcaagttcatccgataatgatatgaaaggaagtaaacgaaagtattggaagccggaagaaatatccgaactaattcgtttacattcggagggttacaacaacccagcgatagggattaaaatgaatcgttctaccgattcaataagtcataagttgcatcggttgggtatcatgagaaacgaatgatggaatcgaaagtttatagaatgtctcttgacaaatgcggtcgaatagaccgcagttttatcaagtgtggtgagttaagaaattgcgtttactgtattgaaatcgacggcgtgatcgtgtatgttggtaaagcaaaagacatgtggaagcgattagatacgtacaggaattcaaaatactggagggaagcaaaccccagcaacattttgaaaaccgcacgtctggaaatggcaatcaaaaaacgtaagcgtgtgaatctcattgtgacaacacacgacgaaaacacatatcataattttgaaataaacatgatccgaaaaattaatcctgaatggaataaacagcactatgacaaagctaaccaaaaaccagaaaacactcttcaaccaattaatgaagttgtgtaacgaaaccgaatgcttttactttattgaccaaaaaaccgtaatgcaaacccacgttcgcattttcaactatcgtatggcaagttacagcgattggttgaaacctggtgcgctggaatgtcgcggcattatgtttgcaatggatggggaaacccccgtaaaactcgccagtcgccctatggagaagtttttcaactatgccgaggtaaaggcatgggaagcgctgaaagcctctcctgtgacgattggtgaaaccgtagtggatgtgatgattaaggaagatggttccctgatctccaccttctgtgattccggctatctgggcgttaagtctaaagcatccgttcaatctgaacaggctatggacgctatgagcgtgatccagactaaccgcgcattgttcgaccgcctgaccgaactggttaacgatggtttcaccgtcaacatggaatacgtcgcaccgacaaaccgtattgtaattggctatcaggaaccagcagtggtgatcctgaacatccgtaataacgacacgggcgaatatgttgattatcaggatatcttcgcagatggtgtattacgtccgttcctggttgagcgcgagaaaatcgaaatcaccgatctggatgcattcattaccgaagcctacacgaaagaaggtttcgagggttacgtaatcaaaactgataaaggttttgtgaaagcgaaaaccaactggtatgtaaaccttcaccgcacgaaggatagcatcaacaataacaaagatctgttcttaaatattgttgaaaataccgtcgatgacctgaaacaaatgttcctcgatgatatgtacgcactcaagaaaattgacgcattcgaaacgttattccttgatagtctcaatcgtctgactgcaaaagcattccaggcaatcgaagacacgaaaggaaaatcacgcaaagactacgcgatcgccctgagcgctgacttaacccctgacggtcgtatcatcttcgggcctatgatgcgttatttcgatgataccgataagcaaaagctggttgataacatcgttgcattaatggcgaagaactacgaacagtttataccggaagaatataaatgacaaagtgctttggcgctggaagcacaacgttagaagaagagaaagcagggatcgattccctgcttctttacgttgacgttttcccagaaaccggaaaaattttttggaataacaatgcagcaaaacagaatcagggaaaagaagctggttctattatgagcaaatcaaaaccttacgtgagaattcggcacggcgatagaaaatatttaagacatcgcataattttctattactgtaatggttatctgcctttgcttattgatcataagcatgggttggaagctggggatggtatagaaaatctacaggaatcagatccgcttcataatatgctgaaaagaaaagctaaatcaacacctaaaacggttaaatccaaaggtgttgattacagggcttcgcgtggaaaatatcgagcacagataaagatagacgggaagcaaaaacacatcggttactatgataccgaggaacaagcatcaatagcttacgaggaagcgttatatgaatatcaaaaacgtattgggtacgtttaatataagttcgtggatatggcctgtaatagttgctggttcgttagcagggcttttgtacatgacaatcacgctgaaaagtgaaaacgatcaattggctaaagatatcaaagagttacaggctgatatcaaaaaagtcaaagagacaaacaacaccaatacggtgatctatgtcgaacagaaagcgaaggatcagcagttggtcaaggatgccggacgtaaagatctgctgttcaagaaaccaggactgatcgaaatcaagatcaacaagtccttcgaagagtatatggcggagtacgacaaatgaaaattgcaacgttagcccttgttctgggcgttctgttggtcgggtgtgctgagaagcccccagaaaagattttgcctacgctccccgctaaggtgaatccggtgaatgtgaaatggaaagtggttgcagaagtccgagagattgacggtaaaaaataccttgtcatgccttatgacggaaacccatacgttgccctttcatatcccgattcgttaatcttccgtagctggatgaatgacgttaagcgtcagaaagaccagacagataacattctgtgtaccgtgggataccctgagaaatgcaagtcaaaataatcaagtcatttttccgtgacataaccgaaggaaaggtttatgatgcgaagaaggacaaagaaggtctctggatcgaaaatgactggaaccgtgatatgtggctcaatctaacgaatgagcataacaaagaactgattgaatatgagattgtgaaatgaatctgtttattactgtaggcgtaccaggtagcgggaaaactacatgggcgaaagaaaaagcgcgtcaactggggaacactctgactgtttcccgtgacgatatccgcaaaaccctttattgtgctggcggtgatctcactggctatcgcttcaccgaagagaaagaactgtttgtttgccgtgtgcaagaagatacagttcgtaatgccctggcgagtgggaagaacgttatcgttcacaatacccatttacaccaaaaagatcatgatgtgtggcgagagatcgcgaaagagttcaatgctgatttccatatcgaatggattgatgccgatatcgtagaactcctgaaacgcaaccataaacgcggtgtgaatgctctacctgtttcccgtgtctgggcgatgttcgaacagtaccgtaaactccgtggctgggttccggctatgagctatgcagatccgagcaaaccgaaatgcgttatcttcgacgttgacgggacattaaccaaagttggacaacgtagcccgtatgacttcacgaaggttatcaacgatccgcctaaccctcctgttcaagaactgttcaggatgtataaggccgctggttatgcctgtgttgttgtgtctgggcgtgagggtactgcacagtgcgcacatgataccgctgcaagcctgatcggatacgatgttgacctgagcgatggtatctacatgcgcgaagaaggtgatcatcgtcacgatattcacgtaaaagagcaaatacttgttgaaaagattctcgataagtattatcctgttcttgcagtggacgacagggatacaccagtcgggatgtggcgaatgaacggtatcccatgtttccaggttgattacggcgacttctaaaaaacagttgacagtgagtgcgggtgtgataagatacccgcacaaacaaaggagaatattatggttattcgtgaaaatgaaaatgtgatggttgaactgggtgatcgtgttaaagttgagaatcctgttgaacttcaactgaaactcaaccagttaggccagcgcattgctgataaaattcctgctggttatacagtgaagattgtccgcgatggtcagttctccttccttctgggtattttgagtcaacgtaacatcgttgaacagcagttcgggattcagtggaatccggtaactaaattcgtaacatgggcgggggtattatgagcgacaaaatcagaaagattcatcaggcatggttatgtactgaaccaacgatgcttcgttatggttgtgtgtttgggttggttgataatgatcctcaacaggacattgcaacaagtccggttgttgaatatgcgattccgtcgaacaaatcgtttgttgaagtagtgacacgttcaggtactacgtatcacatcgttaaccctgataacgatttcatcaaagacattctgaaatatatggatgaccgatgaaactacttcacatgatccgtgctattcaacacagccaggcttctcgatgcatatcgacccgtgttggtgcggttatagtaatgaacgggcgtgtggtttcgcagggttcgaataatacggttgattctgattgccgttgtgctgatcataacgagcatatgctgaatgacgaaggtaaactgaaagcggttcaccgtcctgagcattcagcatggtcaaacgataatgagatccacgctgaaatgaaagcgttgctaagtgcgcatactaatggtattatgcttaacaacgcagagttgtacacaaccgcttcgccgtgtccaaactgcgcaaaacatatcgaatggtatgcggcaataggcgctatcaaagcggtgtattacctcgataaatacgatcgtggtaatgatgaatggatttcacgcttacagaaatatggctgtatcgtggaacaaattaaacgggaagagttagaacctcatgttaacttttccagattagtgtttaacaacaatgagtaaagaaatgtctgaactgaaagtaaaagcatccggcgaatatgtgatcatcgaagctactgcgcgtccgcagggttccgaaatcaaatctgaatctggcatcgtggttggtgtacgccagcacggggaacaacctttctatggtaaagttgtttctgtaggcgcagatgttccagaagaagtggcagaacgtatcctgggtaaatatatcccgctgccaagcgctcacatggcgaatgttcctgaccctgatctggttgcgggttacatttccgaaaaagaagcaaaagagaaggaaacgaaatacgtttccgcacattacaaagcaatccaggcaatctacgagatctaaaaatggctaaatcaattcaagcaattatcgctgatactgtcagcaagtccaaaaaactgttcgacaaaggcgaaattctggaagcccccgcgcgtattgacgtaatggcagcaatgatcattgacgcgcatcagggtaaactgaaatcccgtgccgatgaagtcatggcgtacatcgtccagttcgaagacgtatgtaaatacgcgaaagatgttgacccgctggttcgcgaaatttatcgcaagcagttctaaaaattccggccctttagctcaataggttagagcgagcgactcataatcgcgtggttactggttcgagtccagtaggggccaccaaatacgcaggtatagttcaattggtagaatatctggcttccatccagaatgttgagggttcgagtccctttacctgctccaattcgggtgcgtagcgcaatgccgttaaatggttcggaatatgcaacctttctcacggagaaggctctgttggtatccggtaataggttccccggaatgcggggtgaagtaaagaaacttccagcccacaaatttaaaagagaaaaaatatgaaaggtctccaaaagctgtttgagttaaccccaaaaattcgcgaaatcgtcgctgcatcaactgaaaaagaaatcaacggtaaattgatgaaactgtttaccgaagaaatcactgatttcgataaagaatatcgtaaagcgttcgatgcgtattctgttgatggtttctttgcatcaccgcaggtgaatagcaaacatgaatatcatcgacgattctttgactggtcgatcgtcaatatcgttcgtcgaactgatatcgaacctacgaaccatcagttgatctctatggattcttctgtgttctttatccagtatcttattactggtggatttaaagcagaaggtattccgttctgcaacgaagctctggaagaagaattcgcagaagcgtataagtatatcaaagcagttcgttaatcaacaggctatcttcggatagccttttttctggagaagcacatgcgctttttaaaatacgcaagctggtttgtactggttccccttgatattctttctggtgttctggctattctgctggctccttttgtggttccgttctacagtgaagaaaccggacacttacctaaagggttccgttggatggaaacattcgataacccgatcgatggtgatggtggacatatccggcgttgggctaacatccggtatcacttaggcgatctgggtgtgtatgcgcaacgtgtaggctggttgtggcgtaacaaggcgtacaacttcgcttatcacgtcttagggcgtgaagcacaatcagacttcgcctggaagggcaacccgaaaacagaaggtggttccgatccttcgcgtcacggttatctgttgatgtggaatgattcggcatgggggctttatgtcttcaagccgtggcttaaagtcggaaaggttcagttctgcttacgcgtgtattgcgggtggaaactgaaacaggaagtaactgaccctaacgggctggatcgtgcaatgctggcgttccatatcaacccgttacgttattatgtcgtagaaaggtaatacaatgaaagcatatcagattttagaaggtttacacactggtacaatctacctggaagaaggtaatgatgttcgtgtgttggtatccaaaaccctcgaaatggattcagtgatcggtaaagctcgcgttgctccattcgcaaaacgtgaagtcgatattgaatttcaacccactgttaaagtggaaggtggacaacacttaaacgtaaacgtgttgcgccgcgaaactctggaagatgctgtgaagcatccagaaaaatacccgcagttaacgatccgtgtgtccggctatgcagtgcgtttcaattcactgactcctgaacaacagcgcgacgttatcgcccgaacctttacagagagtctataatggcgattgaagacgtacagggctataagccccattcgaaagaaaagatcgacaaagtaaaccgcatcaaggccgcagaagttgccctgggcgaaatcttcaaagaactggatgaagagtattcaagtgattacgcggtatcagataccaattcattcactacagaagaactcgatgcgatgcttgaacgtatccatcaaatccaaaaggcgaaagaccgactgaaagaagcctctatgtgggcgtgtcgtgcggtgttccagcccgaagaaaagtattaaaaatcaagccgttgccgaaaggtagcggcttttttgtttttatgcaaaataatgcttgcgctgaatcgtgagtgtggtaaagtacacacatcgaaacgaaactgaggatgacattatgaaaacttacaacatgaaagaactggtttgcttcaacactcgtcgtgaagcccgtgcgtatgttctggctgctggtaagaatacctctgctgtaatcgacctgggtactgataaagctgttggcgcacgttgggctgctgttgtggttatcgctgctcctgtgactcctgttaaaactctggttctgggtgcgcgtaaagccgaaactctgaaaaccagcacttgcggggcgggtggtgttcataatgttacggtcattcgaaaaagatcttttaatcgagtcggtgtatgaaggtatacggggaaaacagaaagaacaatctccgaagagattgatgtaatcaatgaatttctatgtagaccatacgttaagagagttattatgaatattggtagtggtgattcatacccatcatgcgcattgagcaacttcgccccgcatccgtttacgtttgacggggtagaatgtgcatcaatggagggctttttacaaagtctgaaattcagcaatccagatatgcaagcgcatgtgtgtacgctggttggtaaagccgccaagttcaaaggcaagaaaaagaaatggtatcgcgatcagaccctatactggaagggtatgccgattcaccgtgaatcagaagcgtatcaaatcctgattgaaaacgcgtacaatgctcttttcctgaatgacgggttccgccgtgcgctggctgcaaccggaaaaagtaccttgactcattcaatgggaaagaataagatgaatgaaactgtgctcactgaacgtgagtttgtccgaaatttaacccgattgagagatctgttatgataggttataaagattatgatgaaagagtagaatgcgcgttcctgttcaaaggcgcgattaacccgttggcattactccacgcacagggtgctttgagttctaccctgattattggtgttatctacaaagcgggtgtgtattacgttaccatcggcgcgaacaacattaacgtgatcaacagctacgttgaaaaatgtaagctgaaagatattgtgttcgataaagtcgaaatggatgttcctggcttcgacgctgtttatatgtacaagggttgatgatgggttacgtggtttatttcgattgttcggatcttgatccgttcgttctgcaacaagcaaagaaatatcatcaagatatcactggtatcagtgtcacgaacgatgatatgctgtgtatcgaatttgattattatcgtacatttgagcgtgacaaattccttgcggatattgaagcgtttaagagtacccttttctttgatcgttatgaggttaaatcttgaaaccagttattcttaccgacattgacgggatcgccgtaaaatggcaaagcggcctcccgttctttttgtcaaaacacaacatgccgaccgatatcgcgctggatatggttacggatgaaaagttccgtgatatgaccgaaatctttgggtgtgatcaccaactggctaaaatcctcatggaagaatacaataacagttcgtttattcgctatctaagcgcgtatgacgatgcgttgattgtgatcaaccgtctgaaagtcaaatatgatttcgtggctgtcacggcgctgggaaccactcctacggcaagccttaaccgtattgcaaacctgaacacgctgttcccttctgcattcaaagaagtgatggttgtcgggcatggtgaaaccaaagtacaccgctacctggaagcgaaagccaaatatggcaatcgtctggtttgcttcgttgatgatcttgcggtaaacttaaacgaatgtcataacgtcatcagtcagttgccgttattccatatgttgcgtggtgaacgtgaaaccccgtggtcgcctcaccagtcagttaaatcatggtttgaaatcgaagagaaattaaatgatcttacagattctaaatgaactcgcttcgactctgaaaatctcagagaaggaagcgatcctgaaacgtaatgcaggtaatgatctgctgaaagagattttccgcattacgtacacgaaacagattatgtttcacattaagaagtttccgcaggtggacggtaagccaggcacaaccccgctatcgaatgctatcgcggatttgatgtctgatttggcaacgcgaaaatatacgggcaacgcagcccgtgatcgtctgctggatatcgtatcatcggtgaacgagaatgatcgcgaagtgcttcgccgtatcattaaccgcgatctggaatgtggtgctggtacaacgttaccgaaccgcgtatggaagaaactcattccagaacagcctcaatgcctcgctacgccgtttagtgagaaagccttaaaacgtattcgcttccctgcttactcgcagcttaaagccgatggtgcgcgttgtatgtccgatctgttagagaatcagatccgcaaagcaacccgcgcgggaaatgagtatgaaggtttggtgaatctggacaaggatctgaaaaagattcgtgaatatctgggttatgatgttgtacttgatggagaactgatttatgtccctgctgaaaaaactgctgtcgttccttcaaacagcgttccatttagtcttgctgggtttatgggcgatgacgacgattctgtttctgaccttgtggcagatgttaggcgggaagctaccgagaacgagacacaagcggaagcgaaacgcgaagagggcaacgggattgtaaacaaatccctgaaaggtactatcagcgacgaagaacagcgcaatatcgtttatgttgtctgggatatcgtaccgtatgaagtatactatggcgatgctccgagtgttcaaccatattgcgatcgtttctctatcctggaaggtgcgctggctggctctggtgtaacatcggttaagttgatcccttctatcctggtgcagaactacgcggaagcgaaaaaggattacaacaattaccgcaatgacggtaaagagggttcaatcctgaaaaacgttgatttcaaatggaaggattcacgcgttgcggatcaggtgaagttgaagaacaaaaccccgattgaactgcgaatcatcgacgtgtacgaacacaccaaagaagctcataaggtcggagggttcgtggttgaggacttatcaggagaagccagaacaaacacaggttccggtctgactgatacggactaccgatacgatgaagacggtattaaccgcgtgtacatcccgttagaagaacgtggtgaactggatcgcgaatacatcatggcgaacaaagatgactatatcggcgctatcgtcgaaatggaagttgacggactccagaagtctaaaacgcgtaagaagggcgaacctgagttcagtttcttcttgccaatcatcaagaagatccgacgcgataagaccgaaccggatgatattcacgttatcttcgctgatctgttttaaatagcactttttgctaaaaagccccttgcatgagtaaggggcttttgttatattacaaacatcgaaacgaaacagacaaaaggaacatcccatgcaaatcactaaagaactcgaaggcaaagtaatcgttctggtaaatgaagaccgtttggcacaactgggtaacggtggtgaaaaactgccagcagacgcactcgaaagcctttctaaaatgcgcgtgatgcgtgttactgacggttgggttacttgtctgcctctgaacgacgaagacaaagccgtatacgatgcacaagcggattcatgggatatcgaagtacctctggtaaacatcgaagttgaagagtgctacgaaatcgaaaaataatgcttgcttactgggtaatgtagtggtacattacccatatcgaaacgaaaggagaaacatcatgaaaattatgcacactgcaaatcaacttcaaaacggcaactacgctatccacgatgctatcggtgcgctggttggggtttatcttcatggtatcaaactccttgaagtaagtgggaataccttttatggtgttgaaaacatcgaagcagcgatggaaattatcggtgacctgaaatgagtaagaaactcgaaatattcgaaactatcagcgaagaccctaatcatcgctggtgctgtgcgaaaactggttttgatgctgcatggggtgatactccagaacaggcgcgtaaaaactgggaacaccaacaattgttttttgcctgtcgggttcctaccaattatgaggggagtcaattgttagcatgaaaaataaagaatatgacccaatagaagttaaagagcggttatcggtagcaagaagattccttgaatctatcgaccctgataaacttggaaaatgccctgatacgatttgccttaattgtgggcgatccgtaatggttggaaagtgctgtgataatcagaatatcgttatcatggacaggaaagaagtttcaccggaagtgtgggatcggattcaagagatcatcaaaaacccacctgaaccgacgaaacgtttacgcgaacttatgagcaggaaaccacgttatgaaaaatgaaccaagtaaaactatccgcctgatccgttgggaagggcaagaaatccgttatgaagacgacgaccgcgaattcgtccatgaaatgcttgcgcataatctgggattcaaaaacgccgcactggtgatgatgcaacaaaccagcgatgaagacacctggcaatgcgtcattctcgatctggacaaaaacaaggaatacaccgaagatgaactgtttgcgctcacagagaacgctacagcgcgtcagaagtgcttcatgatcgatatgcctcgcgagaactacgagaatatcaagaaagcccgtaaacagaacaagaacaacgtgttcgacctgttcatgggctatcatgaagaaactacggcctaagcctcacttgttttgctggtgtcgttagtagccgctgccacctgtacacattccaatgtttgcaggtggaaatcttttgatacgtcgcggacacattcaacgatcagatacttccctgaatattcatcccctaacacctcaatcaatgcccccactttaacatccattcgaccctgattgatatcaaaccgaatacgtttttcatagctggataacgtctgacacttcacagcctggaacggttgaccctgtttgtctgggttctggaagttgttctcatataccgcgtttctgttcatggtgatccatgcgttttcaatatcggtactcgcaaggatatcactatacagttttttatccgtcatcgagaaactaaagaaacttgcatcccctaacagggtagtgttatccttatgggtaatgtattcacctttcgtgaataccaaagcgtcacctaaaaacgggttacttacgttgaacttgtaagcctttaacggggtttgtgcgaggatctccgtattgcttttcataaagataccggaaccatcttcccacagataacagaagtcagacgaatctacgctctgcccgttgtcacggatgtaatcaaacacggtttcatacgtcccgctcaggcaagccggaggaatacgcacgtttgatgcgtcgatatgcggcgtgatcaacttcatatcgttatacagtgccgtcatgcactctgtaatcgtctgtacggcgttgttactgaacgaacgggaaaacttacgacgaaacaccgtatgcaccggagaaaggtttaggcgcagtatagagcggttcatatcatcggtttcgacgtttgaatacagaacaccgtagtaatgctgttctaacgtttcgttatactggaaggatacctgaataatcggtttctctgtcaactgatagattaactggttatcatagatctgcatcaatgtttcagaagtaccgttaatgatggttttctcactcattgagacaagggcaggtaacaattcaagatagacgttatcagcgaacttttcatatgttggatataatttaaccgacacgacgcggtttataactttactggacattagacatcctccctttatattctatttactaaatagtaaatatcgggatacttgaggcgatcatgaaagagaagaaaaacacacttgataaatttatggttacgcgtttaaacatcaagaacagcaaaaataaagtagtcacgttgcctactggtgaacaggttacgatcccccgtctgggttatcgtcatttcacccagattaaagcaatgaaagacccaatgcagttgcttgagtatatcatcaaagagattcaaccgcgcgaattaaccgcagcagaaaccgaattccttttgattcacctgcattatcacaatgacgataaagcaatggcgatactgaaagagatcggtattaatctggatgatatgaaaatcagcgaagctaagtatgaacatacttttgataaccttcgattggtcttcaataaaccgaccctaatgctggatgatctggcattactgcttaaagaagcgtatgacaacgggaagccgatcgaactgacggacgaaaaccgtattcaattaattaactgcctgtatcgttatgaatatgacgatgtaaaacgtggcgtactccaggaagtctatattgtgcatgaggggaaaaccattaaagggcttaacatcatcggtgaatgataatggctagcaatccatattttaacgaagaacaacgtcgccggatgcagaatccaccaaaaccacaggcgcaaccgactgttcgtaagatccaggcaacgttagataaagattcgatgcgcgagttaaaggatatcaatgataatacccttgaaaccgcgctgaatacactggacatcaaagacagtgtgaaatcctttgaggatcgtttcaaagagaaattcgctggcttccaggaacaatacgaacaggatcagcaaccacttgctgaacagttgcccgattttgttgggccagcgcgtccaccatcattaacagacaacagcacaaccagtgttgataactccgtcagtgtatcgaaccagcataacccatttgcgaaaatcgaaacatacaccggaacgattgcagaagcaatcaccaagtttatcgaactcgctgaaaagaaaccagcccccgcgccggaacctgaaccagtaccggaagaggaaccggaggtcgatcgggacaagaagaagatccgcgataaggataaagacgagaagaaattcagcaagaaagtattgtctttgctgggtgcaatcaaggataatacatccggtcttctggctcgctttatcggttattctctcgaagcgctggcgaagtttgcaaaatggactctgattatcggtagtatcgtatttgcgatcgacgtactgagtaaggttgttcagaagtggttccaggatattcttgcagagggtgaagcctcgaaagatttgtttggttcatacttcgggaatatcaaaacccttgctgagaaaatcaacgaaggtctgcaaaacttcgatatgagtaatttgggcgaatcgctgaaaaacttgttccttgaaccgtttaaggttctgggcgataccatcaaaaccgcaatcacggaaggtatcggtaatctgatttacgctctgggtgaatataccggatctgaaacgattaccaacgccggacgcggaatgaaagtatcagcactgcgcgacaaacaaaaatacggtcttgaaattgatcccgatgatctgattctgctgaaacaacaggagatccaggatcagaatgataaagtggttgaggcacgttctaaggttgtcgaacaggttaaggctacccagggcgcattctcatatagtttcggacaacaaacagacgcacagaaagcattgtctaagcaattggaacagatgcgcgatcgtgtggctatcgaagaaaagatcaccgaagagaagaagaaagaactgaaagcattgcaggaaaaccccgcactgttaaaagctgaggttgataaagagaataccgctaaccgtaagcgcgtggacgaaaccaaacagatcgaagcagcacaaaaggctgagaagccgaaagcggaaaatgatttcgatcgtggtgatcagattcttgataaagaaaatatcaccaacgaagacaagaaagcaatggagaaaattcttgaatcactcgaagagaaaaacaactccaagaaacttgacgaagacgatagcgaacgattccgctcaatgcttgaccagtggcagaacaagatcgccgcagtaccggaaagcagtgcaagtattgacaagcaaccggaacctgtgaaatcacctgttcagcctacaacgcctaacagcgttcaggtcaacaacaaaacagtaaacaacacggttcagcattcagtacaacgaactgaccgtaaaccattgattgcattagcttaaaggaaatttaaatgaaaattacagtattgcaagacactgtacaatcatttgctgaaatcaaaaatgctggcatcccctctgggggtgctgcaacaactaaaaacgcgttgactcaaccgatcgtaacagcggaatttccttcccaacgtgcagcaggtattgataacgcttataatgcatcaagcctgtataataacggcttgctgttcacagcatatgatttcacgggtggacttgcaccaggcagtaaagacaactaccgctcattacgtcaggcagcacagaacgcgcaacagatccttagtgctaacactgggaacgttcgatacaaacaggttttgaatacccgtactatgggtacacttaaccccatttgtcaaatacttttaccgcgaagcctgaacgataacgaagtgaactcacaccgttatcaggatgcaaccgatagtattgttgctaaaggtttatcccgtgcggtatcaaacgttatctggggcgctgtagaatccgtttctggtggtattctggcagaccgtagggaagcaatcgacatcggtactaaagcagcgtttcaaggctctgataagcgcacaaagatgtattacaatacattcgttatcgaaagccgttatgacctgctggaactgattaaaatctattacctgttcacggtgctgggttatggtactacttcgggcggtactccagcagaattagccggactggttaagcaagcgtataattccagcgcttcgaaggttgcaaacgtttttgcaccatcaacaaaccagacgacagcaagcgatttcaacggcagtatcggggatcagattgttgacttcgtatcgaacgttgaagttattaaatcgcctcctgtgtggtttattcgtgacttccagacaggcgacagtttgcggttccctcattccacgttcgggccagcaggtattaccagcgttcgtttcgggcgtacaatggacaacattgtaaatacgttgagagaatcaccgaacaccccgatcgcagttgaaatcgaaattcagtttatggaactgatcgatatgcgtcaggattcgatttttgatacgcagtattaagggggaacaatgttctatagcgtagatgaatttttgtcaggaatggcaaatagagacttccagcgaagcaacctgtttagtgttgtattcgcaaccagtccagcatcacgcattctcgacagcacgatcgggagtatccgcgatactttaattgatggtactatgagttccattaacgcaaataacccgaacgagttcatgaacgctattacagggggcgtaagcaagttattcagctatacagttgataaagctattatgtccctgaacaaaacaggtttcagtaaaatcatgggggcgttaagccctcgtttaattacttccctgtttggtgatagtgtttacggacagatgctaacagaattccgtgacaaaatgatgtataatatggggttgagcatcgttggtgttcagttgcctggtaaaacactgggttatgaatacgtgtataatggcggtgtaccccagatccgattcacccgaccggagaatggtgaattatcgctaacgttccgtgtggattcagaagcgcgtaacctgaaagtattcaacgaatggttatcagctattcgtgatgatgtctcaggccagttcgcattcattgatgaagtatcaagcgcgatccaggtaaacttacacaatcgcgatggtgtcccgcacagcacgtatgtattccagaagtgtttgcctgttaaagtcagcaacccagaactgagttatgaaagcaataacgaaatctggacattcactgttgactttgcttataaaacaggctggcttgttgaagcagataaagaaggttgggacggattcaaacaatcacttatcgaaggtgcagcaattgccgttcgtggtgtggttacaggacaataaggggcgaaagccccttttgaggttaaaatgattgatataatccgcgtaaaactccctggtggagtgaagcgattccctatgtttaccgtgcgcgatcagttgagtttcttactcacaagcgcggacatggaagggaagacgctcacagaacagcaagaaatgctggatgaaattttagatattctgtatccgggttattcccgcaccgaacaggaaaacattttcactaaggtgtattgtgtatcgttcggtaagaacgcaatcaagatccgaatcaaaggaagcagcggacaatcagaagcattcatgcatgtaactgattacgttttgcaaaatgaatatgcccttgatgattcgcttactctgggattcaaattcccgaaacatcgtaacaacagtgaacaattattccttgaatgtatccagtatgtcaagcaggacggcgaaagatacgaatggaatgcattagacgaggacacaaagaacgcgatcctggatctggtgtctattgaagatatggaaaatatcgttaaactgttacgcaagtcctgtcatgttaccgtgcgtgatattgagttcagcgacttattgacactgtacaaaatcctgttcaacaaatcagaactgaatgagttcttcaaaaccaactatttgttaaataagaataccgtacagattgaacctataatgaatggaagcccgatggaacgttcaatttacgttgcattactggcggaagacttgaaacgaaaagagaatgcaaatgcgtaaacatacaccccgacatatcccaaaatataatgtgacttatcgcccgttaaccattggcgatcttgatgacacggataacttcattattgaaggtgatgtgttcaagcatcagcgcgattatgtttacattatggctctgttcgacagtatcaacaaagagactgtagatctccaaatcaaatgccctgaatgcggggaactgattaagtttgtgctcaatcgtcatcatatcatggtggatgaatacgaagaaaagctgtacggcaatgagatcaagatttcagtcgaaccacaccgcaccggaaaggaagagttacccgaactgattaagtttgtagtcatcgacggtgaacaaatcttatgggatgactgtaaagagtcagagaaagaagccgttctggatagtatcgactatccggtctttaaatcaataaatagcgctctggataagccagcaatcgttgcaaacattccggtaaggtgttcgtgtggctacgagcatatcgttgcactgagaggcttagaggcgtttctaaaggtggttggataaaatgggtgttaaccttcgcttactgtacagcgatatcgatcccaacttaacaaaagactggaacaatgacgtaaccgcctcgaaaggggcggcagcggtaaagaatagtctgatcggtatcgtaacaacacaaaaaggcacacggcctttcgatagcaactttggttgtgagatcggggaacagattttcgagaacatgaacccgctaacagcggaagcagtaaggacttcgattgtctccgcgatccgcgcatacgaaccccgtgtttacaatctggatgttgaagtgattccgcagtatgacgaaaacgcaatcaccgtgacgatttactacagcatcattgatgaaccggaagaagtagaaagaatcaaactccagctatcatcctcataacaaaaagccccgaaaggggcttttcttattccatcacgatccagcccattagctgttgatatcgcaattcgaacggggtgatgaaagagcggttattgataaccttcgtcccgttataggacttaatcacttcctcaccacgaagcacatattcgtatacttcgtccatagtgtcgtaacgcacttcttcgacttcgaagcagaagttggaatattcaatcattccgatcttgttcgcgtaacggcgttcgatgcagccctgtttttcaatctgagtgatcgcagtatcaatgaactgcgcaagtgcttgcatgaaattaccacattcgacttcacgacccccgcttgagatagccaggtaaacgcggctcaatccatcattgccgatgtaaccgatacagtcaccgccaatatagacagaccagactttacccatcggccccatacccatacgattctcactacgagaaacacctttcagtaacagtgccatgataccgccgcgaacgtaattcattttcatgataagccccttattttttcaggttgattaaccaagatggttgggtttctaaactaaccgctttccaagcatatgcaacactataaccggaatacgtctgacatacaacagcattttcatttaaatatttcactttgtgatctgcctcttgttcatccagggcagcacacacgatattcttttcatacactccgccgtttggctggataatggtttcttcaatcagataaacgctgttcatgctaattccttctcgattgcttcgatgatgtggagaacgtaaccgttcagttcttttgctttatcagcggcttcaaccataccgtaacgaggaacttctaaaacgttcgcaccttcgagcaggttgctttcgatgtctacgattacgtagctctcaccgattactgcgccttttctccagtcttttacgaacttcaccattttagctttcatgttctcgttccttttggctgttccgtttcgatatgtgtaatataacaaagccctcacgcgaacgcaagggctttttgagttaatgcataaaagatttgacgtacttcacgatttcttcacgacacatatcgaccggagtatcctctgcaatagcagcatgacagaagatttcaccatccagccagaacgatagcatgtactgaatatcccgaccttcgttttctttctggtgtttcttgatgcgatcaaatgcatcatccatgctttcggtagctgtaagcatttcagattcacccgctacagcagccatttccccagcttcatcactgaattcgctttccagttcttcccagtatactatcgttatcatggattaccccaaacagattttacatttacagagaggacattccgcctctttaacgcgcaagcgctttgttgctgttcgcttcgctgtgttgtgatcatacacatgcaaacagcggtaacagatcaccaatcgtttagccgtcataaccaccaccgcaacgaacatcaccttcaatgaacagttcgcggttatctctcaggagattgtatttcttttcgagttccggcccgaatgcgtccgcgtcgtcataccagtcatagttataacttccggtttcatcgtcgtattccggttcgtcgccgcgctcattgaagtgaacgattttaacatcatccagattcagttctttcagcttgtcccaaatgcgggttatttcgacgctattacatccgaacgcttccagtgtgattgtaccgtcatcgtgtatttgaggcgaaccccagcgaggacgagtatcatcaaacatatccatcagagattcaacgtttgactcaccgtaaatctttgcaacttcctgttctttaccagggcggacaagtccgatcccgataatgaaactactgcttgagctattgctcacgaacccagaacgaatcttcatcgtcttgcctcatatttcgcgttctccgcgattttctcatgatacaggttgtatgacaacaccagcgggatacaagctactataagcccgatgaccgccagttgatattcgcgtttatcgaacgccataaatgcgatcgtggctcccagaataaacacacctaatgcaatgatgaagaataatgtcattttggcagggtatccatttcacgagattttgctttcaggatgtcaatcacagtagtcatcgcctgttctacatcaccatcatagtgaatcaggaatgttttgtgaagtcccatgatcagacgattgatgatataagccatttctgacggtaacagtttaccattctgtcgattgtacttctcaaacaagcggtagagttctgcgctattgcctggcttctcgatgctaaaattatgcatcccggacagaataccatccagatacagaacagttttgttatcactgcgcaggtgtccgccaaccttgtagtagttgctgaatacatacggcttttcgcggatatcttcgatatcgaaatcaccatgatcttcgatgttgccaacatgggcgaagaaatgatgatcttccagttcgagaaggattgcaccctttttgtaagggaatccgactaaatcaatctgccagccattttcaccgacaaatacatcatcaacaaccacgaaatccggcagcataggcgcgtatgcgtggttcttttcgttgttttcacgataggcttgtggttcggacaggtacaggatatcgccttttacaacttcaccccagaatacgttacgtgacatattattttcctcaatatgccccctttcgggggcggtcattgttagattttgacttctttttcttccaggacgatttcacattcgaatgatgtggtttcccagactttccagaaatcggatggaatattatcttctttcggaagaatatcttttgcagcgatagaaactttggtttcttcgaagtccagatccgcgaaccatgcatgggctactacaacaccgtacattacgcgacttaaacgggcattcagtttacggacttcctgaatcgttgcctttgtctgcttatcaagatactcgactacctgatctttgtcaagcgcatccagttcagatttcacctgatcgtaagcccacaggataatcaggtcgccgttgttcagtttcttcttaccttcttcacgcttcgcgacggtagccgctacagcaggaagggaggaaacacccttgattttcacgttcagttctttcgacatgtaaacatcagtcgattctgtgcgctcaaccttcggagagaacccgtaatcacgaataccctgttcagacagccattcacccgcagcctcaccaaagcgctgtttcagcccttctgcgttgcgcagtccgatcgcgttgtcacggaagaacttcataaccttctgacggcctttcaggatttccagacgcacgttatcagtcacgaactctttaccgcttaacccgcgagtcatgccacggttaaccagaggcagagaggtaaagtctaccagaaccgacatacgatcatcaccgattttttccagcggcttgatagtcaggccagaagcacgaaggtttttcagtgtcggaatatcggtttccagcggcagaactttaacgttcacgataccatctttaacgatggtgaagttacgcacctgcttagtttcgactttttccggcagaccgaattctttctgtttgctttctgggatagtcacatacccttccagatccgtgttgatggaaatgttcggacgggaactgttacccaccagatgtttaaccgatactttggttgtggtttgggtaaatttcggtgtccagacttcatgcgctaccatttgcgccgccagtgctttacgttcttctggggttgcagcgtttgcgatctgttcggtcagttgatccagtgtatcatcttctttctgtacagtctgacggcctgtgcggttatacgcccagtgctcagaagacaggtcgatcactgtgtcagtttgtgccagcagttcgagcgcatcaaccagagtgaacgcgttttcgtctggaaccatgttgtaatcaataccatcaacgaaacgctgtgatggatctacaacagcctgtgcaatcaggtctttcgcgttggagtagtcctgtttggtaaagcagttgtcatacgctttgatcagacggacatcacccagcttttgaagcactttccatgccagatcagggttcattgtgtgcagtgcatgataaagcacgacatacagaacttgctgttcgctggcgatgttcggatcgaatccgtcaacatcattaatcgcgttttcacccagcgcccagatgtttttgatgtgttctggaaccagcacaacaccgtttgcagcgttcaggacatacacgcgcccttcgtccaggtagatcgcatgggtagcatcagcaactttgacttcgatacgcgcggaagtctgcgcggtgatgatttcgttaaatgctggttcgtatgcgtcgaaaccttcaacgaatttgtgcaatgcgttggttgcttctgccattttttccagcagaggacggtttacataataaccgtattccaggaacgcgatactgttgaaagtcagtggcagaaccgcacacgctttcagaatatcatcggtacgccagcagttatcataaccgtctgtcaggaagatcaggctgttcaggttgccgttttcagattgcagatcggtagcgatttccgcagccagattcaacggctcaacaaagccagtacaacccgtaggtttcaggtaacggtcgatagccgcgcagatgttagacaggtcagagacattgctaaccttctcaccacggaacaccgtgccgtaatcgcctttgctggagaagtacaggatcgaaacggtgtcatcctgtttaaccagactcgccaggtttgctttcaggtgtttacggatcttaggcagttcgttgtacattgaaccggatacgtcacacacgaaaacgtggtttgtcggggttggcttcgatacagcgtttttgaattcgatatttgtgattgacatttaaattttctcgtatttgaatttttctaaaatttcgttaactttattgcttactgcttcgactgtacgatcacacccgaacttacgcgccaggagttcaacgtattcatccatcgtagtgagtttggattctgcaacgtcaaacgcaagcgcatacattaccggattccatacccgaacgatttggagagtatactcgttcagttcaaatcgttcaagatattttcgcaaagaaaatacatcaaacggtgcggggcgatcctggctaaaggggatcgactcccctaatgcatagcgaggcataacaacacaaacttctgttttcagtttattatccatcagtgatgactctttgatgtgtgttcaaggttacggaagatgtttccatgttccagttgagttccgatcgggccgcattcatcggagtacgtgaattcatagataaacacgccgtcctgattgccgaacttcgtgttgtactcttcatacaaccacattttgatcagagcgtctttctcttctgtgtccagatcgtaccagtctcgcccgtcatacgcaagcgcaatttgaggatttgaacggtaacggttttccgcgctttcttcggtttcccagtcatagcgcttatcgtcgtagaacgattcaaagctattacccagatgaccgcctaagtcacgatgaacgtgattgaccacttcttccgctgtcaacggcggatcgtagtaaccacaatcagggacgcaatcacccatcatttcgcgcaggttgtcgatatcagtcggatctttcgggaaccggacgatgaaactacttgatgaactgttgctcacaaaaccagaacggattttcattttacatcctcaaattgtaagttttctttggttgcgttcgcaatggctttttcgttgttcagtgttactatgcgcagacgttcgccagtaaagccgtcgcattcagtgatactcacccagtcaaaagatttagccatttcaatcgcacgttccagcgatacggtagaaccgaccaaatcactaaatgtatagtaatcttcgcttaaactttcaacagtataaattttcatgatactttaccctttgtttcggatttcaggacgatgttactgtaaggatcttttgctaccagttcccacaggtcgccaggatgttccccgctacggtagacggatgaacggatgatttcgttaaacttgctcagggcttcgtctatgtcgtcatacccgcatttgagaggcttacggttgcaacgaatgaagaacatttcgttggtattctccccgcgttcggcgtttttaaccttcataccgcctccattttaccaatgacttcttcgtatgtcacagggttaggttcatagccgttagcgcctattgtatcgcctactctgtttcctactaaagaagcaaccgcaactttcttgccgtctttccacgcagtgaaatgcagattatccgcaacatacgggaaggtttcgtgattgttcaccgcgtcgatgcagtccataacggtatcagacgcgcagatcagattaccaggttcataatcaaccaaacattcaacagtgtaaatcataataatttcctcacgaaaaagcccctttcggggcttgattaatcagtgtccgaacacaccacgaatagactctgcgaacgcgtacagttcagggtttttcgctttcactgtttcgatttgttccaggatgtaatctggtttgtatttcgcaccgaaccagcagtaagagaaagaacgatcccacatgaacacgttgtagtattcaccgttacgcacttcaaccatcacgtaacctggattagaacccagcgggtaatctttcagtagattgaatttcgcaccagcgccagtacatccgttaaacaggtcattaaaagtcatggtatgttccttttcagtttcgtttcgttaaagctaagataccactatcaactactggatgcaaacacttttttgaagaattttgtttccggtctttctttgtacggacgcattaccaaatctttaccgtccagcacggttggcttaccttcgagttcgatcaggatgaagtttcctttatgatacttcaatacgccctggctggcagaccattcatcattatcccagtggttgtaatgccattcaacaacggtatcgatcgggatttctggttgatttctcataatactttcctaatttgtttcgctatggcttcaatcacgggtattgaaactgaatttcccgcttgacgatatgcctgttttttactatccggtatgataaatgaatctgggaacccttgcaaacgaaaacactcacggggagtaagtcttctggggttctttccttcctgcaacaccagacattgaacgccgtccttgtaatactgctgggtgatagtcccagtgtgcgtagaatcgcttgtgacggcctgataaccgaaacccttaccgtttgccttatttcgttccttacgctctctaaagcccttccatgcgttatctgacagggtgaacgaatcatcagcatcttcgaggatgtcgcctactcgcgtaggggtgcgcgggggaaccggaaacgaaaagaatacgtcatccagaaagcagacaataaacacgcgttcgcgtctttgaggtagtccgaaatcctttgtgttcaggcgttgatagaatacgttgtatccttcggcctccagaagcccgtaaatcgttttaaacgtcttccccttgtcatgggttagcagttcaggtacgttctcaaagaacagcacacggggctttttagcgcgtataatgcggaggatttcaaagaacactgtaccgcgcacatcttcgaatcccagtttcaatccggctttactgaacgcctgacacgggaaccccgccagcaggatatcatgatccggtacttcgttttcatcaatctggaacagatcaccttgtaggttatcattgccccagttttcgatatatgtttgctgtgcgaacttgtcgatttcagacgttataaggcattcgacaccgccgaatgccttatcaaatcctaatcgaaccccgcccacacccgcgcagaggtcaattattttcatacgtcaaaatcaatctcgtcaattttgtatgagttttcatcaatgtccgcccatagggttacattaacgtgtttgctatcttcgtacaactggcgaccatcaatcccgcccgtgtaattgctttcggtacgttcagtaacttccagtcggaggctatcgcgcatgatctgaacaacagcctgttccagtgtaaccgcgtctgggtttttggtatcgcccagtacaacatctttaacgttcaaaataacatcagtcattagtgccactccgttttaataccgtgtcggtatgcgtcaatccccagtggggtaatcagcaaccatgctttcgaattatcgtgataacccgttacccttcgagcgtaacctttttgaatcagggcatcacgccctgatttgctgggtacgtcatcgaaatctaagtctagcactttagttgcgtatccgtaaagtttatacagaacatcaatttcagcgccggacaatttaggatacatcatttgtaataccccacaacatgatcgctgtatacgcgttcgatgaaatcgttccagaattcgcggtcaacttctttcggatatgttgaaatcgctgcaagccgttcgacttcgcccatgacttcttccagcttttcctgtacggttgcgaacggtacgccgccagctttaaccagtttcaggaatgcgctatcaggcagaggataaacgatatcaccatctttgtaaatctggatcaactgcataccaccgcgcaacgcgtgacttaaagccttccagtcgatgccgttgttggcttctgcttgtcgtgcgcgttctccgtattcatcccagagtttgtacactgacttacgcatttcatcggctttgatcgtgaactggaatttacgccccagcacttcatagaagtcctgacaaccagatttcattgtcgtgtcggtaacgaatcggcagaactcgtttgtagggaaacgatccttgatgtcagacactttcacttcacgcgtatagcgtttcatatctggtgtgaattcctgaataccaccgatcgtttcggtttctttcagtacatcgacaacttcgcgcagtgcagccaggcgagaacctttcacaccatattttgcggcttgcttgcgaacataaccgaacaggccagttagttcagtggtgtaaaaacgccagcggttagcgcggatatactgccagatttcagagttagcgatcagcttgtcatccgaagcgtgaagcatatcgagcgctacggtatcaccatcacacgcaaggctgataaacttagtcagactatacaactgacgatcaacgtcgtctacggtgtttttagagcttttatcgcccgtgctggtgtcgatagtctttggggctttccccaggagaatatcgcgcgggtgcgggagaaagatccctttatagtctttatcgcttgtcggtgtgttcagtccgtacaggtgagaaccgaacacggtttccattacagttttcaaaattcaacccccagggtttttgcgataccgcgcagttcagcggtagtgatttcaggaacaacaacagcgtgagaaccgaactcttttcggatcttttcactcagttcagcacgatactggatttctttgtatactgcttcgctgcgatacatataaaatccgccccagcccccactaccagaagtcaatccagtcttacgatcgactttctcgatgttccagcttttcaaatcagcgtctttatcagtggatgcatacagatattgacgcgcaacctttagaacgtgaaattcgcgagggtttgctgttttacgggtattgtataacctttcgccaggatcgtaaagggtatcacccactttcacatcagttaaatctttcggattcatttcattttccaacgttttgacttttcacagtagaacaccggaagacgggccagaactggcttcactacgtcttcccctgtgttcgtgttatgaaccacttcgattgtaagggattgcccttcggacggccttacaatgtccagttccaagatctcacgattaccctttgtattgatttccgctacgtagtaatcgtgtccattgatgtttacgacatcacccataataacgctaattgtttgaatcatgagtatgcaaacttaattttaacattcagggaatccagcaggattgaatcacgcccatcaatgacggttaatcccttgtatttgctatcgtcttcgctcttacgggagtatacgcgacaaaccagagaaccatcctgtgctatgtattcaacatggtattcacggcgttctgacgtaaacacatcaccaacaacaaccggacgatcgacattctggcgtttagtcccttcgtaggacagtttgccgttgccgtctacggcgcattcaatgcccttatgtgtgacgctcgcaacagtaacaggctctacagttccaccgatcagcattgccggatctttggttcccagtttcatcaccagtgtttgacggatattatttgacatcggttctgtaacaaacacataaaccatatcgtttttatcacgcgcaacagattgcaaagtgaaattcttcgtacctacagaaccagtatgattgattcctacacgattaccgggttccagcgacatacgacattttacatcagagataccgctaagggttgctactttcatgatttaattccttcaaagtcttcattagatttccaatacacgttgaagttacggcaatcgtggtcggaagtcaacgtatatttttcttttgttttctcgtcggtgatcaccatcgtttcattctcgatcgagtccacaccatagacgaatactttatcaccgcgtttattcaggaacgcttcacctgtttcaaccaactgccagcagttgacgggtaaaccacccgcacagatcggacggtttacgaggcagtaaggacgtttaatcatttaaattcttccattgcataggaagtaagatctttgaaataccttgcggtgttgccttctgggttgtttgtaatctccatcaggataacagcaccatcaactcctgctttcttagccatgaatgaaatggcttcggtagcaataatcgttgctttcataacatcagctttagaaacgttgatcgtattcatttttcttccttttcattattcatgcggtatgtgtatataatacaaaagccctcacgcgaacgcaagggcttttttaatcttttatcagagtcccgtgaaagctacaacgatttgatagtggtcatcgaagaattccccttgtcgttgtacgacctcatgtaagggcatccagaacgcctctaacgcatcgtcagaaccgcccataatgcggggcagacttccatcattgttaggctctaacttgatgtactgcgccacagtcggttttgagaagtgtacggaacgcttcggatgatcgaacagcatcgaattacggattgaaccacggataaccttttcaggaaccttgatccgtacctcttcgagcagttcgcggatcgcacaatccaggaacgtttcatttgcgtttttgtgtccgccgggaagggctaacgcgtctttacctggggcgaacttacgacgaattaccagcaggtgattgttgcacacaaccacactatcacccgtgcaacagtttagcgcgtcggggtatgggtagtttttgaatttctccaattcgctttcccatttctcgtattcgtagaataaacgccagaacgtgtcttccatcatccatttgtcgatataatcaacggttgcttgaggaacaaagcgcaacagtttcttatcccacccgtttttatggttaaagataatcggacgcagatcggttgctgatagatccttgccgttaatctggacaggtggaactggtacgtgtgtccatccgaacgctttaagccagtatgaacctgcatctttttcgtaaccgtagatagcgattttgtcgcctttggtttccctgatagcagtacgaacagaggttttccatttctcttcgttgtaaagataatctggaatgtgctcaaactgaacacgaacaacatcttcgatcgggaagttagcgtttaaccatgagaagatcatggtttgacgctcacgcgccgtcagcgggtttaaaacgttagggtaagcatatgctgaacccagaaggatgtaaacgatctttgcttctccgagtgctttacgcaccattgctgcatgaccattatggaagggttggaatctgccaattacgacagctttatcaaattgtttcataacgtgctccacgtttaaaggttaatcataaaacagacgcaatcaccaatacaccaagaaaaccgccaataaagccgaagaatagcgaaatgaagatagtaaggatgatctgttttatgttcattatagtattctcgttttaggagtcaagcccccaagagcgggggctttaaaaccttatttacgagaatcgaaaatcactttaccagcgtaatcagaacccatgacagtttgaggtacaccgccctgatatttgtccgcgatggtctgctgaacatcaagttctttccagcggatcatttctggggtgattgtgcgttgcagaatggcgttcgcttcggcttctttcttagccgcatacagacgggcatcagcatcacgctcgttagcctgtgcagcattgctacgggcttctttgtcggcaattgcctgaacaactgcctgttgagcgatttgctctttacgtgccagttctgctttttctgcgttcacctgttcttcacgaattttcgtgttttcaacctgcttcttgatcgcttccggcaggtcgatatcctgcaagaatacctgtttcacggtgtaaccgtaaggacgggcatactcttcaacttcctgctggatcgcgatctgtagctggctttgaacttctgcattatacagatcctgtgctttcggtacagatttaccgaactcacggacagttgacagaagtttttcagtcacatatttatccagcgcctgatcctgactacccgcattgatacggttgatcggggctttgctaccatcgaactgtaacatcacggtcatatccacagtggatttgaatttatcctgggacggaacctgcaatttgtcaaacttcattgcgatgtctttggtgttgaacacctcgaaatcagccagtggatttaccaggtggaaaccaggcagaacaggcttcggtgaaactttacccatgaaggtttgagtttttaccgtaccatcctgaacgatagtgtacgagttcggaaccagccacagagcggcgattacgcccagagcgatcagtgtggttttcttcgggttgtttacgatagtgtttaagttcatcattatttccattgggtttatgtttcaattcgatagttattctatcatcactttttcgcttgtcaaactctttttaagaaagttttgtcagcttgtaaatcgtttgatagcacaagcctttgatctcgtccaggacgttcttcaatgaactatctactgaatcatagatttcgttggcttcatcggctattttacggagatacgcgaccgtgtcaagcacattttctgtttttaatacgggtttgtatcgaccagtaatgcctatatggatttcggtgaatttatcaaccaaatcctgcatatcttcgtaaaacccttcaaatgctttatgctgtgaatatgaaccagtcgcaaaatgtgcgctgtgcatataggttacagacattaagcaagtgccaataaaggcatcaattttactcgcggtatcgcgttctgttacttcgttaaacgtctgcatcttcatcccttatgaacgatgaatagcggcgaattcacttgcaacccgtagccctaaacgtttacattcgggttcggatttacattgcttctgctgccattttcgttccatgtaattatagaatagttcgctggtatttacgctgggagggatggtgtcaagatatacctgtagcgccgcgttgatgtagtaatcgaactctttggcgactacggatctatcatcagcatgtgatgacggagacaagattaacaaaccaaacatcagcgctttagatatgcgtttaatgttcataagcaattctctacgtgcttacggatcaacaatagatccgttcctgtatatatttatagcaaaaaaggggcgaatcgccccttatgtaaaattagtctaaaaatacatcaagttatctcataccagcataagctacgctcaaaagcgcggatcttatttgcgttctcgatattttcatcccatccaattacgccagctttcatccggcgtaattcctgacgcattttagcgcgtactttcgaatcaatctttttcacagcgattgaaagcatcgcggagatatcacgatgagctttgttaccgtcgcgattcaggtttttatcgaaccggatatatgcgcaacctgatttgtgtttccagttggttgtataccaacgtaaaccatcaggactttccccgtgctgtgcataatactctgaaaatgcttttgtctcttcgatctgttcgatggaggacttatcacggactggaacatatttcttacggtaagtacggctcatagtgttctcctttgtttgtctgaatacaccttaacagttcagaccaacattatcaagaagtttttcgtgataatgtttgcgacagagcgaaacgtatttgtcttcggctccgatctcaacctgcgccccttcggttacgaagttgccttgtgcgtcgatacgtgcaaccgtagttgctttgcgtccacagtgacacattccgcgcagttctcggatctcgtctgcccaggccagcaaccagtaagaaccctcgaacagattcaactggaaatcagtacgcagaccgtaagccattacagggatttcgagttcatcaacaacgcgacacagatcgaaaacgtttttcttcgaaaggaattgcgcctcgtcaacgaagatgcaagcaattttattccggcgctgaatgtcccagaacagatccatatcaggcgcaatcaattcacacttttcgttcagcccgatacgcgaactcactgtgtttgatgtgcgggtgtcgattgctggcttatagattacaacacgcataccgcgttctttgtaattgtgcgcgtccgtcaatagtcgcgcactctttccagcgttcatggatgcatagtgataatacagtttagccattgacacgctccacaaacttaatatgattctggaatttaccctcaccttcatggtttttgcatgttttgtttgaacagtatatccaccaatcccactcgtcgtaagggggtttgtcaatgttcatgacgcaaatcaaagggaaatgacaatcccgacaacgaactttttctataatgtgtgcgttagccaattgtaaaccacccgttacccatgagttttttgttacgtcgcgcaagatgctctttgatttccggcatctggatagcaatatcatactcttctttcgtcatggtatgatttgcacaacccatacacccgcacacctgcgcgttacaccaacggagtgttccgtatgtcgcaatcaccttcattgctttagctttgattttgtcagtcatgattataaccgcccatttcgctatcttgtgctttatggatatcaagataccacatgttgattttgcttttcagttcgcccatttctttatccagtccttcatcaacaagacaaagaatgtcaaccaccgttttacgctgtgtgatgttgattttgttcgctttcatggactgcgccagcgcttcacaggttttcaccagtgcggcgcgttgtcctttgattgcggcgatccgtttgttcgctttcttgatcgcccgacctgctttgataggatcaatcatgataaatccgccttacgtggatcaaccgatggatcgaagtgaacgacgatgatcgggtaatctcccgtacactcgtcaataatggcgctaatacgcagccaatcacccccagcaagccccgcaccgataagaggggtaatgataggcaatttctcaggaaacgccctggcgcgttctactgcgctcacaaagcatgaccggattgcatcataatccacttgtgggccagtaccccagaatttaaactgagtgtatgcattgaagacaatctgaccttcttccgtcatgtagatggagttagtgcctaacttccgctgatcgcctttcatagtcagtgcatcaattttgaacgcaccagggattttgtgcttcacttctttagcaatacccgcgcccatgttgcaataacagttacacccatgaatcaagtgtacttttcgtttcaggaacaactctacagcgttccctttgatttctttaataatcattttcatcacctgtatagtggcggtaagccagcacagccagccccgcgatcacaaccacaacacacattaagatataacctgtgttcatttaaattcatcgtcccatctttgccacgcttccaactcgtcatcatatacagggaacgagctttcgtttggctttttaacgtaataccagataatgattgcagcagcaatcacacacccataaaagatcactaatcccaacatcagtataatcctataccagcgttatattcttcaaccaggtaagtacggagtttttcacaacgttcattatttggcgctttggtgcagaggttcatcatcggttcagactgcaaaaactcacgctgtttaaccagcttctgacgcttgaagaggtgcgcattttcttcgccccatacataagccgcgtccagttgttcagcgattacctgttcacataccgcaacgtctttaatgtcgcgatggttgcagagttcagccagtcgaacatcagcatgagcaaagccagcaaacagagtgagtaacagcgcaagttttttcatcgttttaccttagtatgaatcgttttcgataggggtataataatgggtttcgcagacatacgcaagcactgatcgcaaactatcgctttcaaattctggattttgattgagtttcagactccaacccgtgaagcacatccagcgttcttctgcaacgtcaaaggctaaccaatacgtgttgaactgtgaacatgtatgttcgaagatatcgaatagtagtttaccgccgatcggtttcacatatggtttcacgcgttgaagcgatttcaggactgtttcgaggttactgcgatcctcattcatcgcgatacggagaatatgctgattggtttcttggttatatccatcaatccccagacccatatcctggaagaacttagtcgcatcatggaaaatctctcgtccgctgttcggggaattgatgtagaactcaatgcgttgttttggagtcatcgcgcggacacgggaagcggttttgtgatcgatctcgtctttgacctcctgacgggctttcagcaacccgttcagcttttcctgatagggttttacaatcgctcggatttcgtcgatacgttcatcaataattgctaactgctgttccggtgtcagtttagtttccatgttaagcccctacgcgcacaaagcgatcttcaattgcatcattaacacattcgtaaatgctaacgtcattcgggacgtgcttacgaatacccactttcacgatatccatgatctctttgttgctaccccacacgttcaggttgaagtaaacgccaccgctatgaattgtgttgttgccaacatcaagatacgtatcttgactttcgcagataaacagtttgcgtttttcttctccatatgcgaagtagatactgaacgattccatacgatgacgatcgaccgtgatggtttccactttaacctttggatctttgttcagttcatctaacacaccctgaatgatgtgcagcatgttcggcttgatgatagtagggtgactggtaataactcgatgtgatgtgctcataatttaatcctcaatagttggtacacacataataaaaaagcccctgcgaaattgcaagggctttttatcagataatgcgtttttcttctaacagcttcgcggtatggttaaccatgcgagcgtaatcacgggcttctttctttgaatacttgaatcccgcgttgtaactcgccagcgcctttttcaagtcgcctttgtggtaatcaagccagtattccagttcgtgaagtgcatacttggaaccaccccgaagggtttcgagcttattgattactacgcgtttggaatatgatttatccattcgtgcggacgcgctacgggctgttacttgaaaacaaccataagcatgatgattctttttgcctttccctacgttctcacatgcgcgagactcgatccaggcaatagccgctaaatgatatcccaaacgtttcgatgtttccgattcaactggctttgcagttttgcgatcgtactcatttccgatcctgaaagcgtactccaaaacctttttctgctttggtgtaatatcatccaattccttaacatagctgggggcattggctggcgctttcttcattactgttgcttgttgtagcggtaaagttgacttcacagcggggagtgtttggataaactctcctaacggatcagtcgccgcgttgccagaaaaagagcataagaaaatgctggcagcaaagataattttcttcattgtaatacctatttgtaacaagagagggctatgataccctcgtcttattatttatgcaacgattttacgctgttttgcttcggtcagttttttctcgatgaattcagcaatgttatagtttgaaatcgaaacgttcggatcgtacagttctacgatttcatcaaacgatacctgaaccacatgtttaaagtgaacactccagccagtcgtaaagatttcgctgttgtcgaacccgcaatcagggctgaacatggcgcggtatttgtatccgctgtaatctttcaaacgattcgggctgtgtgcgtcactggtgatcaggaatttcccctggtgagtctcaaccacgaagaaataacccagacgttctttgttgtccagcatcgtttcgaacttgcggttgttatcttcacggtcaacgcgagtttggatcttcttccagacctgttcatattcaggccaatcatgctcgacaacaaccccttttatgggttctttgccttgctctttacgatagcgatcaattttattcactaccgcagagagaagcagtttgtcgctatcacttaacgccgcatcaatatctgcatatttaagcactgcataacgttcttcgcgtttcatactactacatccttatcacagactggacaccggatcacacgatacacatcacgaccgccagtgtaatcagtagataccttttctttgacatcctgcgcagtgtatgacagaacagcaccacaacgacaggtagtttgttttggggtaatgcttacaacttgaaccataataacctcacaagaatagtttcacttcgctaccgcatttcgggcagacgatatgttttttcacgatgtaatcagcagcacggaagaaaccgttgtagaacacttcgtttttcttctgtacatcagacagttcatactctaacccacttttgcagttagtgcaaacggtaattagctttggactaacaataacgctgatcatgtatacctcacgaaaaaggggccgaagcccccttgattaaaagttctcttcgacgaatgcagccagtcgcccacgatatacggtatccaggatcacatgacttgaatgaccgtactctttaagtttttcaaccgcatacacaaagccgttgttaacagcagtgtttcgcgggttgtcaatctgtttaatattcccgcatagtatcagaagggtgttctcaccgcaacgggaaatgatggatttgatttcgtgattgctcaagttttgacattcatcaacaatcagaaccgaacctttacccggatcaggatgcccgattgagcgcccacggaagtaatacaggctagggaactggacaacgtttttctccagcagcccttctacatatttgtcaacttccggttgatccttaaacagaatgttcaggctcgtaatacatggttctacagcaggacgcagtttttcgcccagagtaccaggtaagaacccgatttcgcccgacagaggactatccgatttaacatacatcaggtttgcaaagtgtccggcgttaaccaggtgcattgcaccagcaacagccagcattgttttacctgaaccagcagcgcccatgatggtcaccacatcggtatttttatccataattgcatcaatgaatgacgcttgcagtgcatcgcgaggctgaattgttttcatcagcttacgcttcatcgcggattcgtgtttgattggtaagagttcaagctgatactctccagcagccactacacgccctacgagttcaccatccgacagaatgtattggttcgggtaataatcgccgtcaggaagcgaggaatagcttatttgggctacttcgccaacatatcctaacacctcgacatcatcccagaatccagggatatcgacatagccagaatacaacacatcgctatctttcagcgagtcatcgcccgtgtattgttcaacaggacagcccttagacatcgcgatcaacagcatgttaatatcgcgggtgatcagggttgcgttttcctgcatacaggtagcgataattcgcgcatcttgtttatcaagcgggaactcttctaaaccgatataatcaacgatacggagtttcacgctttccggcagtgctgggttcgtcaggttcaacgaaacccctgtttgggtaattgcttcgtacttctgccccaggattactttagacaggaggcggatcgccaatcgtgcttcatgagcggttcgctctttacttttcaggtgatccagttcttccattgtcgcagaggtgataatgatttcagtacccgcctcaacgaatgagaagattgaatatgggttcgagattaaaacgttggtatctagaacatatttcatagaagttttcctgttaattgcggggtacgcggattcgcaccccgcgcactgcaattacatacccaaacggataatatggatatatgggaacggatgaagatgacttgaacgcatacacaaggtcagcgtttttgccagttcaaaccgttcgtcgatcgtcgtgtcacattcatcgaaaatcaggttgattgcctgatacttgatcgtttgtccacggaaaatggaagtcagatcttgacgtttcgacagaatgaaagacgaatcagcgcccttatccagtccatgttctaccgcagcacaaatacccatctgctttgtcggtgcaacgtagatattcagtgtccctttagactgcttgatgatatcgaaagccgctttggttttacccgacatccgacccatatccagcgcagtttcgaagatagacacaccgccgcattcttgcccccaacgcccatcaacgattcgcgcaaggtgcaggttacgtgactgctttacagcgtcaacatagaattgtgaaatcatattgtcgccttatgcaagttcaacgtgtggtgcgtcgataaatttcgtttcaatcggaaggttcggatcgttcttccagttgatgccgtagcgcagttttacacccagttcatcagcggcttgtttcactgcattcaggacaggcaaccacactttcgggttagtctgccagccagcagggagaacgctaggatacagatccacagcatcaccagtgatgtgttttgagttcatggtctgggaaacacccttgcggacgttctcgcgctgttgctctacggtgcgcagaccttcgcgtacaccaaaatcaacaggcgagagttccaaagcacgttttaccaccttaaccagttccggcttcacgccttgcaggttgttcaggcttttctgactaaatttaaacatacatacctctttatgaaaataccctatgggctacacagggtatttacggtttaagaggcgcaacgttttacatgtaaccccaaattgcatcttccgcgcgatcgcgtttccagcgaatcgtcatttccagcgaatcgtcatttcaacactctcctgtttgtcatcaggaggaagtttatcattattgatttgttcaatatatgcttgcgcatctgcttcgctacggaacaacgcatggaaattataatggttgcgcccagttacgttacgatcatccagagagaattgacctttattttcccaatcatcatacacagtgattccgttaacaaacagccccagcccacgatgttcacgcgggaagccagtgatgatatgttttcgacccatctgtgccttttcaccagtgatactgattacttcgtacaggattgcgccaggtttgatatctttcaggacagcacgtttttcaaaagcgttcataatgtattcctcacaattagttttcatatacagattaccacaatctgttttgatgtcaacaaggtctatcgtttttatttgggaaagttaacgtgaaaaggcgatcgtgtaatgcttcgatccgttcatacgcttgtttcaggatcgtcttatcttctgggttcgttgtctcgatgcagatcagttcgtccgagtcgatagcgatcacatcatccatcagtgaagcgaatacgttcacgtcagggtgagtcaattcctttatctccgcttccatcccgtcatgctgggataacagttcgatgatatcgcgctgtaaatctccctggtacgggaatccggtttgaagatggttgataattctttctgctttggtcatatttcacctacaaaaaagcccctttcggggctgggattaaatgtctttgcactggcaaacaccgtatttggtgaaaggcttgtcaccgctcaggtaagaccagatatcgcaagcctgttcagcggtttcgaagattgcagcatcatagaagccgtgttcttcgttaccatctttattgaggaacacaggaagccagctttgcggtttgaagcagtcagtaacaactacccaaccttctttcgctttcattgcttctttgttcgcttcaaccatttccagcatttcgttcagtaagttcattttaatccccttgtttatctgtttcgttgtctacgagagagatattatcacaacggggattagtgtcaacagttattcgaaacgaattgtgctatttttgaaaaacattccagagcacacagatcctttgatctgcttgccgttcacaccagttgcttcgaatccggttgagtatgtgtctttttcagaacatgcaaaccacttgtaacccgtgaactggatgttcgtataaccctgtgcttccaggatacgctgtgcctctttctcgtcagtacagcttgactgcaagaacacaacaacgacaaccatcaaaatacacacaacaattttccacataatttatactcttttaaggttagttttgctggcttcgatccagcttacttggttagatccaatatcacccagacatacagttgtatgactaaatgtgttcggtaaagaaacaccatcaggagataacaacaaatcatgtacacttacgctggttgcatacaaataaccaccggacgtatacagtgtttttatgaaatcatatgaatcgttgggccacttgaaacggtatttctggttccagagttcaacttcatgcacatcatattcatcgaacaggggatcgttgccctttgtcgcttcgtaaagcgcaccgcgccattcaactaaatccgcttcgatatcacttacacaaaactcttcttttgcgctaagtttatcaagcatcatttcaatagtgcggatagccatgcttaattcacgatcgagtttcatacaataccctcttcttcgagcacttcccagatcaggcgatccaggtgcatcaggttccacataacggagtcatacgaacccagcgagcgggagtaaatcactccccatgaacgataagccttttggaatgattcagcactgttttcatcgtgcggcatatcgtcacccgaagcgatcagcagtttcagaaccatcaggctattgagcgcctttggcgtgaattcttgttcgcttaacttcatcgcgtaccgttcgatgatcgcgattgacttcggatctttaatacgcccatctgtacggcgcgttttaaacgcgctcattaattcatcaactacggcggtacacttcatatgcttcatccttttcctgtgcagacatccgattatagcggatctcttcgcgctgttcaacttctctcacggcttcggctttcttctcagcagtgagtatgtgatgaactacagcgtttcggattccccagagatattcaatcatctgcatatcttcaacggtgtgatagcctttcgcatcacattcaaatacaatttcatcgcgttctgccattgccacctgtgcggtagaaggacaaataaccattccagagtatttttcaatcaacgattccagtgtacgcggttttgctggaatgtcaatagataccggaaccattcgcatcgttgaatcattatgggattgataaatcatcagaatgtaatctccgcaaactgcattctacgctcaatcgcatggatagcgttatcgcgctgttctttgttttcatatccagcccaggtaatcggggttgaacagatcaggtgaaaagtgattgctgggtgtctcttcccttcaacaacgattgttgcatcatcttcgatccaggttacgtgatccagattcaccggatagtttcttacggtaacagtttcaccaaccaaaagcgacacgtccagaatatcacgatcgcggacatatgatttaatacgagatacgattaacattatttcaactccactgcatatacatcggtttcaggggctttgtgtacgcgcatatctttaccacataccgcataagccggacagttacgacaaccgttatgatccttgttgccagtcagttctttacggaactgttttgttttcgggtgttcccagatatccttcacaaaatcttcggcttccagaacatccagaccttcttcccagccaccttcaacccagcgttcggtaaacgagcaagggaagaactgaccacgttcgttgatgtaagagctaaacatcgtcgcttcacagtcttcggcgtattgcttgtactgttcgaagttcgggtgtccctccatcgcttcaacgaaagcgggggctgaacagctatcgaatccaaatcctacaccagaatcgaggcaatattcaacaagttttttatattgttcgcgggtaacggtgtcccagttcttaccgcgtcctttttgtttcagtcccaggaacacgatcgcgtttacttgtttcaggcgcggatcattcttcacggcatcaaccacgttaaacgcgtcatcataggttttcgagctaaccatgaagtgaaggttgatttgctgttgtccggcttctgtcaggttcgctactgagtcgaaagcgacatcaaaaccagcgtgtttataaaccgataccgcaacagccccagcaaccgccgctaaacgcgctgcaacgtcttttgatacgtcagcaatggtaaggttcggcacaatgcctttagaacgcgcatacgccatcatatcgaacatatcagggtttgtttgtccctgtgcatcagcaccgagggcgcattgagtaagccagggcattttgtcgatgatttttttgaagttggcaagatccatgttgaacccgttcgggttattggacttgtagcagaacccgcagagtttacccgctggcccgttgcatttggtagtgatctcgatatcgagaatttcggggaatggtgcgtattctggatcgtgggaatatgttgcaccccagcgagcgaattcaccagtatcaacgttgaaattatagttgtagaacttcgagcgagcgaagcgcatattgccgtgttgatagatgaacagggacggcgctttgatgctggtaacgatatcgacagatttcataatataattctcaaaatttaacgtgggattggaagacagcgcgagcaaggctttcattgtcgaacggtatcgactggtgtttctctttgctgtcaatattaacgcgccagaactcactcgaaccgtttttggtggagtaatgcatcagcgttaccgttttattcttttccaggaaagtacgtttgtcaatctctgttttgatttcgtgctgcatcattttacactccgtttcagtttacgttcgtcagccagttcttttttgtacagtttaatgtacttcccgttaaggatgcgaagctgttggaaaactttgttacacaaagcacgttttgctttgtattccggcgtattgcggattgattcgatcgtcatacccatttcgtttttagggtaagcgcttaactccgcgccgatctctctgtaccagttgcttaactgatcacgctgtgctttgtactcttcaaaagttaacattataactgatctccgtaatctttcgctgcatcttcgggggttgcatccagtcggtaaagctcaacggctaacggactgggtttgatttcgcggttcaggatctcactgataccgcgaaggaattcgatataaggacggaatctcatttgatacgtaccgcgttaaaagcctggttgcgcagttcataagcctgttcaagctgttcagtagtgaacagagggctatcggtattagtggtgaaactgcaaatggttttgttgtcggcgttgacttcttcaacaacgatttcataaccccatgccccgctgtactcacatttcacgttccggtacttgatgtaaaccgctgcaatatcttcttttttgtagttccggcttttgtagatgatttccatgatatcctccttcgtttcgatgtgtgtacaataacagatcagggttatggagttttagcaattcgtgctaattacagtagcatttccatttgcaacagaacgctccagggattcggcggtaacagaaccattgaccgatattgcttgaccaccaccagacattcacgccgtcagttttgaattcgatgttcaggtagttactgaaaatatgtttcatgttattccccttatgccattttcttagcgattttccatgcggctttgaacgctggaacatcttcaacatcaacccagaaaccagaaccgaaaccatcgttgtagcaagggcaaccgtcgcagtagttttcccaggtcatcactttaccaccaacagaagcaccagtttccatcgcacgtaatgcatcttcaactttttccagtttttctgcattgtcgtcataaatgatgaagtaccatttgccgttgtattcgttacccagtttgattgcttcgcgaacaagtttcatgatgatttcctttttgtctgtttcgtttcgatgtgtgtaatataacaaaagcccctggcggttgcaaggggctttttaaacaaaaagtgctattttgtttcttcgaggattcgaaggatttcggcgcgggtgatcggatgttttgccagctcacggatcgcgtggtcaacgtgtatcttacacatcaaaaacttctccccgcacttgtcgcatgttgcatacatatcgccatgtatacgcccgatcccatcggttacggaatgatgcatccaggcgtaaggagttccccgcatccatccggtagcaacatgtttacattctcgttttcgtccgaacatattaccacccgttaggattgcggaaatgtgtttgccagtagcgcagttgttcgcggttcatgttttggttatcaatcaccataccctgaatcatctgcaacatcatgcgggtttgattgacatcctccaggctcgctatacgctgttttaaggctttgttttcctcttctaactcaaccatacggttgtatgcgttgacgcgctccagaggcatatcagggcgctctttgaggacacgggcgcgggatacttcgcattcgtgatttgctttccagtgcgcagcttctgattctgctttttgcttgtctcgaagcgcgagtgacagatcgctaaccagatccagaaccgtttgcggatctacggtttccagatattttccgagaccctcttcccagcttttaatctgtgtagggctgtcgccatatggaacaccatatgagaacgcgcgtttatactctttgcccctgaaaccatattcctgatttccctggatgctcatattttcaacgagagtccacttactacccatcatagaagaaatcgaacgggctgatttttcaatttcttcaagtttttcacttgttactttcattttgtactccacaaatcatattgtgcgcgaaggatagcgtaaaggctaccgatattgattgaatcgaccggacactggaacatatcagagcgcatcatattgaactcaatattgttctgttcaacgaagttaccgatcattgatgtccagcccatcaccaggttatatccgtcttcggataacccgtaagccaggttaaccctgatacaacgcttatcagccagttctacgctgatacagttacttgaatgcatggaattgcatggaaatttgttaggaaacttacggaacatctgggtaaggagtttagccgtttcaatgttgatcgcgcgttcctgatccctttgcgcctggttgtcatgacggcgattcagatacttttccatttttgggttgagattcacatgttgcataatatattcctcacaggtttaaagcgttcttttccggttccattacatgaactgcatttcggagatcggtcgctatcatatcgccccgatccgttacatgcaacacatttccgtaatttccagccatacacgaaccgcatgtaataatcggttcgtgcggccttgcgttcgtggaagttcatactttgttgtaaacctgaaccagccacatttcgatgttcggcgcgtaagtaacgtttaccatcggcatagtgcggtatttgtaagcggctttgtacgcatcgagttcagtcggaacacagaaagagaaaccgttgtcataacgttctgcattagaaacttcacaaccaactacagcggcaatgtttttgttcatgttcatgatgttttcctttctctgtttcgtttcgatgtgtgtaatataacaaagcccttgcattgctgcaagggcttttttcactttaatcgaatttttctggcaactgatctacaattacctgagtttgatggatttcttcactcaatttatcgcggtaatgaaccagttcacgggttctggatgctgaatagctaatgattttatcagcggtagcggtgtaaccgtaaccagcacatgcgatttccagttttgcgttatcgccattcggtacgcggatatgagcataggtcagcaagtttttaaccgcttgtaacagttcatgatcttctttaccgatgataaactgatttggttctactgaatcaatgttcagttcttcgtctttgttcattttgcagccttatacatttcaaggacgcggttcatatgctcttgtgattgaggcacacccgcgaagttcagtttgatgaagaattccagacgatcctttttggtgcattcatccagccccagggcaggtaatgaaatgttttcaaaggctcgctgttcgtgtcgtggcatttcgtcccagaacaaacgggaaccgtccggcataggaatcccaatttcaccttcgtagactttgataatcgtcgtcaggcgttgtttaccgtcgatgacttctacccagtgagtttcgttgaactggctatcaaccgcgatcgcgatgataccgcaagggaaaccactgatcagggtagtcagaaacgcatcttgctctttctgcgtccacacataggggcgctgataagatggattcagatccagatctttattcttccaccaatgcagataactcccaaccatgatcgcgtgatcgcgactgcgaaaagttaactgatcgcggatacggttatgaaccggaatatcatctttagacatgattcaccacccaacccaacaaaccagtattgatagccgcaacggtaaggcaaatcacagccaacacccgcgcgttatgaactttagttttcagttctgcgatctcctgatccttttcactttcgaactcgtcgcgggttccatagtaaccaggatcagcagcggttgcgatacgcactttgtctgtttcgaataatgttgattttccatgatccggcccaaccacacccagaataccatcacggtcggtattgacaattccgtgcgttccggctttggcaaacttaccatccttaacggttactacacgatcgccagctttgtaagtcataatatatcactctttcacgttttgttgtaagaactctaacagctttccttcggcctgtaaagcataaagtttattcaactttgcgatgttttcaaagtctgatttttcgctgaacgaccagacaccatcatcggaaaccagcgcacctattgatacgccagtttcaggatcacgcgtcaacgccagccccaggggatgtaggatatctttattgattttccagatcaaccccaattgagataaggtgttgaaatcaacgtgactcattaggcatcgcaccgaatgacagcagccccatacgatgatcgttatctgattcaccagtgctgaattcaaattcttcaccgctgatactgatagcacggaaaccatctttcaggtacggcaacagatacagagggatcagcatcatttttgaatcgtcatcccacttacggaagcccaggtttttcatttcttccagagtcaggtcatttggatcgactggttcgaaatcaggggaagcgtaaaggcgtccaggcagatcgcgaatatttttcacggtgaatgaatcaccccatgactgatacgcgataggttcagcggcgcgggttgcggtagccagaaggatcatttggcagatttggaaagtagttgcttttggtttcatgatgtatatcccacaagtttagtcagtaaattccccatagtcttacgcgcatgatcgcggatctggctatacggaacatatttgaagtcatccatttcagtaatggttcgaccatttttaacgaaggttgaagcacaaacacatttttctgcttcggggtaattattacccacatatacgaataacacaagctcttttttactcgtataatcaatcagacccaggctcaacagttcgtgttgttcaactacaacgcccgtttcctcgaagcattcacggatagcagcattgatcggggattcgcctttttcgatatgcccctttgggatgtcccaatgaggcgtttcggttgcgtggcccattaaaacgctgccgttattcaggaagagaataccagcagaccgttccattactgtgctccgaacttacgatcgtatgctgccagcgctttatctgctgcatcaactgcctgagtgtgtttgttagcggatttctcgctgaacacttcgcggtaaatggcaacccagagggatcggcgggtctgttcgctttcttcattgacgcgagaagccgcaaaagcgttatgttctttgatcagttgtgcgaattcagcatcatgatcaatggtttgttgttgaatagctgtagaagtcataattcacctatttctttcagttcagttttgagtttttcgagggttgattggtactgaatgccgttcacaatgtcgttgcgtcgggcataatacagcgtaccagttttgtttatctctgccaacacttctttatcgagtttatcaggttcattgctaaatgcaatcctgaacatttcttcggcgttcggcgcgaatccgttacagaacgtgataccgagtttcggatcgaagaatatcagggatactttattcactttttccataatgttcttcgtaatcctcgcattctgggagataggtttcgcagaacatacacagcgtgaagaatgtaggctggcgaattccgatattatcgggtaagtacatccagaacgtgttagcaaacacgatgaacgttttcaggttttcaacggttacggtactgataccgtcataaccggattgagtaattgcgcgttccaggggaacagggtattgctcgcagtagttggcgtaatgttcgcttgtcaccagcgcattagccgcttttacgagatcggtaattttcattcaatatatccccaacgaatttttacgttatcttctgacgccggacttgtaggagtcgggtacggatagctttgcgcttcccacagataaacaacagcatgttttgtcaattcttcgataacttcatcgaaagtaccgacactggtttgtaaaggcaacgagaaaggtttatcgttggtttctacttgagcgattggcccatctaccaagataacacgaaccgttgtgtgctcagacatatgagcatagattttgtttttcatgcgggtacatattccactttgacaggttttgcgataaggcgttctttagtgaagccttgcccgttacagatatcacaaacgtaactgatatcttccatctgatcaacccatccagaatccggcaagccagaaggatatgtgttgacacgtttgacttcaaaccctttaccttcgcatttagggcatacgtgcggatacttcgctttcagttctttggagatctgacgcaaagttttctcgccgccgaacacagcacacaattgctgtaaatcagggattcgaagatcggcgggagtaatcacactaaatttcttcatcatatatttctcacttaaagaattttttaatgaaagagaggaacaatccaccactgaacatgatccagtatcccgcgccgtcaccgttaaacaggacatacacagcgacaccatagcaaaagatttccgcgatattcagtaagtttctcataactccctcctttgtctacaccaggtattttaccagaaagtagattactgtcaacaacaaagttttatcaacccacttatcaccagtcattagtaatcccctacaggttgagaagatgcaacgctcaggatacggaaagagcattcattccatttgcaataagttttcgcacagtgaacagtgcctttcattacaaacccgtttgagaataccagccagtaaagtttcatgattgcctcctttgtttcgacacccctaatataacaaaagcccctgcacgaatgcaagggcttttttcaaatatttttcaacatgtgtagttgaggcggacaatcttttgaagcaatcaggcgatccaggcgtgacataacgcgtctgtagccgtcatactcgaacttgattttgggtgcgatgtaatttacatgtatcgcgtttcgcgtgttcaggctcaatgtatactcagggataacggttcggaatcgtaaagcaatcactggcttttcgtgagcaaccgaatcatccatgttttcgaacatctggacggtgaacgcacaggcaaacactttgccattaatccggcgatatgcaatgacttcctgcataccttcgtttttcgctttcaccgcgtaatacagaacgttacacgaataatgtttagcgagactattaagaatttcactgtagatctcaaagtcttttttgactgacgcggaacgatccaggaatcggtctgcgatgtgatctgtagtcattgaaacctttgtcacataccaatcacttaacgctttactgaaattttggttaacttctctgcgtaagttattgataacatacatcaatcgtgctctgttcataaatcacccattatgtttaaagtattcgatttgacgcagacgtttttccgctgcctctttcgaatcatattcaccaagttctttcgtgcgatcgtggttcagtacaacccacttatcgccgcgatgttcgatgtgctccgtgatgtcttcgactttcttatccagatccagcggttcagcatcttcctggatgatagtcaaatctacgggcaatgtcaacagtcttttaactccgctgatatcttcgatgcgggaatcatacgcgagggttacatgtggtttgtaatcgtcataatcgtatgttgctccagcatccattgcatctttgaagcggctatggagataatcagactccagaacgcccacgatcgtattaccgtatttcgtttcccacttctccacgtcaaccagtcgggcaggttcagagataccggatgcagggaacagatcaaccgtcttacggctatacacaatcgttgtatgcagctttgcagcggaaacaggattctctacacccagaagtttttgcaccttcgcgagcgcttcacaggaagcctgatcgaacttcgcacacatatagatccccgaatcaactacgggtttcgctacttcaagaaaacttttcatgtgtactccaaatgaaaaaggggctttcgcccccagtggttaaacgcctaagcgttaattatgcttttgatgcatcaatcgcttcattatcaccagcgatttctactgttgctggcagaagtgctttgatcgcgccgatcagggcatcaggggatacaccctgcgaaccgtcgatttccagaagaccgcaaatctggcctacgagttgacggtgatttgccagttcttgttctttaccctgaatgatttcgttcaggtcgaatacacgggctttcaggatcaggacatcgttttgaagctgttgggtttggttttgttcagtcattgtttacactcttaaaagattgaatacattaagcacgttacgtttcaaatcgtctaacgtaccattatttaggattgtataatcagtcaagccaggtgtcaaacctttctccgttgaatgattatcttcaataccagtttcacgttcaaggaacacaaagcgagtcccgaacttgctcaggtatttatattcgtgcggttgacgcacatcggtaatgataaagtgatccgcgtaggatttcaacattttttgaatagcaattgaagtccatatagacggatctattttacaaacaatatcagtcccgaacacctgcatcaaacggcgaatcgtccagggctggctgttttcttcgcaaattttatgagcgataacatctgcgttactcatgaagaacccgcgagaacttaattttttgataccgctagaaaacagcgcgtatgcatcgttattggacatcaccagcggggcttcacgatcaccctcatagaatgggttcttcgctgccagcgctcgcaattgcgtgttatcgtgatgttccatagaacgtttcaggatagctttgatttcgtcggctaacgcgataacttcaacattacggaagttatgcacaaccatttgagcaacggtatctttacccgttcgctttttaccacaaataccataaatcatttttgcgttttccgtggagtaggcacgatcacccgtccgtcgatctcaatttccatgtgagcgaagttgaacatcgtcatacaggatacggcttcatccgaatcattggtatacataagctcaagctctccgaggttggagggccaagcgccatagaagcgaaatgtcgctacagtttttgactgcgagttatccaggatatgcaaagccattgcctgttgtggttcactccaacgcacggaatcgaaggtgttaaaatcgacagtaccgagcatccaaaggtaaaccccaagatacgatcgcagttcttcatcaacagcaaaacgaatagtcagtggatcgaactccattgcagatcctgggatcttccctcgaatcattgggttcagtgggacatccgtaattggaatgttgatagcaggtagtgtaacaccctgaacttgtagtttcaacccttttacataatcattgtcaggaatatctaacatgaagttagtaggtgaaatctggttcaggatcatagcagttgtattcatgatgatctccattttatagatatttagatcaagaccgtgagcgaagcgaacacacgaacgaagtgagtgttatgtacgatgtactgtttataatatttatattttatatatagagaaaacagtacattttcgtatactttttatacaatcgttaactatccgtcttcgcttcgcttgacggaactcgcttcgctcgcgatctaatttttagttgatctattcaataaataggtatatcatacctatactttcaaaagagattgaaaacatgaaatcattcaaagaactactttctgaatctgttcagaacaaaaaatttgctaagaccgttgatctggttgaccgtggtaacgctgcaaaaggtcagattggtttcctgcattttgcacatggtgctgattacgatgtgtatgcgccggactcccacgatctcgcttacttcggtaaaggtgttgtccgcctgaaaggtaaaaccactggcaaaactcaggcagcgtatattgactgggcgaaaggcactgtttcattctacagcggtgatcctgctgatgacctgaaatttgacaagccactgaaattcaaaggcgcttccctgtacaaagaggccgaagaaaaccttgatctgtataatcagttggcggaagatttcgaaattgatctgcctctggatgaagcattggtgaaaggaaaggtgtacaagctcccaagtaacgatatgtgcttgctgtataccggacgtaccaaaaccaaagaaacaggtgaatacgccgtgtttacggttgtagatgcctctggtaagcctcgtctggtatcgggtaaacgctttacccaagaatacaaaggcgatgttctgtctaaactggttctcgctgaatcggaagatctgaacgaagccgctaaagatattcgcgaaaaagttattgcggtgttggtgaaacgtgggtttaacgaaaaagacgcagaaaagatggttgataaaaacctgaaagatgcgatgaaggttcgacctggcgcaacccctggaaaactcgcggaaatcgtgagtaccctgtaaaaataaagccccttcctttcggttggggctttttgttaatatctgttccaaactttcttcgcgctgtatggttttcctttggactggaaagcctgtgtaggcaaccaaactgctttcgcccaatcttttggtgcgatctctgcaagtggtgaacgtagatgggctggcaggtaggctttgatcatttgatcagccccgcgcattcccttcacgttgttccagttgattttcagtctggttttgttagaaagtcgatctgttgatccgtagccacgtttcaggagttcttctaaaaactcttgacgtgctcgcggtggcgcatagtgcaagttcagcccgtacagaaccaagttacccgctttcgaacgtcctgaacccaggaaaatgatcagcgggaaccgatcccagtatggcagggtgtctttgtatttcgcatcgtagatgaacgtatacaagcgacccgttgctggtttcgcaaccctgtgcgtcttaatgctggttttgatgaaatcaccaaaccaatcggtcgaatctttctgacgtttcgcagcggttacaccaacagtcattttcttcaaactgttgcggaaatcgtttacgatatcaaccgcgtgttttttgcgatagtcattacgtttgcgtcgggcttcggtttctgctttacggcgttcgatttcatcatcaatctgctgcttatagcggtgcatagactttgtgaacgttgcgtatgcaatcccgttttcgtccgcgaactttttggctgtcatgccttttaattttgcgcgtcggaatttgataccaagttcaacccattcacccagctttcgcttcggtggcggttttggcttgtcttcttctgcgatgatctcgaactcaaaaataaaactcataattccctccgtttagggtatttattgccctttccatccgaacacacgtttcaatgtgtcctctgtgatgatcttgaactcccagcccttttgttttgctgctgcattcgcggctttccatttgtcgatgtttaccgcataagtatacagcgcatcaacaaatttctttttgttgtgaacgttgttgttcgctggcttaggtgggggcaacgtttctttcatcggtttgacttcccaaaggtaggtcacaccgttatccatttcaacatagaaatccatgaagtagcgccgtcgctttccgtctgcgttgctgaaataagggatcacaacctcttcactgttccagcgtttcacatgcgggtttttatcaagccagttcataatatatttttcccagcttgaacgatacgttatctttcgcggatctcccttatatttctgtatgttctggggcataaaagaccccttgtatgtctgtcttccagccattttagatcctaaatatagtaaacattagataggggaaattacaatgttattttcgttctttccaccagttgattacaaaggcacaccaactactgatatctaccgcgattatcgtttttactttaaccgcgtgatcaggaattataagccgcgtacatatcaactgacaggttcattaagacccgaacaattagcggaaacgctatacggaaaccagcaatactactgggttatcctgatgcttaacgataattacgatccgttttacggatggattaccgatcaggaaacggcttatcaatgcgctatccagcgttattcaaaagcaggtggtgaacaggttctttatcatatggatggtaagggcaaccgttattacaatttggttgaagaccctacgaatcccggtcattggtatgacaaaggcgataagaacatgcgttatttgcagtaccagggaacattagtccctgtagatatttatgaagatgcggtgcttcaaaatgaagcaaaacgaaccatcaagattattaacccctctgatattcaatcgtttgtaagcgattatatcaaggaaatggaaaaggcaaacctatgaaatacggtggaaataaatactcccctttctttgagggggtggtcgaagaagtcgatgatcctcgtctactggggcgtgttcaggtgcgtgtattcggtgagcatccggcacagaaacaaaaatctgaaactatcggtattccagttgaggaattaccgtggatgatgcctattcaggatattcgcagcgccgctatttctggtgttggtttttccccgactggtatcacgcgcggtagttttgttatcggttactggcgcgataaatggcaccaggacggcgttatactgggaacctttgcgggtgagtaccgagagaagccggacacccagaaaggcttctgtgacccgtttggtgagtatcctcgttatgtaggtaatgatgtcaacgtactggctcgcggtggcgcagaggggcgcggttcttcgagcgtgattattcgtgatgctaacagttcgttagctgtcaatccagatgatcgcccacttgacgagatcccagaagataaccgtcctgatactggcgggttcactatcgaaaccatgcttaaacaggatgaaggtatccgcacaaaatggtatattgatagtgaaggttatccgactatcgggatcgggcatttgcttatcatggaaaaaacccgtgatactgcgaagattaacgccgcgatcagtaaagcagttggtcgagaagtaaccaatggaacgatcacagcagaagaagtttcaacgctgtttgctcaggatttggcaaaagtccggcaggggatcagcaacacttcaaacgttcgagaagtatacgtgacgttaaaccgtcctcgtcaaatggcaatcgaaaacatgtgcttccagatgggtgttggtggtgttgccaaatttactaatgctctggctgctatgaagcgtcaggactggcaaaccgcttacaacgaactgcgaaactcaacatgggctaaccagacaccaggacgttcttcacgcgtatctaaaatcgtgctgacgggcaacctcgaatcatacggtgttcaggttccagatccagaagggcgttcattgagtgctgcatacaatgctgttgtgttggctgcatcaaacccagaagatccttttgttcctggtgatactcgcgtaatgttcgaggaacctaaatccgcatacgctgctgaatatccatacaacatggtattcgaatcccgttctggacacattcaggaattcgacgatacaccgggctttgaacgttacaaccgtgttcacccagcaggatcatacgaagaaattcgccctgatggaacccgtgttgttaaaatcgttggtgatgattatcaaatcgtcatgcaaggccgtaaattaaacgttaagggtaatttacaggttgttatcgagggtgatgcgttcatttataatatgggtaacgttcaacagaccgttgatggtaacgtgaccgagttcgttcgcggtaatgtaaatcaaaccgttgaaggtgaatatttggggctgattaaaggcaacgcagaattaaccgttgaaaaagatgcaaccgtaaacgtgaatcagaatttaatggctaacgttaaacagaatgcaactgttgccgtaacagaagatgcaacaattaccgcaaaaaatgctctgattgatattgagcaagatttggatattggcgcacgtaatatcaacatgcgagcatcgaataatactttcattgattccggcgcactgactaagatcactggcggaacagtccaagttgggtaatgtatgaattataaacgcatctacaaagaaatcatcgagaacaggagaaataatcctgttagtggaatggttgaagtacatcatatcattcctaaatctatgggtggtgacgattcagagggcaacttgattgccctttcacccagggaacattttgttgcgcattatcttcttgcgaagattcacaacaacaaatctatgtggtgtgcgtactggtttatgtgcaatacccgtgacgtgaaaataacatcacgccagtatgatacagcccgtaaactttcgagcgaacatttgaaaggaaatactcatacgctggggcatactttatcgcaaagtcatcgcaagaaaataggcgatggtgttcgtggagaacgtaacggaaactacggtaaaactttttcggaagagcataagagaaagattgccgaaagtagaagagggaaaccacacgacgaagaatcccgtaagcgtatgattgaagccgctaaacataaagaaaaagttacctgcattcattgtaatcgtgttcttgacaaaggcaattacaagttatggcatggcgacaaatgcaaaatgaaggtaggctaaacatgatcatggattatgaaaccatcattgatgggattatgcaaaattttcagcatccttgcgatgctgagatccccgctggatattacagacgcgttatctggcagggacacacagaaaattaccctgctgttggggtagaatgggcgaccgaaatcatcccgatcggaactcacctgtatacgagttcccctttcggacagaaaagcgatccgcttccggtggtgaactctccaaacgtacccacgaatccagacggaaccccaggggtttctactgacattctggttacgaagattggttattatttcgccagtcaagcggatattgatgcctatatcgcatctatcggggctactaagctcgcgggtaatgactggtacggggcggatctatcaaaagcgaatctgttcaagaaccctggcgaactcgcgatgtacaaggtggaaaactccggtggttacttgctgacttccggcccccgttgcgatcagcgaatccgacaggtatacaaccagactacaggcgcgtttaccagcattgattactactggaatggtaatcgtattgcgtacatgaaacacgacgaatcccccgcacaccagtgcaaatatacagggatgtcagtaaacacgaacgcagataccagcattcctccggttcctcctgctctcccgtcaacgtatggggcgctaccgagtgaagccagattgttttctgctcgctctggattgggctgtattccggcgaccgtggggttcccgtatacgaatatcagcgatgctatgctttccgcgtggaacgagactcgtaaaacgttcaagctggctttcgatatgctgacgggtacaattaaaaatggctctggtatcgcgacgatgtttgacgggctttcaatcgggatggaagaaatcacagcgggtgctctggcattgtcacagcaagcatggcaaaccgcaatgaaggtgttccggcagatcattagctctgcgtttaacatcgtgggtggggcatggagtctgatcaataacttcctcccgactgttgcgatcctgggtgttgcaatcaacatttacgatctggtgtttggtgatagttcggttcaatccctgaaagattctttccaggctctgattgactccggcgcacagacgtatgaaagcgtcataaacgcaatctacggggctataggcagttcttacaactacaccgttgaatatgtcaaggctggcgctcgcgaccttgtagacgcttgtagcgcgttatttgactggtgtttgactatgttccaaaacggttgcgttgctctggtggatttgtacgggcgtatgatgcagatctggtcaatgcctccagaaacaccaaacccgctttggtctgcggtgctggctatccgtaacatcatgcgacagattaaacctcttgatgtgattctgggcggtaacttcccagggtttacagcaatggatctgtatcagcaagcacaagcgaaagtgaaagcgttcattgatgcatcctatgcgcagatctccgcattgtatgatcaggggcaagaactattcaacaccctgaaaacacagacacaggaaagggattcgattaaacgcaagttcgatcagtacctaaactggatgtgggaacctgtaacggaagcaacaaccgctgcttatcaggctgcacttgatgccgctaacgctgctgtgaatgcgactaaggccgcatatgagggaatcaaagcacagattgctactctgcaagatgggatgaaagacacctacagcatggcaatggctgaactcaaaaaactgcctgtaatggctcagattaaccagttcttaggttactgtggggttgcattcgatgacctgttaaaaacgtatgagaacgcgctgacgggcgcacaatcgctatataaaaactttgttgacagttcccgctcgtttaaggacacatgcaaggtgatttataaccagatttgtacgcttgctctaagtaaggtaactcaatacgtaaacaaattattgtcattaatcggactcgcgatcacattcggttcaattagtgtttgcgtccctatggttcaatactaaatacccgataacgaggggtaataatggctactacaaagaaacaaattaatcagatccccgatatctttgtcggggctacttttgacgaaatcaaatctgacttaatcaactggctccgaggtcaggacgaattcaaggattatgatttctccggctcgcgcatgaacgtacttgtggatctgttatcatactgtacactgtacattcagcaaatgagtaacaccgcactgttcgaatcgtttattcgtaccgctgcattgcgtagttctgttgttcaacaggctcaggatttgggctatatgccggactcccgcaccgctgcaaatacttcgatcctgatcactgcgaaaaacccactgaacccaacatcgatccgtattccacgcggtacgaaattcatcggtacagtgaaagaaacaaacagtttcccgttcgtcgtatccgatgacgtggtgatcgttcgtgacaaaaacaataactatgtttcgatgttgaacatcgttcaggggcgtttagtccgtaccgaagtcatctttgatggttcgactatcctgatccgtgatccaaacatcgaccgtagccaggttcgtgttaccgtcaacggcgcacaatgggatgactggacaaacgaaagtatcgtaaacgcaacgggtgcatcaactgttttctatatgcgtgaaactgttgatggacataccgaagtttactttggtgaaggtgaaaccagccaacaggtcgcgggtggtgctctgactgctgattacatcgggggcttgaaacctgcaaacggttcaaccgttgttattgaatatatttcaaccaacggcgaagaagcaaacggtgctgaaaactttgtttacgtggatacgttgacaaacattagcattacgagtattgttgagaacccgactaattcagcggactatgtaggcgctgatggtggtggtgaaccggaagatatcgaacgtattcgcgaactcgcgcctatcatgcgtgagacacagcgccgttgtgttactgcatcggattatgaatcgttcttgtctcaccgtttcggttctgttattcaggcggttcagtgctttactgataaagaaaaacctggctatgcgttcatcgcggttaaaccgaaatcagggttgcgtttgacctctgttcaaaaagaggatatgcaaaactatctggcgaagtataaccttgcgacgattacgccgtcgatccttgacccgaactatctgtacatcgtacaaagtatcaaagtaacgtatgatatcagtaagttggttgaatcagaggaatggttgcgtggtcaagtaatcaatgaggttgacagatattatactgataacgttgaaattttcaacaaatcattcagtaagtccaaaatgttaacctatgttgataacgcggacgtgtcgatcattggttcttctgcgactattcagctattgcgtgaacttgataactattacagcgctccgatgtctggtattcacttcttaaaccaggtgaaatcacgttctgttgtttcgaacgggttcaaatacacaaacgctgctggtgattcgtatgatgtgcgttatgcatcaaccgatatgaacaccacaaccggacgtgcaaaaattgttatcgggccattcaaaaacggtgatatcagtatcgcagcctatacaggaaccgattttgataaatatcctggagtgaccgatcgtaataaatattacgaagtcggctatgtggaacactacactgatttcattagtttcgatctgggtgtcctgaacgttccatccgagcgattcagcgctgcttatatcgaactgactggtacaccattggaagagaacattttcacccgtgatggttctctgattgtgtttgaaaacgatctccgtcctcaatatacaacattgacaatgaatccaatcagtcaataattttaacccctgtcatccggcaggggttttttgtttgctaaatatgggatataagtaacgcaaatttggagaaacataatgattaaagcgccgtcaattaccagtttgcgcgttgataaactggctgctaacttcgtttatttgaagtgggatagcgtcggcatggatttttactatgtcgtggaaatggcagaaactcgcggggcaggtggtgttactattccagatgaagatttaacctggttccagttgggttacgcttttttgaatgaatggttttcttccgatgtccagccaaacaatttttataaattccgcgtcatggttacgcacaagggctttgaaccgtctgattgggtttatacagatgaattatggacgttcagccttaacgcctacgcatattcaacaatgcgtgaatttacgccaagtgatgcattcataaacgaaaaattcgcaaagaacaatcagaactacgttaacttcaatacagatgtggtaatggcagcgttgatgaaagaagactttgtgttttctccactttacactgacgtatcccagatcagcgataaaattcttacacaagaaaactatcacgaaatccaggatcatattgaacacgtttgtaatgacattaacagaactttcctggtagcgtcaaacggtttgctgtacctgtttgaacgttttcagaacatggcaaaggtgtcaaacgacaaagggcagacatggcattactacaaagcatttaacgaccgcgtaggaaaccctgtatcgcgctctattgcgtaccaaagccgaaacacaacctatgtactgggttacgatcgtatcttctacgggcgcacctcaacggatattcgctggtctgcggacgatgtgcgattctctgctgatgacgttacgtttgccaaactggggaaccagactggccttgatttcgacgtagactcatacaacacattcgctaaactgcctggtaacgtgtcgaaatatgcagaagcaatggcatgttccgatgactggctttatgtggttgcgaaaaacgttgtgcgtcgtatcgcactgaaacagacaccgatcgacaccgatccgagttctccgacgttcggagaaaagattttcgatacagcaagctatacagttgtccctggaaatgataagatcgttgtcaagaaaatggatgtgatgaacgggattctttatgcactcgttacgggtgaagtgaaaaccgctctgcaagatcctacaaaacccgctaacgtggttccgtccgctgctgctggtgtgtatcaatggaaagaagacacgaaaacctttgtgcgcctgtacgggaacaccgagaaagaacgtttttatatccagcatgaatacaccaatatgtcaacgaacggcacggagatttttatttccgtagcaaactacaaatatccaggcacacttcccgatcctgaattgttgatcgagaaccctgcactggtcggtgctgtaaaatatgatctgcgtcctggctatactgccagccttgcgattaactttgcgacgattcgcgctcatatcgacgacccgactgtttggaaatttggtgcgcaggaatactacaacgaggcgaattatagctggttcttccgcgactctgtgcgcacatggatcactaatgataaccgtcctctggtggtgtatccgaaaatcacctacagccttgtaaccgatagtgctggcccttcgtcatcgcttcgtgtgaacaaagaggtatgggatcgcggacatgttacgatttacattaacaacattaagtttaccggattcacgaagtatacgaacggcgtgttgctatataagagttcaggcgaaatcatcgggttctttgaactgagttaccgcgctcgcgataacttaacgattttctggaaaccagacaatacgttattgattgccgatctgattcagcaggaacgcgaaaaaccgtatcaaccggatctgtcacctggtttgattgacccagatttaagccatatgattacgcgctttgcgcctcaaagctatctggatcagcagtatttcgagaagttcggggaatactatttgcagttcgtttcgctgggtgaaaacacctactataacaagctgcttaacctgatcaggaacaaatatccgcgtgagaagaacagcgtagaatatctgtggtcggaagtaaaccgccgtaatatctacctggataaaacgaagcgtgatcaggtggttcgtttctttgaatctcgttgtagtgatttctactcaacgaaaggcatcgaagcaagctataaattcctgttcaaactgttgtataacgaagatgtaagtgtagaaatcgaaagttcgaacactctggaatatgatattctggttcattcaacaaatatcaaccaggatattgtaggccggacgatttacacaccaacagcgagagcaaacgtgacgtatatcgaacgccagtatgatgacggtcaattacgttggtcggtaacgctgcacaacgtgatcggtaacttccttgaagggcaggttgtcaagtctgaaaagactaacttcacaggtactattctgcgtggtgtgcgtggtaagcaaatggcgaacaactcgatcgactacttcaaccgtgggcgttcttactacgtgatgaaaattcgttcgaatctgccagcgtcccgttataaggatgacgttttacgattcgtgcatccggtaggctttggctttatcgggatcaccatgctaacggtgttcatcaactccggtttgtctatgacgcatagtgaaacgatcattgacattcttcgaaattatcgcttcgatagcggttatccgaagtattggcctgatcgcgtagcacgtctggacggtaacggaaaccagacatttgaccttgtaactggtgaagcattgtacgacccgcacccgaaagcgggacaaccgtttgatgttccgccacaatatgacattgatgaaaaaccgctgaatggtgtactgccgtccgcgcgtcgatttgatcaaagtcctctgttcgatagttcagcggttaaatactctcagttccgtaacttagtggaaaaacgattgaaagacgacgcgggtaatcctcgcgatccgaatccaccgactcagagaaaggtagcataatggctcaacaaaacatctaccgtgcggtcgtaactggtaagttccgcacggaaaacatgatgaactttcgcgaaatgatcggggacacccccgatcataactcgatttatatgtcaatcgggcgtaccgaacaatgggcggataacgaatccgaccctgaattcgctcccccttatccgaacgatgatacagatggtatcgttgatatgtggacgcatatgatcgggatgacgaaagtaccaggcgaaatgattgatgcaatcgttccgcgtaaagactggggcgatactcgatatccaaacccaaaaatcttttacattaatgacatcgtggttgtaaactccgcgccttataaccgtactgactacggtaaaggatggatggtataccgcgttgtagacgttcctgatattggatcttgttcaatctccagtatcacgggtaaagttgaatgtgtgcgcattggtggcatttggacaccgacccacgaatcgatcgaacctccgcgcggggaagcgaacggtatcgacatgggcgacggctatatctgggaatatctgtatacaattccaccagatgttgttatcaaccgctgtacaaatgaacatatcgttgttccgttccctgatgaacttgaagaagacccggttcgttggggttatgataacgtgatcaaatggtatcctgatatgtacgatttggtgtaccgaatgaaggttcactcaatgcgattccgcgcgtatatggattccctgttcttcccgcaagcctctttacctggcaaccgtgggttccgtcaaatcagcgttattgtaaacccgctgttgaaaaaggcgcaaccatccgacccagaagtaaaagcaacgaggcagtattacacgaaaggacagcttgaacttgactcaggacaaatgatctacatggaaaaccgtcaaccgattattcgttctcctgatcagaccgaagaagtcagtattattttcgaattctaaggaaaccataatggcatatcaaactggtaaaaaattaattgacgtggggcaaatcggcaacccgtcaactggtgacccgctgtatgacggcggtgttaaacttaacgaaatcatcaccaacgtatacaatgcgtttggtgatgtgcgtttactgactgcgaatgatggtgtgggtacaatgttactccacgcgaccggatatttccagaaattaccgcgaacctattattcaggaaacccgattgaactaggttcactgcatgatatggatacctctacagggccaattacggttgtgcttccatcgggtaaacctggcgaggggttctatttcataaatagtaacggtagtatttctgttgatcgtcctgttgtattccgtccgcaagttggtgatggtatcaaaggggttcaggatcaactttacgtgacctctccatatactcagattaaaatctggtgtgtgaagaaagaaggttccgttactacatgggattattctgttgaatcaatgtttggttcaaaaacaatgcctgtagatactactaaactcattctgaaagcatcaccgaccgcaattcctttatttggttatagtgaattcagtggggcgaaaattctcgtgtacgcggagaatatgacaggcacagtcaataaaatggctgaaattcttttgtctgttgaccgtgtcgctaagggcgtgtattcaactgaatacgcagttctcaaaaatagcgaagatgaaatgtacacgcttacgttcactgttggtgcgagtgatattgtttacgcaaacgtacaatccaaaaccgagaatcgcattaaattctcgattaaagcggttgacaccattaaatcagggatcgcagcatgaaacaagaaattcttatcggtaacgtggttgatgacggcgcgggtgattatctgcgtcgtggtggtcagaagactaacgccaactttaccgaattatataataaactgggtgacgggagtatcccgcacccagcgggtgcgtggaaaacgcacacagcgcctacgctgacccctattttcggtgaatcatgggcgctgaataccagcaacaaccgtattacggtaaacctccctaaaggcagtgtaagcgattataacaaggttattcgcttacgtgacgtatggggtaagtgggcggtaaacaacgtccgtatcgtccctgcaagcggtgataccatcaaaggctcaccgacttacaaagaactgtacaaagacctgatggacgttgaacttgtttattgttctcctggacgttgggaatatgttgaaaacaaacaggttgacaaaatcacaacttcggatctggcaaccgttgcgaaagaaacgtatatcgcgactcagggacaaactgacttcctgaacgtgttcggccctggtaactcgtacaacgtccgcgcactggaagtttactatcgcggtaacttgctgtacatcgacgacaagagcgggtttaattcatcaaacagcgattacggttcacctggtgcgagcgccggacaactggtagatctggatggtgtaaatatccgtcttaaaaacccgtgtaacgctggtgacacgcttcaattcgttacctatctggatggtattgctgcatggcgagcgacgtatgaagcgcataccatgcgcgtatataacacgggcgacacagaacaggttagtatccctggtgaaatctgggttggtgatttatcaactaaacgcacgtttactaatgctgaatttgggatcagtccccgaattttgattaacccaaactcgttcgaactactgttgaacggtcgccagcttgttaaagcaggtgatgcggatctcccgacatttgtttgtgagggcgcagaaggttatgatgaaagtagctgtattgcgaactccggcgcatgggttccttctggacaggattacagtctgatttttgttaactccgtggttacgggtattaaatttgctcaacctctggaatcccgtgatgtggtaactattcgctggttcaacaatgatatcggtactgtcatggaatgggacggtgtaggcggtattaaagaacacaccgataagatttacctgaacaacgaagaagaagtgacgctggttaatcagattgaatataccgattataacaacccaacgcagaaaacctcgcgtaaagtagcggatacatttagcggtcgtcttctggatctgcaagcgttctttgatgttattcacccaatcgggacaatctacgaaaacgcgcataatgatgctaacccaggtgattatatgggctttggtatctggacacgttacgcggaaggtatgttccttgcaggttggacaaccgatgcatcggatagcgattttggtctgaacaataacgatctggacggttccggtcaaccaactcacacttctggtggtactggtggcgaacgtggttatgaaattaaaccgatcaacgttccacaaattcagtcaaccgataaggtgttgattaaagatgacaacgggatcattattattggtggctgtcaggttgacccagatgcaacagggccaggttacactaaataccgcgaggatgtattaaaagtaaatcgggggaacactactccagataaactaaaaacgctcccgccttatattactgttcaccgctggataagggtagcataaatgactcagtttatttccaaaacaagggagggggcgaaagtcccttcccgcaaagcagactttttgcaatatgaaatgggtacgaaagaaccgctgattggcggtaaacgtactattggtggtgcaaacgtcgatcagcttcgaaaaggggtagattaccctaacgtacaatcagcaattgatgacctgtattctttgtctcaacagatccccatcaatggggtaatcatgatgacggaagatagccccccttctgcggtgcaacaggtagaatcaattacgtttgatgggacggtttcaaacccagatccagatcaaacacaggcgactattcacgtttatggtttcccgttcgttttcggcaatacaacgaacgcctctaccgtatgtgagacagtctataacaaattcgttgaattcgtcaacgatgaaaaatatttcgatttggttactcgtaaaggtctcaacggggaaattctggaagttcgttttattgattcagttccgcatccggttactaataaaactgaatatggaatttcgatggtaggaacaatcgacgtacaggctaaatctggttacggtacatggacaaagttaggtgaaattgaccttgctgttactccagcagttccgatttattatttcaagcgtattgcatgaggataacaaatgaacaatacaattaaccacgtaagcgataaatccgtttacgtgacatttgatcctgctggtacgcaatggcctagcacgtttaagaacgtacaacaggcattagccgctattgggccgtgggcgcgtactgatgttggattgcctaatgccgcgcctggtgtgcgcggtattgctgctattgcgacacaggcaatgattgacgcgggtactgacacacagacgattgtaactccggctttgctggcgtatcgtttgcaaaaccctcatgcatcacaaaccgtatggggttacactcgttacgcaactgatgtagaatcagtaacagtaacaaacgatctggtttctcttactccgcgctcgttgaactatgtgtttaacacccgtcaggcaaaagaaaacgtttggggttctgcgaaactgtcaacaactgctcaggcaacgtccggtactgatgacactaccgcaatgactccgcttaaagtgaaacaggcaatctctgctctggttccggtacagtcaaacgcaacagaaagttcgtttggtcttgttcagttagcaacagttgcagaagttcgcgcgggtactattcgcgatgggtttgcgatttcaccatacacgtttattcgtctgactgcaagcgaaagtgatttaggtttactccgtatcgctacccaggcagaagtaaacgcgggtactgataacaccaaagcgatcaccccgcaaaaactcgctgctgtgaagggttccggctctactttcggtatggttaaattaacaacagatatcaataccggattagcgaatactgctttgtctgctggtgctaacgtagtaccgagcaacaaaaacagtgcaattactggtggtgcattgtatcagggttcgattagtgctgacaataaataccagacaaagacagatgttgacgcaaatatcccgatcggatgtatgatgcttgcagcgtttaacgccgatgttggtaacttgtttatctgtaacgggcgagcgatgaaccgcaattcaaacccagaactgtttgcccgaattggttatacatacggcggttctggtgatattttcaacttgcctgatatgcgcggtcttgtagctcgcggctttgatggtgggcgtggtttggatgcaggtcgcggttttggtacatatcaggctgatatgtttgcgtatcacgaacatgatctccagatgatttaccagaacggcggtaatcttcctaagagtcaagcagtttatgaactgaaaggcgcagaaaagaatgaccaacgtgttatgcacctgaataacgattacagcaaagcattaggtactggcggaaacgaaacgcgaatgaaaaaccttgcggtcaactacgtaattcgagtacgataaaggggttaatccatgatttcaaaacttaacccgttaccaaagatcccgtttgttgatggtgtccctgcggacaccacacaaacccagatcaattggattgttaacggcgaaactctcgatggtgcaaaaaccaaaaccactaacgagggttctttaaacagatgcggtgttctggttcaaaagaacgcggtacaattagaagcaaatacaactacccagacatcaaaaatcaacgaagttatcgatcaggttaacctcattactgaaaacctcgcggcgatctctgatgatagtgtgatcgacaaactggataaagttgtcgctgatgttgacgtgctgaaagtagatatgtctgctgtacaggcaactacagcaagcaacaccctgaaaattcaggatatcgaaaaggaaattggtgtatgggatgcgtcaaccgatcctaaacatcgtaccattcgaaaagatattattttcctgaaaggtgaactgggtgcatatcctggcttcaacgaaaatggtgatgtcgatccgtcctctactggctccggcgtgaaatacaaggtaatggctaacgctcaggcggtatctatccatgaagcacgtattactaagctggaagatgactgggtaaactcagatgtaggccatttaaccgacgaagttaccgatctgcgtaacgaaatggggccgaagcatttagccactttcgaatctgtgtatgttcgtctgaatggtatcggtggcgatatcactggtattaataccgaactgtcaaacatcaacacttatatcgggcgtacaggctcaggtggttctggtagtatagattcccgcatggaaactgcggaaacgaacattactactctgcaaacccagatgaatgatccggttgttggtgttctgcctcgcgtaatccttctggaaagcgctgttggtaactcacaggttccaggtagtatccgttacgatatcagcacaatgaaacgtagcattagcgatctgaatatgatcgttggtgaaacaagtgatgatggtctgcgcggtgaaatggcacaggttatgaccgatatcggtactgactctcagccaacgagcatgaaaggccgtattctgaacctggaaaacacacagcgcgacgatcaccaggcactgattgatgttaccgcaattgtgggtaatacgtcaactggactcgttgcggctaatatcgcgatgggtaaagctgtttatggtgacgcaaccagttctgatccattcctcaaagatggtattcagaaaacggctcgcgataacaaaactgcgatcggcgttaatactacaggatcagaaacagggatttataaactgatttccgatctgactgcgcgtgttgctgctctcgaagctggcggtggtggtaacgttgaacaacgtctggacgatctggaacagaataaagcctctcacaaggatgttactgatgctctggttccgtatatcacagaagttgaagcggataacaaatacgaagcgaagaaagttccactgtcatttactcaaaatctggtcggtcgtaacgattatatcgagggtgatgatatttctttatctgttaccgttacaggtggtaaactgccttatgtgtaccagtggaagaaaggaaccgcaaatatcgggactgattcaccgagtgtaatgatccagaacatcacaacgagtgattccggcgtatataaagttgtcgtaaccgacgctgaaaataccgtgattacttctgatgaacttgacattacggtatacacggttcctcagttcgatacaaacttgagcgatatttctgttgctgatggtgaaccattgactctggaagtagtgtttagtggtggtaaacctccatacacttacgtatggtataaagacggttctgtactgactggcgaaactggttcttctatcgttaaatctgctacaaccagcgaagatgcgggtgtttaccatgtaaccgtaactgacgcgatgaatagcacaagcgattcagcaacagcgactgtcacggtagcataattttaacaaggggcgcaagccccttttgaggatcatatgattacgaacaatccagaacagttaaaggatgaaattcttcgtcgtctgggcgcaccaatcatcaaaatcgaaatcacacaagatcagatttatgactgcattcaacgcgctttagacctgtatgcagaatatcattataacggcacaaacaaaacgtatctgattttgacactgggcgatgataatccgcgcaacgtgttcgacttgagcaaagagcacatcttcgcgatcacgaaggtattgcgtacaaacatgggttcattgaccacaatggacggtacagcggtttatccgtggtttaccgatttcctgatggggctgactggtggctctctgggtgggcgctgtgcatcgagtgtgtacggtatgaacgcatacggcgcggatatgggctactttacccagatgatgtcctatcaacgctcaatgcaagacctgctggctccactgcctgattactggttcaacgatgatactggtcagttctgcgcatgggggcaggtgaacaaaggtgacattatcgttattgaagcgatggttcgttccttcgttgatgtccctagctccgtaggaagcgtcgcaggatacgctacagcgggttctaacgcagtggaagaccaatccatagccgacatctacgaaaacccgtataacagcgttgtgggcggtgtacgagcgggacagggttcaactgttacgggcggaacgtctgcatataacaaccgatgggtaaaagactactctaccgcactggtgaaagagatcaacggacaaattctggctaaattccaggggatgcaattgcctggcggtgttgctcctgatggtacgcgactgatccaggaagcggaaaccaaactgcaaagtctgcgcgatgaactgatttcgatgtctgacgcagtaccgatcattatggtgtagggggaataatgcaaaactgggatgaaagtttattcgctcagttgtctacgggggaaggggttgatcgcaacttaaaggatcaggtcactaacccgtatgtaaactggtacaaatacaacccgacacaacagctacacgattcactgacagcagaatcaatccagatgaaatcgcctgatatgtattacgtccggcgcgacttcgtgaatattgataagatcctgggcgaagaccgagaatccaaatttacgaagtcatggaaaattgctgcatatattgaatcgtatgccaactatgaaggacaacgagatttctttagtaaatttggtctgagttcaaacgatgaaatgacgctggtaattaaccctcgtttgttcgcacatcaaactgatggtggtattcctgttctgggggatctggtttatttccctatggacaatagcctgtttgaaattacgtgggtagaagccgatccgttctatcagttcggtgatcgtcctcaacgcaaaatcaaccttgcgaaattcatctacacaggtgaagaactggctcctgaattgcagcgaaatgaaggaatccacattgaacctgatgcagaactggatctcgaaccgattcgaaatcttgacgggctggctgatattaacattgaacagtacgaagaagacaaagaatttgaaagagaaggtgatgaattcatcgaatcttttgatgttgtcaacggacgcggttcaccgtttgcaagtctgccataaatacgttatatgggtataggcggaagtctatacccacaacccatacaggaaaataaaaatgtttggctactggtataatagttctctgcgtaattatatcgtcctgatgggggcgctttttaatcacgttcaggttaaaagagtacgcggcgatcaagaaaaatacataaaggttccgatcacctatgcatcgaaagagaagtttctcgcttccatgaacaaactcaactacacgttgagtcaggaaaacgttgcaaagaccgaaaccattttaccgcgcatgaacttatcactggtggatctgcaatataacgcaatccgtaaaaccagtatcgcggtcaaccaaaaaatgacacagttagcaaccccacgaaaaacgatcacacagtttaaccctgtgccgtatcgtcttattttcgaactgggtgtgtatacgcgatatgaagatgatatgttccagatcgcagaacagattttgccatattttcaaccgcatttcaactgtaagattaccgaactgcataagaacgatatcacagttgaccgagacatcaaaatcagtctccaatcggttgcgccggataccacattcgagggcgatgcaaatcaacgccgtcatgttgagtggtcatttatgtttgaattacagggttatctgtacccgcctgtaactgatgttaaaggcgaaatcagaaccgtttacacggatttcttcgctaacatgaacccgttagataaagataactttgaatccgtggatagtcaagccgatccggtagatctgcctatgcaggactacacgggcgaagaatatattcagacgtactcgcacgataagccgatcccgtctggtgatgaacctcctaagccgagggaatgagaatggatgaaaaattagatttgcagcaattgctgaatattgattccctccctggcggcgttgagtctggggaggatgtggttgtttacgaaaaacttgaactggttgacgttcaatcacatccagcagaccggaaaccggatctggaagaggattatacgctcgcgcgtaagactgcgcaccatatgaatcagatgatcatggatatggcgcagatcgcattacacaacgcgaagaactccgaatcgcctcgccacgtcgaggtattcacaagcctgatgaatcagttaaacgtttcaaacattggcctgatgaagattcacaaagaaatgcgtgagattacggaagagactacaaaaccaggtgctgaaaagggcggtggtggtagtgaaatgaatatcgagaatgcaaccgtatttgttggttcccctacggaactgatgcagaaatacggcagtgcatatgaacccaaagagggcttcattaatggtgaagctgtagaggtaaaccctgatggaaatggaaccgacgatcgatccgagtaaggaatcagatcaccctatcggattaatgcatcccaaatatctgaaaaagaaaattgatgaattggggatggagtggacacaaagcgaacacgataaaaaatggtatccgacaacgttcagtgactacctgaaaattaacggcattcaaaaggtcgatattcagtctaaggacagttcgaactttgccacgtacaaaaataaaggcaacaagaaaacccgatataacggcaacccaaacctgaaacgtgcgtatatccagactaaatggacgcaacaaatgttgatggagtgggtgaaatgtcgtgatgatatcgtttattttgctgaaacatattgtgcgatcacccacattgactatggtacaatcaaggttcagttgcgtgactatcagcgcgaaatgctgatcgaaatgcacaaaaaccgtatggttgcctgtaacctgtcgcgtcagttgggtaaaacaaccgttgttgcaatcttcctggctcacttcgtgtgtttcaacgaagataaatatgttggtgtgctggctcacaaagcctcgatgtctgcggaagttctggatcgtaccaaacaggcgatcgaactactgcccgacttcttgcagcctggtattgttgaatggaacaaaggttctattgaacttgacaacaaatgtaaaattggtgcgtttgcatcttctcccgatgcggtgcgtggtaactccttcgcgatgatctacatcgacgaatgcgcgtttatcccgaactttgttgatgcgtggttagcgattcaaccagtaatctcttctggtcgtaaatcgaaaatccttatcacaacgacacctaacgggcttaaccacttctatgatatctggaacgctgctatagaaggaaaatccggtttcgtgccttacacggcgatctggacatcggttaaagagcgattgtatacagacggcgacaacggtacatttgatgacggttattcgtggtctgcgaagatgatcgctggctccagcaaagaggcattcttgcaggaacactgcgcggaattcatgggaaccagtggaaccctgatcgctggttggaagttgtcaaaactcacatggattgatattgatgaaacggaaacgaacttctatcagtataaacgtccagtagaggggcataaatatgttgcggtacttgatccagcggaaggtcgcggacaggattaccatgcaatgcatatcatcgacattacgacgatgccatttgaacaggttgcggtgtatcactcaaacaaaacgtcgcatcttattttgccggatatcctgttacgttatctgaatatgtataacgaggcatggatttacattgagctaaatagcacagggcattcagttgccaaatctctgttttccgaactggaatatgagaatgttatttgtgacagctacaacgatctgggtatgaaacagactaagcgatcaaaagctatgggatgttcgacgctgaaagacctgatcgagaaagataaattgatcataaataacaaaaagacaatactcgaatttcgtactttctcagaaaaaggcgtttcgtgggctgcggaagaaggatatcacgatgacctcgttatgtcgcttgcttgtttcggttggcttacaactcaaatgaaatttgccgaattctgcgagaaagacgatttaagactagccaatgaagtttttgcacgggaacgcgaacagctatacgaagacgcattatgtccggttatcgttacaagcggtgatgaaacgatttcggttggttctcacggtatttcgtttatataaattagaggaaattctataatggctttacaatctccaggtattgaaaccaaagaaacatcggtacaatctaccgttgttcgaaattcaactggtcgcgctgccattgtcggtaaattttcatgggggccagcttatcagatccgtcagatttctaacgaagtcgaaatggtaaactattttggttccccagacaacttgaccgctgactatttcatgagtgctgttaacttcttgcagtacggtaatgatctccgtgtggttcgcgttgtcgataaagatgccgctaaaaacgcaagcgcaattttcaaccagatcaaaacaactatcgcatcacagggttctaactacactgtaaacgatgtgattaaagtaaaatacaacaacgttgttgtagaagaaaacggtaaagtgtccaaagttgacagtaacggcaagatcctcgcggtaatcatcccaagcgaaaaaatcgttgcccgtgctaaacagattggtacttacccagatatttctactggctggactaccgaaattgtttctcagtcttccggtgtttccgcgtctattacgattgacggcatcgaaagcgattcagggatcactctgttgaacctggatattgcaaaagaaacaattcagggaaccgcattccagactcttacccagaaatatcagatcccgtctgtcgtggctctgtatcctggtgaactgggttcaactgttcaggtggagattatctccaaagctgcttacgattctggcgctatgatttcaggctacccttctggggtttccgttaagaatagcggtcgttctgtaatgacctacgggccacagaccgacaaccagtacgcttttgttgtgcgtcgtggtggcattgtacaggaatccttcatcgtgtcaactgagaagaccgataaagatatctacggcgtaaacatcttcatggatgactttttcgctaacggtggctctcagtacgtttacggtacttccctgaactggcctaaaggcttctccggtatccttgagttcggcggtggtttgtcctcaaacgacactgtaggcgctgatgaactgatgactggttgggatatgttcgctgatcgtgaagcgctgcatgtacctctgctgattgctggtgcgtgtgctggtgaaactgtagagatcatgtctaccgtccagaaacacgttatctctatcggtgatgaacgtcaggattgtactgtgtttgtgtcgcctccgcgctcacttctggtgaatatcccgctggcaactgcggttgataacatgattgaatggcgtactggctataaactcagtggtggtgctgttgttgataacaacctgaacgtaagttcaagctatggcttcatggatggtaactataaatatcagtatgataaatacaatgacgtgaaccgttgggttccgctggcaggtgatatcgctggcctgtgtgtttacactgatagcgttgctcaaccgtggatgtctccagcaggttacaaccgtggtcagatccgcaactgtatcaaactggctatcgaaccgcgcacagcacatcgtgacgcaatgtatcaggttcagattaacccggtaactggtttcgcgggtggttccggcttcgttctgttcggtgataaaacactgactaacgtaccgagtccatttgaccgtatcaacgttcgtcgcttgttcaacatgatcaagaaagacatcggtgataacgcgaaatacaaactgtttgaaaacaacgacgatttcacccgttcttcgttccgtatggatacaggtcagtacatgactaatattcgtgcgctgggtggttgctacgattaccgtgtaatctgtgacaccacgaacaacacgccggacgtaatcgaccgtaacgagtttgtagcaacgatctacgtgaaaccgcctcgttctatcaactacatcactctgaacttcgtagcaacgtctacgggcgcagatttcgatgaactggtaggaccgcaagccgtataacgtcaagggggctgaaaagcccccataaataatccgaggttaaaaaatgcttactgacattttacgcgcctttgaatccggtgatttcgcacgtccgaacctgttcgaagtagagatcccgtatctgggcaaaaactttaaattcacgtgtaaagcggcaaccatgccagcggctacagttgaaaaagttccggtaggataccaaaaccgcaaaatcaacgttgctggtgaccgtacctatgatgactggacaatcacgatctataacgatgacgcgcataatacgcgtgacgctctggtagcatggtcaaacatgatgcacggaatgggcgatcagattagtggtgatattccagcgaactacaaaaaaaccgctacggtgaaacagaaaaaccgtaacgatgaaattaccgccgaacataccatccacggtcttttccctactaacgtaggcgaagttaccctggactgggacagcaacaacgaagtgtcaacatttgaggttactttcgcgctggactggtgggaataaaggctataaatacaggggtagcaatacccctatcattatttttcggagttactatgaactttttgggctttggcaatgtacttagctttttcaagaacttcgcccgtgaggacgaattggatcttgaacagcaattaaaaaatgatacaggttcggtcgcgcctcctaaaaataatgatggtgcttatgaaatcgaaactgatctgactaatcagaaatacgcaagcgtattccagcagttttattctggacaagatccggcgattcagaacaaagaacaattaatcaatacatatcgcggcatcatgtcttacccagaagtagaaaacgctgtttctgaaattattgacgatgcgatcgtgaatgaacagggcaaagatatcattactttggatcttgccaaaacagattttagtaaggcgatccaggacaaaatcgtagaagaatttgataacgttctaaatatctatgattttgataacatgggtgcgcgtctgttccgtgattggtatgtggattcccgtatctacttccataaaatcatgcataaagacgaaagcaaaggtatccgcgaactgcgtcaacttgatccgcgttcgatggaactgatccgcgaatctatcactgaaacccttgatggtggcgtgaaagtattccgaggttatcgcgaatttttcgtgtatagcgctcctaaaaatggctatacatacaacgggcagatctaccagcataaccagaaggttaaaatcccgcgctccgctatcgtgtatgcgcattctggtctggaagattgcagtaacaacattatcggatatctgcaccgcgcagtcaagccagcaaaccaattgcgtttactggaagatgcgatggtcatctaccgtatcacccgcgcacctgaacgccgtgtgttctacatcgatgtaggtcagatgggtggcaacaaagcgacacagtacgtaaataacatcgcacaggggcttaaaaaccgcgttgtgtacgatgctaaaacgggtactgttaagaaccagcaaaacaacctgtcaatgacagaagattactggttaatgcgtcgtgacggtaaagctatcaccgaagtagacacgcttccaggcggtgcgaacttctctgatatggatgatatcaaatggtttaaccgtaagctctatgaagcactgcgtgtgccattaagccgtatgcctcgcgatgatgggggtatgcaaattggtggtggtggcgaaatcacccgtgatgaactgaaattcagtaagtttatccgcacactgcaaattcagttcagccctgtgctttccgatccgttaaaaactaacctgatcgcgaaaaaaatcatcacagaggaagaatgggaagaaaacgttagcaaaatttccttcattttccagcaagattcatattacgcggaagtgaaagatattgagattatggaacgtcgcctaacgttgatgtcacaggttgaaggtgtagttgggaaatatgtctcccataaatacatcatgaaagagattcttcgaatgtctgatgaagacattgacgaacaagcgaagctgatcgaagaagaatccaaagaagaacggttcaaaaatcccgaagaggaagaggaaaacttttgatgaaagaatttatcgaagcaatcaaaagcggtgatctggtggaagcgaagaagcaattctattccatcatggaagaccgtaccgaagcccttcgccaagaaatgcgcgttgaactcgcggaagctgtacgcatcgaaggtgaaaccgacgatgacgacagcgatgacgatgacgacgacaaaggcggcgatgataaaggcgacgacaaagacaaaaagccgtctgataaaaaagacgacgataaagacgaataagaggtgtaaataatgcaactcgaactcgaagaaatcagcgtcgaagatctcgaaccccatttaaccgaagcgaaagcccgtgttgatgttctggggatcgatgacggcactgtgaagatcatcgaaaatttggcggtcaatgaacctcatttagccctggctatgatgtccattgtcgagggtttgagtttagatgaagtcattgttaaacacgtagattcgcgcggtaatgtggaacgtaaaaaagaccgtaaaacccgtgaacgtaatgcgtatcaaacaactggtttaactaaatctcaacgtcgccaaattgcgcgtcgtgcgctaaaaacaaaacgtgcaaacccttctattacaacccgcgcacagcgtaagcgtaaaaaagcgctccgtaaacgcgccgcattagggctataaatatgaatgaatcccaactcaatgaaaacggcgatatgctgctaatcgaggaatggggtttaccttgtgcggatatttccgattcgattttagaatcggtcggtgagtcgaaaaaagacggtaaacttcggattgaaggtattttcctccaggccgaaaaagttaaccgcaataagcgactgtatccgaaaaaagtattagaagaagcagtaaacgattatatcagaactcaggttaatacccgtcaagctctgggtgaaatgaatcacccgccgcgaccgaatgtcgatccgcgtaatgcttgcatcctaattgaaaaattatggtggaaaggtaatgacgtttggggtcgcgctgttgttgtcgaaggtgataacggtgatggggataaactcgcggcgttaattcgcgcaggttgggttccaggtgtttcttctcgcggactgggtaaactttccgattctggaaaaggttacggtatcgtacaagaagggtttaaattggcggtaggcgttgatgttgtttgggggccaagcgctccagatgcttacgttaagccgattaccgaatctcagtcaagcaaaacgcttgttgagaataatagtgctgatgatgacgctttcagaaaactctctgaacgtttgaaaagtctatataaataatatcatatcaaacaggaaacttagaaatgcttaaagaacaactgttggcagaagcccagaacctggataccccagttgagttagacagcattttcgaatcagttgaactttctgatgatgcgaaagcaaacttcaccactgtattcgaacaagctgtaaaagcaggtgctgcgaaactcgctgaaacccacatcgcccagatcgcggaacgctccgatgaactggttgaagcccaggttgccgaaaaagctggcgaaatcgaaaataaactgtacgaagatgcgaataaatacttcgaccacatcgcgcaggaatggctctctgaaaacaaagaagctgtgtcccgtgatatcaaggccgatctgttcgaatctctggtaatgggaatgaaagaactgttcgttgaacacaacgtagttatcccagaagcgcaggttgatgttgttgcagaactcgaagatgaactgaccgagaatcagcaggaagttaaacgcctgttcgaagctaatcaggctcaggctaaagagatcgccaacatgaaacgcgataccatcgtttcagaaaaaacaaaagatctgactgaatcgcaaattgaaaaggttcagaacctgatcgaaggtttggaatattccgacaagttcgaatccaaactgaccgcaatcgttgaaatggtagcgactaaagcggaaaaacaggttgaagagagtaccactactcagacaaccactaaagatgactttgttccggtgaatgaaaatacacctccagcagagaaatcgaagatcaataaatatgtacaagcggctaaagccctttcctaatcttataaggtaagaaacaatgtctaagaaaaacgaattgatggaaaaatggaacgatcttctggaatctcaggaaggtttaccggatatcgctaccaaatccaaaaaacaactggttgcagcaattctggaaactcaggaaaaggatgctgatactgatccagtatatcgcgacgaaaaaatcattgaatccttcggcggtttcctggcggaagcagagatcgcgggtgaccacggttacgacgcaaccaacattgcctctggtaaatccagcggtgcaatcaccaacatcggccctgctgtaatcggtatggttcgccgtgcgattcctaacctgatcgcattcgacatttgcggtgttcagcctatgactggccctactggtcaggtgttcgcactccgtgctgtatacggtaaagatcctctggctggcggtactcctgcaaacgttcgtgaagcattccatccgatgttcgctccagacaccatgtattctggtgaaggtgcaaacaccgcgtttgctgctatcgcaactggtgttgctatcgcttccggcgctatcgttaagcacgtattccaggaaactggtatcgcgtacttccagaacgtgacctccggcaacgtaaccgtaactggtgctgatgctgctgctctggatgctgctgtaatcgcagaaaacgagaaaggcactctggctgaaatttccgaaggtatggctaccagcgtagcagaactccaggaaaacttcaacggttccagcgctaacccgtggaacgaaatggctttccgtatcgacaaacaggttatcgaagctcgtagccgtcaactgaaagcacagtattccgttgaactggcacaggatcttcgtgctgtacacggtatggacgctgacgccgaactgtctgcaatcctggcaactgaaatcatgctggaaatcaaccgcgaaatcgttgacctgatcaactacaccgcgcagattggtaaaactggtttcacccagaccgtaggctctaaagctggtgcgtttgacttccaagatccagtagatattcgcggcgctcgttgggctggtgaaagctataaagctctgctgattcagatcgacaaagaagcgaacgaaatcgcgcgtcaaactggtcgtggtgctggtaacttcatcatcgcttcccgtaacgtggtttccgctctggctcgtatcgacagcggcatcactccggcaggtcagggtctccagaaaactctgaacgtagacaccactaaagcggtattcgctggtgtactgggtggcacttacaaagtgtacatcgaccagtacgctcgccaggattacttcaccgtgggctacaagggtgataacgaaatggatgctggtatctactacgctccatacgttgcgctgactccgctgcgtggttctgatcctaagaacttccagccagtaatgggcttcaaaactcgttacggtatcggtatcaacccgtttgcgaactctcgctctcaggctccggcagatcgtatcacctctggtatgatcagcaaagaaatgtgcggtaaaaacgcatacttccgccgcgtgtgggttaagggactttgatcctaagttgttgaaaaacaacgactttttaaagggaaccttcgggttccctttttgtttatataaatagtgaaaacatttgaggctatattatgaaacatatcatttataaaataacaaacaccatcaataacaaaatatatgttggtgctcactcaaccgaagatatcaacgattcatacatgggttccggtattgcaatcaaaaaagcgcaaaagaaatatggtatggaacatttcacaaaagaaatacttcatgtatttgacacccgtgaagaaatgtatgagaaggaaagggaaatagttgatattgaattcataaatcgaccagatacatataatgctggtattggtggtaaaggtgctccaatggcattgattggatggagtgatgaacaacgcaagctgatttctgaaaatacttcgaaagctatgcaagctccagaaatgcgcgaacgcctttcaaaaatcaaaacaggaaagaagcaatcggaagaatccaacaggaagcgttcagagactatcaaagctatgtataagggttctgcattcgacagaaccggatctaagctcacagacgcgcacaaggccaaaataagccgttctgtgtcgatagatggagttgtttatgcaagtggttctgatgctgctaaagcgttggggctttctcgatctggccttgattaccgtttaaagagtgacaaatttcctgaatggaaattcgttgcataaataaacaatatactccctataaattcaggaaccaaagaaatgagtgataaacactacacaattcacaagttgatgcgtcagtcttcgcttccgtctggtaaacgagaaaaagttatcaacgaagcaacaggcacgaccgacatcaacgtacagaacacgcgcccagaactggtttctttgactcgcgcggttaacaacctgatctatcatgaactggttgctgtacaagaaacagaactccctgttgcaacactgttcggtgttcgctatcgcaaccctaatggtgatatgactttctccagtgctgcaacctattcaggccgaatctctggacgtacagacatcgacgaaatcgatctgactaaagcctacgttaaaggtgatttgttcaagcatgacggcactgacgttgtttatgaggttatcgcaccgattaccctgaacactctggatactgacaaagacaccgcgatcatgaaagctgtgttccaaagcaaaattcgtctggtgagtgaagccgctgacacttctaagtatgaaaccagcgaagatatcgcgtcaacctccttccagatggatcgctggaatattccggtacgctcgcgtaagtttaaaaccgaaatgacggttgaactgatgcaggatttggaagcgaaccagttcgaagctgatggggtgatcgaagacatcctgggaaccgtggcaagtgaagaagtcaacaaagacattattcaaacactgatcaccgtttccaaacgttacaacgtcgatggactcgttacggatggtatttttgacggtactaccgcatacaccgcgaaggatgctccagcattgggtcgtatcctgtatcaattagcgtgtgaaatggggcaggaaatgaatagaacgacttcatttgatgctacctacgtcctcgcaacagcgcgtgttgtaggcattctggctgcgtctggttggatgcacgaaaccgacgaacaacacccactggcaacaggtaagctgaacaacggttattatgtctatacagacaccaacagcccgttcgattatatgctgactggttgcaaatatgatctgggtgatatggatcacgtaggctctctgttcttcgctccgtataccgaagctgatgaagcaggttcaatcaaagtatccgtagatccggcatccctgcaaccgaaagttgctattctgatgcgttacggtctttccgtgaacccatacacagcagaaagcgaatccgatcacctgatcaaaggtgatgattggtctgctcttgcaggtaaatctaagctgagtcagatcgtaggtattaagttacctaaactgggttaacaagttttgttttgagaagaccattatagtaataaagatctataaggtcaaacgagcgaagcgagttttcacgaacgaagtgagtgatgggtaagtacgatgtactgtttataatatttatattttatatatagagaaaacagtacatttccgtatactttttaaccaacattcactcactacgttcgttcatgtactcgcttcgctcgtagatttgacttcttgatctaactggttataatgttactttgttttgaggtgatacatggctgaactaaaacttgaagatctacaggctgaacttgaagaggatatgcgtattgatccgttgaagttacaaagcgaatcagcagacattccgaagatttggtcaaaatggcttcgataccattcgaatgctaagaaaaaacttattcaactccaggcgaagaaagaagcgattgtaaaagatcggttactgttctacactggtagacacgaaagcgaaatgaccgatgtcatttacactggttcgggtgaaatcaaaattgctatctccggtgatcctaagaccgttgaagttaacaagctgatccaatacttcgaactgattgcagagtttaccggaaaagcgctggatatcgttaagaacaaaggctactccatcaaaaacatgttggagatccgtaaacttgagagtggtgcataaaatggcagaagaatttgattgcaaatgcgttgtgtgcaaacaaccgatgaactcccgtaatacggcgtttgtcaatgaagctggcccgatctgcggtgtcgtatgtttgcaatatctcaacgaaaggaatgatcgcggtatcaatgaagccgacgatctgaacgaagttcaaatgttgctgtaggtgtgaatatgaaagactattcaaaaatcgactttaacgaagtatttcgtttgctgggattgatggaagaatgtgtgaccagggttcatgcacttcgaatttcgtttgaaagcggttgtatcgaagacgaacgcccagatttatagcagtaaatagatgtgtaccccttgtggggcttgggcttaccgtgtggcgtacccatttgcgccgtccgatagaatttactttcggtggggtgattggtaagataccttcgagtaaaggccagttaattgtaattcagaatagtacagcactgaaataaaataaatgtacgtgtcggaacaaacggtttccgaaattaaaaagccccttcctttcggttggggctttctttttaaaacttctcttcttctccggtttcaagttcggctttcagttcttctcgccgtcccttgatcgcgtcacgcattgaaatgtcatcggatgctgcaacctcgacttctttcacgcgggtgttgtaatacttttcaagttctttcaaaccttctagtgtccggcacgaagcaaccttattcatgaaatcatcaatcgctgcttcgtttacgaatgtagtaaaacttttcattttggcctcttaaatttctacctgtttgatcgcgtagtcgaatcgttcttcattgtagatccgcacacgttccatagcatgtttcataccgtagtttgtcgcactgtatttatttttggctgtcttagactttgacagcgtagccaggttatcaacgatatcccatacagtagcgagcgctttcgatccgtgcttacgaagtacacgaccgatagactgtttcaccacaacagcagatttgcaagggtgcgcaaaaatgatgtggtgtaggttcttgattgagatacccgtactcagtaccccgatcgaaccgatgacgattaaacctttcgtcgattccgcgattttcttcatttcgttacgatcgtcaatgtctgtatcaccattgaccaacaccacgttatcgtaaaccttgctcaactgctcgtacagccattttccgtgctctttgtaccggaacatcacaaaggcgttttcgttcttctcacgggctaatttgagcgctaattttagaatccacgcgttgcgccgtgtgtggctggttacgtacttgatttccgtctggtagtccgcacccttcaattttttgacctcttcttctttgtatcgaaggaagatcgtgttaattttcaggttggtgacttgtccatcatccatcaaacgacgcgtatcaactggtttaaagactttgccgaacgcaccgatgtattgcatcatgttcgttttcccttctttcagggaaccggataaacccagtttgaagatacattgatccatcgtgtcgataatctttttgatgctcatgcctgttgagaggtggcattcatcaaccatcaaacacatgaactgttggaaccattcggcaggcattttaaccgctgattgccaggtagaaacgtaaatcagtgcattactgtttttcgctgtaccggaacggatacccagcattgccgatttcgggaacaaacgatagtttgcgatgtcctcgatcatttggtcaacaagtgcggtagtcggaacgatgatcaacactttcccgctgtaatgttccagacaccaacgagagataagcccctgaatcagagatttacctgctgatgttggcaggttcagaacaccgcgacggtttttgataccgtggaacactgattcgcgttgataccagtacgggtcgatctgtttgtcgccgtcataaaccggatgttcgctaacccacttatcaaaatcttcttgcgtgatatcctctgtttcgtggatctttggatcaacccagattgaatacccgcgtgattctgcgaatttggataccagataggctaacccatacgggagtttcccgttgtagtccatcaagtaaatgtaaccgttccatccaccatatttgtatttggcctgatactgatagcctgggggctggaagctgaaatagtcacgcagttcatagacaatgtttggttctgcctgaatctgtacgtggcttgtgtttaaaaatttgacttcaatatccactatgattaccctatgtacaaagtatatacgtatttatgtcataaatattggataaacacttggagataccaatgaacattgattacgaaaaagttgatgggttccgtaccctcgacgcaaaagaacagaaaggcgcgttagctgattacgcaatgactgtgtttgctgttaagctgaacaaacaaaaatccttcgataacatgctggcggatctggttgctgctttaccggaagatgaagaaaaaccggaactgctgatcgattcccctgaaccggaaatcgttgcatataaaggtgaggtgactatgggtgaacctgtcatcgaagccccgaacgttcccgatgtggttattgatgcttctgcggattttatggagtacgttaaagaggtcgcgccggaagtagccgatcaaatccaattagtacctgatgtcgtagaagctcctgtaagcgcttctgacgagtccaaaggcgaactggtatggttggaagggtttagcccgacaatcttcatgatggggcgctctgcgagttctaacgggtattatacctgtccgtggtggatctatgactggattaaacaaaccccagactggtacaaagatcctgatagctgtccacatgcaagcgcaatcgacacaatcaaatcacttgcgttctatatcgtgcgcgatggtgaagttcgtgttcgcgaaaccagaaatagccgattcgaaacatttaagttttagcactttttgctaaaaaacttgttgacgcataccctcgtttaaagtatatttgtactcgaaggcgggggaatggctctcgcagtgaagaaggaaagcaaaatgaaaaacgaaatgatgaaaaacgcttattacccagttctgtttgtttgggctgatggtaaagtgaagaaagtagtcaattcaaatgctccttactatactgttgaagaagcactgcgccacgcttacgaagctgattatcctgtccctgctgaacctggttatgctcgttggaacggttcaaaatgggttgctgatacctgggacaactacgaagaagcaaaaatggaatgcgatcctgattatgtttctcgccaaatggaagcgcacatgattgcagaccgtcgcctggataacgaagctcgcggtttctattaaaattcaaagggggcgtagcccccttttttgtaggtaaaatatgactgaattaaatcacgaatgcctgaaagacttatcagaaggtaaagagatcggaaacgtcatcttccttgatatcgacggcgttctaaataatatgcggtgcatgaaatttggtgagcatatggacattgaatgtgctcgacacctgcgccggatcgtaaatcatgcgaactgtgatattgtcatttcctctacatggaggatcggcaacacaacccatactctacgggaaatcttctacccgtggggattgtatcgcatcattgggaaaacctgtacgaatctaacagaccgacaagcaggacgcggtgatgaaatcaaagcatggatcgacaccttcggatgtaagaattaccttatccttgatgacgataccgatatgctgccggaacagagtgaacatttcatcaataccgatgggttcgtagggctgacagaagaacaatccacttacgcgatccgtaatgtgttcggtgtaacaaacccgttctgtcctgaatgcaacggctatgggcgcgtgaaccaatatgataaatgtccgtcttgtgacggcaaaattttacttctctaaatagagaaaaactaagaggttttgaaaatggctacagaaaaatggactacggtacacccgatcccgtggcgtaacaccagctttacctatctgccgtggtggatctttgatatcatcgtggctgcgaatgctgcaagcgaagactggcgtgattatgccgaagaaaaatacgcgaaagaattcgacacactgaaacaggcgtatattgattacaccgatgttgatttcatcgaatcccgtaacggttatctgtataagctgagtgattttactcctgctgatcctgtcgtaacaattacaccaaaaaccgctcctgctgatttcaaagtaggtgatgcggatctggctgcaactgatctgtttaccatcgatccttctggtacagaaatgactctgagtgttgactcttccggtcatggttctatcgttggtggtaaacttcatgcggttagtgaaggtgatgttgtcgtaacagcaacctctggatctgttactgcaactctgacggtaaacgttaaacctgcaccataataacaactaagaaggtaaaaatgctactatttgaattcaatgatgtattcgcaaaattcagcgacgcaatcgaagccaaatttggcaaacgcccacaaaacatgacagatgcagaatatgaagctgctgtatcgtccctggttcgtacagatttctatgaaaaactggcgatcgaggtgttgggttgggatatgatgaaatggggcatgacctatcgcgatcgcgaagtcggttttattctcgtcaacgaagcaaaaagcccgtcctgggtgaatagtcaaaaaatcgcgtacatggataaagtatgcgcacagatgggtattgtacgtttagacttctggacttgtcgggatctgaacgaactgaaagcccacgcttaccgttgccctctgatctcccgcaatgataagcatcgtcaagcatgggatagcgcagggaaatatcgtagtgttttcctgaacgacgatatgaacatcactattcaggatgttaaccgctcctttgcggattacacaccataaacaaaaaagggaaccgcaatggttccctttcttttatgcaatttttctgatttctttcaatgcttcttctttgctaccaacgaagagaatcgctttacctccggcttttctgaatggcaacacagcttttgccctgtcatcaatcagtatacctttgtccgcatatgctgctttctctccgctgcttttggtgtagtggaattcaggcagataaccgaacaccttcatcaacgcttttcttttttgttctgctaccgcatcggaattgtatttccctacgctggttaagatcgcaacctgacctaaagttctcaaatgacagaacaggtcgatgccctcttgtaatggttccagattttcgtagaagtcagtttgtgatatagcctgtttcgcttttttcaattcttcttccggcattctcgccgggtcaccgtacatcggaacaaaagaaccttcccagttgaacagtacaccatccatatcgaacaaaaactttttcatatcaattcctcggtttgtgtgtgcatcatattcatatatgttcctattgtcaaccccatgtatcagttttcggtgcgtatgctgcaactttcgccactaactctttatcaagctgatcaatggatttctgcggctttccttttgccttaactttgatgtagttagacttaacgacaaacataccgcctttgtcagatttcttgatttcgctgtcaatgcctactttgttgaagctgatccagatatcgccgtccatgtactgtttcagagagtcgcccatattcaggatcttcgccatagtgagcgctgccccttcgtgggtatccatgaggatttctttaggcactacacgatcgcgtttaaggttctgctgcatagcaatatgaacatcgttcataacccaaacgatatggatattttctttctgataacccagcgtttcaacatcacgggcgatacttgccagcttgctcatgctttttagggttacgtcaaagatcagatttggtttacggtcttccggtgctgctgcgatacccgcgtacacacgcgcctggtttttgttggatacgttgaacacgtccgcgatcacatgatgcagtgttgctacgttgtctgggtttttcaggttcatggttttgacatcgtgaccagttttcgctttgatctctgctgccagtttggtactacccatgaccaattttttgagtgcgtcaacgtccagtgtgataccttcgatgcctaacagcttttcgagggtgaaccctttaccagaacccgcaccgccagccaggatgactacctgaccaaatttaggataagccttaccgccgaaggtgatcagcgcttcatcaaggctcgtaaagtctttgaatgatttcatcttagaactccaggtgtttatttaaaagtatttattgacacggtttatgagtgcgtttatagtgcaattgttcgacggataagccggaagaactttaaccataaggtaacaattatgaaaaatgaactgcatgaattcatcaacgccgctgttcttggcgaccagtcaaaatataaagcccgtcgcgataccctgattgacgatttctgtaatttcctggggttcaagcgctggcataccccgtctatgcgtccagattgtgatccaaaatgggattacttcaaatggagtgatcgcgatcgtggttacgtcgataacgtccgcgtaatgtctttcaaccacttatacgcaaattcaacaattgctgttgctaaacgcaacgattcgacttatccgaacgggtggagtgttgctaaagtcatagaaacacttcttcaactgcgtcgcgaatataaatcagcataccgtgtcaatcccaatcctatctataatgaatggcaaatcgtcgcgaaatacctgctgaacatcacctattctattttctgtcgcttcgggacaaaagagattggatttggctctcatgatataattgcagaagcacgtcaccgcatgatccatgcaatcctgaaaattcaaaactctggtgggcttgttcttgctgcgttctgtgatgaaattgtttactacggagaacaggtcgaagttgatgatgttcaccacgaaaaattcaaaagatttgtattcgggcaatataacagctattcatatggaaacgatattcgtgtgatgaggcacccgcgcattatgttggatatggaagggtgggaaccaggtcacggaattggtgatgccgaaagccaacgtgaacgccgtgttcgttcagttgctaaaactcgcgaattgatgacaggtagccttactgattacctgttcagaacaaaagaagacgttgaaaaagaatttgttgacttgtcgggcgaatagcgataagctgtaatctctgaaaacaaggagataaccatgaataccattcactgccgcaaagagttcgttgagttctatcacggatcatgtactgctgccggaatcgaaagcatgttgttgcctccttgtgattctgatattctgtctgaaaaaggcagaaagaaaaatctggatcgtgttttcttcactgctgatatcgggctggctcgtatctatgctggaagggctgcacgttcaataggtggtgatccggtactttatcgggttgtgtgtccggtagatgtggtatgcatgaacgatgacaaaggcgcaagcgtttatcatgctgcatgggctttctgtgaggaattatgaaagataaggtgttagcgtatctcgttttcttgctgggatatcgcgttgaagtgatgggtggttattcttctttgtatggggatttaaccgcgatctggatggttgcgttgggggttatgtttacctttatggcgatctgtattgcgaatgaggctgatcaaaatgcttgaattttatcctgctggttgcaagtcaaatccgcctgatgcatcgttccaatcgtggatttattttcacagggaactaaacgacatcatcgaaagtcagtggaaagaccatcctgaacgaagtgcccccgatttagtcgatagcgtaacagatgtacgcaccctggaaaaagggctgtatgattgtctggttcagggaatggtgtgtaaattgattttgtggtatgctccgatcggttcagatctaactcgcaaaatcgcccgtggctatatcatgacgaaacgtgagtttgaccagatctggaacgaacccgactgtttcgaacgcgaaaaatacgaaaatgaggttagttgtatatgaaactatttcatgttgtatatggtggaatgaaaaacatcgacatcgccgcgttatctgctgggatgctggacgaactcgaagcacagatcgggaaacgattcaaagccagtatcaccgaaacgcaaactttgtttgtcgatcaccctgcggatatggaaaaccttgtcaacactctggatgatctgatgatcccgtgtgctgatggttggaacgaagcatccggtgttcatgtagttgtaacttttgttcttaaaaatgttgacagcagaaatgccgaagtgttagagtttattcgtaaaattgattctactaaaggaaagtaactatgaaaatcgttcagcgtaatatcagcgaagttagccagcaggaaaaagtacagattcatttcaaattcaatgatctgaaactgggctatgcacagatcgcccgtgagcacatgctcgataacggcgacatttacgtgattgttcaagaaattgagcgaattcgtgctttccgcgcagaaaatccaaaagtgaaacatgttctgcgtcgtgtgtacatcaataaacatcgtgaagaacagcgcaagcctaaactcaaagctaaacgcgatccgcgtccagataacaaacgtaaagcaatcaacggcgctatggcgctggcgttccaggaagcgggtttggcgtaaggggtttatatgtcttcaatgatgaatcgctggtcgggcgtgataacttcgactatcaaaaaggatttggtgaaggttgaagcaaaaccaaagccagtagaaccggaaaaagttcaaactatggtatcactcgatcctgctgagttagaacaccgccgccgtgcaaagcaaattgaattcgatctgcgtgtcgctcgttcatacaacagtaaaaacgatgatgcgcgtaaccgcaaccttcaatttgctctgacgttaagcgactgggcgaagctaatgagtgaacccgtatgttcttactccggcagaccgtttagcaacaaaggcggttgctctgactcccgaacaatggaacgaatcaacgcttctctgggatacacggttgaaaacacgatcgcagtaaccagcgccgcgaatagcgagaaatcaaatctcgatgcgtttatgaagggttctgtgatccttccagaagtaaaactgaaactgttacgcaaagctgcgtatcaaattgaaaaacaactgaaaatcaagggttaattatgtttgtgaaatattcttctctgactaaccattatgaaggtaaattcatcaatggtgtgatcatgaatggtttgactggtggcgtgtgggttgcgcgtgaaaagatccacggggctaactttagcctgattacttcggacggtatcaaagtcattccggcaaaacgtagcggtgaaatcctccctgctgaacaattctacggttgtgaaccagtagttgcaaaatactctgaacctgttcgtaagatgtgggaaatgctctctgctgcccgtcagttaagtggcgtgtatagcgatgaactggtgattcaggtatacggcgaattcgcggggcgtggtgtccagaaagatgttgactacggcgaaaaagatttctacgtatttgatatccgtgttaatggcgaattcctccctgataacgttgttgcaaattacgctgttgctgttggcctgaaaatggctccactgctggcatacggtacgtttgacgagatccgcacactgcctatcacctttgattcggtggttaacctggcgaactccggtgcgatccctgcaaagaacggtgttgaacctgagttcaaaaacttcatgacgctgaaagatggtgaaggtgagaacatcgcagaaggtttcgtgatgaagcctgttcaacccgctttcatgccgaacggtgaacgcgttgcaatcaaatgcaaaacgacgaagttcacagagaagaagaacaagcaagcgaaccgcttcgatgctccttctgaactgtcagaaacagacaaagtgaagctgaacgaattcacctgctacctgactgaaaaccgcgtgaaaaacgttctgtccaaaattgacagcgcgaatctcaccgctaaagatttcggtcgcgtgatggggcttacggtacaggacgcgctagaagaaatcgaacgtaactacgggcctttcctggaacagttcgaaaatccaacgctggcgaagaaaaccttcactaacgaagcgtcaaatctggttcgtgagaactggggcgcaatcctgaacaatgaattttaaaactgttctcgaaaacgcaaaaacggctaccctgatcggtagccgtgaaccccctgaacgtatcgcgagcatagccataaagattggacgtgctttaagtgatcgggggatcttcgcttactctggtggtgctcctggaatggatagccatttcatgtttgactactcaccagaaagacggcgtataatcctccctgagaacggttttaacgggttgtattctaatggtaaggatatcatcgactatacagaatacgacacgtacaaagccgctgacgaagcgagaaaggtagctggacacttcgacaaccaaagcgaatggacacaacgccgatacgctcgcaattcaatgcaggtattaaccgaaaacctggacaaacctacagattttgttctattctgggcggtagagaaagatttttgtgttaaaggtggtactgcgatcgctgcaaggcttgccagattgtataaagttccaacgttcaacctttggaatcaaaacgttctggatgaagtctgcgatactttagggattaacactaaacctcctactctggattttctctggtgataactcccgaacaatcacgtaattacgaacgcctctctgttgaagaggcattaaaaaaggcgaaacataatggtagaaatcaatggaatcggtgtgaacgtacaggcgggaagcgggacatcgtgggtcaaacgcgaaacacaagatgatccccgctgtggacgtagcccgacactggcggaacgtgcgcgtaaactggttgatgaaatcaacgcgaaaatggtcgaagcatcccgtaaagacatttccgagtatgtcctgaaatatccgactaaacaagcatatacctttgatatgaaacgttttatcggtaaggttatggatcaggaatgtaccgaaaaagcatatgcggatctgggtgaatggctggcggaagaagggtttactttcgatacccagcgcaaccgacaagctgcgttactcaataccttcgcgggttcgcgtcgtattaccaactttagcgatcctaagcgtgacggatatagcgatctgacttattacatcacctggtgaaaataattcgaaaaacttgttgacgggagttatgagtgtggtaatatagctcccgtagacaagacactaacctaaaaggaaaacatcatggaaatcaaattagtacctacttgcgctggctactgcttggcactgaatggtgtagcacacaacggtaaaggcttacgggctaacgttgaagcaatgctgaacgaactgggtgcggtttatgaatatgatgacgttgcaaccagcgttaaaatcataagccttgaaaaagatggtgttaactgtgcgggtttggtgggattgctacatcgactatagcgacaaccgggtcttcttactgaccagcaaataaggatcgaacatgagtgaagcagaatatattgatagctggggtggctatgacgatgacgacgatgatttttgtggtcataatttacgtcgagaaactctaaggcttttgcaacaagcaaatgcgccgaagcaagtcaaaactcctgttaaatattccgatggttcgattcgaactgaaacggttgtcaaagaagtaaacgggcgtgtcattacgtccgagcggcagaaggacatcaaacaattgtacgatgttgcaaaagccgctaaagtaggaaccatgatcacttgtcctacgtgcaaacagttgcacaagaagacgacatatcataaggtgttctgctctaatggtaaaaaatccaggaaagactgcaaaagcaaatactggaacacgatccatccagaacgtttggatcgtatcttttaaatcaaaacgtggagtacgtttaaatgaaaacttttaatgaactgaatagcctgatcacctcaactgattcctacaaagtgtcccactggttgcagtatccacaaggcactgatgcggcgatgttctatattgaatctcgcggtggtaagtttgatgaagtagtaaccgctggcgttaacttcgttgcgcgggttcttgccgaaccaattaccatgaaacaagttgagttgacacgggtactttaccgtaagcactttgggaaagagattttcaactacgaagggtggaagaagatcgcagaactgggttatgtccctgttactttccgtgcgatcccagaaggtacggttgttccggttaaaaatgccgttgcgactgtgtacgccgaacgtgaattctcatggttggctgggtggctggagacaatgacgattcgcggtatctggtatccgtcatctgtagcaacgctatcgcgtgagtgtaaaaaggttctggctcattaccttgatatgacttctgacctgactggtgaagcatataacatcacactgggtacacgtctgcatgatttcggggcgcgtggcgcgacctctgctgaatctgcgggtattggtgggctggcacacctctataacttcatcgggactgataccgttgaaggtatgattatggcaatcagtctgtttgtggactatcaaactctgtttgatgaagttgaaaacgtcgaagcaatcggtgtttcaattccggctcgcgaacattcgactacgatttcctacggtaaagagaacgaagacgaagcatacaaaaacagcatcgaaatgttcggtacagggttctatgcttgtgtgtacgattcctgggactacaaaggcgctgtagatcgcatcgctgaatataaagagcaaatcattgctgcgggtggtactctggttgttcgtcctgattccggtgatatgattgataacatcatgtacaccctgcgtaaactgggcgaaatcttcggttacaccgtaaacagcaaaggttacaaagttctgcataattcagttcgaatcatccagggcgacgagatccacggacctgaaacaatcaaccgtgtgttaagttggatggaagcgaacaagtgggcgagtgagaacatcgcgttcggtatgggcggcggtttgctgcaagaagttacccgcgacactcaaaagtatgctgaaaaactgtgcgctatccgcgtgaatggtgtgtggaaaggcgtttacaaatgcccgaaaggttccgaatggaaacagagtaagaaaggtttgctgatgaccatcactaacggtgtggaattcaaaacaatcgacactctggaaactgagattcctgacgggtggcgtgatgcgatgattacgtattacgacaacggtgtattaaacacctccgatacagtaggggttatccgtgagcgagcaaggatttaatatccgcgccaacgataacggatcggtagtcttctacaacaatcagccccttgtcgctcgcaaggggcttttttgtaagttggtgggctacgggttcaagttggaacaggtggacaacgcgacactaaaagaggttgttcgaattgcttatctgctgaaagataaaaaagatgaacatcgtgctattgcaatgcttgagaaattaggcgaaaatcattgcttcgtggtgaatcgtgggtataagtacgaaacgatcgccttatttgagaaaggacttggtgaattatgattaccacaatcaaagaaggggttgacctccatttaggcgactccgtaaagctgattaaacagcttgaatctggttctgttgacttgaccataacttcgcctccgtatgacaacttgcgccattataacggctctggtgatgtctggggtgaacacgtatggaaagagttgatatcggaactgtaccgcgttaccgcgcctggcggtgtggttgtgtgggttgtgggtgacgcgactatcaacggtagtgaaacgggtacatctttccgtcaagccttgtacgcgatcgaacaaggttttcggttgcatgatacgatgatctatcacaaaaccgctctaccgaagaaccataaccgatacgaacaggactttgaatacatgttcgtgtggacaaaaggcgcaccaaaaacattcaacccgatccgcattccgtgtaagttccctgaaaaggaaaccgcacgacaaaacagctacttttccgaaaccaacgaaaagaaccgttcagcccgttccggtaagaaacgtaaacctgttggcaaggataaaattaagggtaatatctggtattacgctgtagggcgcaatcactcaacgaaggacgagattgcattcaaacacccagcaatatttcctgaacaactggcagaagatcacattaaaacgtggacggttgaaggggacttggttcttgatatattctctggctctggtacagtgatgaaaatgtcgatactaaccaacagacggttcaaaggcttcgaactgatggagaattattatcatgattctattcttcgtgttcagccatacgttaacaatctggaatcttttctatgagttatttgggtgttatcccctatacaggcaacaaacagtcgctattacctgaactcttcaagctgttccccgaaagaagttcatacatgcgtttcattgattgtttttgcggtggccttagtgtgtcgttaaacgtccctaaacccgttctaagcaacgattatgataagacgcttattgatatgtatgagcgtcttaaaacgcttcctgacctgtctccggtgcgagaattgattgcatcaaaggggctggggaaagacaagaaagaagagtatttgaaattccgtgatgaatacaaccagaacaaagatccgttatggctctatgtcctgatcctgcattcattcagcaacgttaaccggacaaacgacaaaggcgacttcaacgctaatttcggatgccggacgcttaacgatgcaacagtaaaacgctttgaacatttcaaaaagaatgtgaaaggcattgagttttccagtggttcattccgtgacattgatatctgtgaaaatgatttcgtgtactgtgatccgccgtacctgatcaccgatgcagtgtataacaagttctggaacgaagatcgcgaacgtgagttatatgctttcctggatgaactgcacagcgaaggaatcatgttcggactgtccaacgtgactcaccatgccggaaaacaaaatgatatcctgattgaatggatgcagaaataccgcgttcataatctggataaaaagtatctgttaggccagcataccgactcttacgagcaaaacaaaacgcaagaagtctacgtgtgcaactaccagaaacgcgacgtaaatacattccctttaacactgaacgatttaatgtaggttaacatgtttaaaatttatggctatatcccttctgtgtataactgcgctccgtgcctgaactcaaagcgcttgctggacgcgaaaaaacatccgtatgagttcgtgtctgttgcggattccgtggaagacggtaaacctgtactgaacgaagcggtgatcgatgaactcgaagcgcttgttggtacgcgccggatgaccatgcctcagattttccatgacgggaaacatgtaggcgggttcgaccaacttcgtgagtacgtccgcaccctgtaataaataatgacaccttactgaatggtgttattatgctgacgaaacgaattaccaaaaaagactacccaactatcaagcaagctctctttaccgaacaagggggctgttgtgctatctgcaaacgtcccctggagggagagatcgagaaacatcaccttgaccatgaccatgcgttagacggcgaaaacgccggacgtgtgcgcggcctcctgtgtaacctgtgtaacggtacagaaggtattgtgaagcacaaattcaacagatccggtcttgtgtcccgtgatgttgactacatccagtggttagagaacttgcttgcatatctgaaacaagattattccgaaaaccgtattcatgacaaattcataccagataaggtaaaatggttttcaagacttaccaaacctgatatgattgccgaaatggtttctatgggcttcgagtacgccgacaaagacgaacgcaaagccttaaccgcaaaatatagaaagcaattaatgaaggcaacgaaatgaaatatctaaacgctcgattatcaacgcaacagaagaaaaagctgatgatgttgatatcctccactgacaaaaagatcatatctctacatgattggatgcttggaaggggtgactctgatttgtgttatgtcaaaccgaaagaccgaacgatgtttgatgatcgcggtcgcacattgactaatttttctcctatcaccgttattgatatgtgggaactccttgagattgtaggacgggatatacctgttgacggggttgaactgatcaaatatcttaacgagattggacacaatttagatattatccataaggcaacgaaatgaaagtagaaaaacgcgacggcaaaaccgtcgatttcgatcaagaaaaaattcgcaatgctgtgtataaagctggcgggactatgacggatgctgatgccgcaatcatgctggttcagtacaatcagatccgtgattttagttcaatgaagatcgcccgtatccaggaactcgttgaagaatccctgatgaaaacgaacccagcggtcgcccgtgcatacatcgaatatcgccacgatcgcgatattgcccgtgaacagaaaagtaagctgttcaaagatatctccggcatggtgaatctgtccaacaaagagatcaccaacgagaacgcaaacaaagacgcacgggtattcccgacacagcgtgatttgctggcgggtattgtagcgaagcatttcgcccgtaatcatatccttccgaaacatatcgtagaagcgcatgactccggcgacatccattatcacgatctggactatagcccgttcaccccttacactaactgctgtctggttgacctgaaaggtatgctggagaacggtttcaagatgggtaacgcggacattgaaccgcctaaatcgatcggtgttgctaccgctctcatggcgcagatcacagcacagattgcctctcaccagtacggcgggacaacctttgcaaacgtggataaagtgctggctccatacgttgaaatgacattcttcaaacatctgcgcgatgctgaacattacggtatcgaacactataatgaatatgtgtatgcgattgaaaagactgaaaaagatgtgtatgatgcgttccagtcctatgagtatgaagtaaacaccctacatactgccaacggacaaaccccgtttgttaccatcactttcggtactggtacgagcgattatgagcgcatgattcagaaagcaattctgaaaaatcgtattcgtggactgggtaaagagggtatcactccggtattccctaaactggttatgttcatggaaaaaggaatcaaccttgatccagaggatcaaaactatgacatcaaacaacttgccctggaatgtgcttctaaacgcatgtacccagatatcattagttcagctaacaaccgtgttattactggttctagcgttcctgtatctcctatgggttgtcgcagtttccttagcgtgtggcatgatgataacggtaatgaaattcttgatggacgtaataacctgggtgtggtgacaatcaacctcccacgcatcgccattgaagcggaagcgcaggaagaagaagacgcacacgacgcattctggcgcatccttgatgaacgtctggaactgtgttttgaagccctgatgactcgtatcgaaagcctacgcggtgttaaagccagtgttgcgccgatcctatacacagaaggtgcttttggtgtccgactgaaaccggatgatgaaattctggaactgttcaaaaatgggcgtagctctatcagtctgggttatatcggactgcatgaaacgctgttgatgtttggttcaggccaacacccatttgatcgtatcggctcccagaaattaggccgattgatcattgaatatctccgcgctgcaaccgaagcatggaagaagaaaacagggtatggatttagtctgtattcaaccccagcggaatcgctatgccatcgcttctgtaagctggactttgagaagttcggaagcgtcaaaggtgtcacggataaaggctggtacacaaacagtttccatctggacgttgatcgcaaggtaacaccgttcgagaaaatcgactatgaagccgattatcattacatcgctactgctggtcatatcagttacgttgaattccctgatatgaaaaacaacctgcaagccctggaaaaagtctgggattatgcgatggaaaaactggactacttcggaactaaccttccggtcgataagtgttttgtatgtggctctgatgacgagttcacgcctacagaagacggtttccactgcaaacactgcggtaatcaagatccggctaaaatgagcgtcacacgccgtacatgcggttatctgggtgctcctgctgttcgtggattcaacgaaggtaagaacaaagaaatgatgcaccgaactaagcatcaaaattaatcaaaaagccccttgcgaaagtgaggggcttttgttatattgcacataccgaaactatgaggtattgaaaatgatgtactggacaaaagactattttgaatttcgcgatgaagaaagttttgggactgtataccgcaatttagctttgcgtggtagtcctctgtcgcctaatcaactttcatctgtcttgtttcctatcaaggtaacgcactgcgatcggaaaggtgtcaatgggattgttgatgccaatggcacaacatggtattccgaagattcttatctgtttgataacgaggatcgcggattctttaaaaagtttgtcgcgcttaaacctgctgttgaaaaagccgacgcgcaacaactgctggattgttctcacctgctggggcgaatttacgtagatggtaagctggtgacgaaacctggcgatctggaaaaattcttgcgtaaggcgcgggaaactaccctgaaagagaccgaaaaacgttacgatactgcaaccgccaatctacagcgtttgtctggtgaactgaaagttctacggggtgaatgatgaccgggataatccttgataccttgtttccctcccgtgtacgtaggcgcgtagaacgggaaaaccgactcgaagaaatccggttcaataagttccttgaggacaagaagaagcgcgaagacgagaaacacccaaacgcaaaaatggctgagggtgtatcgaaatgttctgtcgggcggttctgggttgaaaaggattatcttgacctgataggtgctattgcccctggtgttacgctggaggacttctcccgcgctactgggcgttcgtatactggttgtatcaaccgcttgcgtatgctctctatagtggtgcgtagtgcgcatttcggctatcgtgacgttatccgtccggtgatcccagtaagcagattaaaattttatatggcgggtggaaaaagacttgacttgaccaacgaactgtgtaaaatcggttatatcagagaggggaaagttgttaaagcccctgaatggttcaccaatcaatttgaaatcaaataaggtaaaattatgttcaagaaaatcgtagcattcgtgactggtaaagttgaaactgcaattgaacaaaacacttccccagaagaagcctggcgcagtgctgcacgtatcctgatcaaagagatcgaccgtctgcaacatactcgcgtttctgctgttcaggaaatcgtgaagttgaaaaagaaagtcaaagaacacaaagatcttcattctggtaaagagtcggagatcaaaaaactgctggcggcggggcaggaagtgtccaacagtcattatgttctggcgctgcaacaccgtaacatctggcagggcttgcagacgaagatcgaagaactggaagggatgaacaaagagattgatctctctgtcgttgaactggatcgcaaactggctgatgtcaaaatcaacctggagatcatcgaactgaacaagcaaaccgaaagtctgggtctgactgtaccggaagacgtgatcgccgctgtaggccacacctccgtaagcgtcgataccatcgtgacgaagattgatgtgttgctgggtggcaaaaatgccgcttccgtaacctccgctgacgttagcgcttacatcgactccctgaacgcgaaataagaggaaggggcgaaagccccttttttgctatgtacgattacactattgaacgtgatcgcggtgaagaatggttgatttctcgtgcgagaaacttctatgttaaacttcctaaaaactttcatactttaccgaatgatgatactgatcgcttattgagaattctcgtagatgggaatgttccacagcgagtttttcaggaaatggttgatcatgcgtgttctgaatgggataaaaagtattgcgaagaactgacgcatgatagtatagtaaacagcaaccttaaagacgcttacgaacgaagaagtgtatatgacatttacgaaaaagagaggaaagaaatgatgttcgaagacggcaacagtgcatttaaaccagcacgtaaaacgtatccagactggcgcaaacagtacgcagaacagttatggcacattgacattcccgaagcgctcatgaaagcgattagccctgcggttgactactattcaggctggaaagatgaatatgagttagaagtcggttcgtttaaggcgcacgtcatcaaagcgaccagaattcttgatttcgttgaagctgttgcgtcgtgtgatatcgttgaagatattcgtattccgtcaatcaacgtttcgcggtatagttctcctggtaacattcgcggggatcgttatgcgaacctggcaagcactacggataagctgaactttcacaaaatcaatgaaaaaggatttgatggttgtgttctgatctcaatggtggttgtcacgacgcaaggcgaatacaagctgatcattgattgtgacaaagcggctcgtgcaattcccacaatcaaacaatgctttggtgaagatttcaaagtattgatgaaagcccgtgcgatggaaaagttcatccattcgtgcaaaaagaacgtgctggagaagtatgatccggcgctcacatacaccaaaattgataaagatctggtaggtgatttatgctgattaacaaagcgcagtgcaaagcgattaactttctgctgcacgaactgattgaaaacggtatcagatttgaattcgttgatccgattaacggtgatgatcgtcatctgctccgctgggtgtctggtagcaatccgctggattcagtctcccaggttgtagagtctgcgcataacaatatgccttgtcgtgttctgttgggtagcgttaacgcctcaacatggaatggatctgatgcttattatgtcggattcaaaaaagagttgacggaagacgaatgatgttataatatgcccctgtagacaacaaactataggggctaaatcatgaaaatcaaaaatactgctactgaaaatctttgcaacgaaatcgcggtgacttactggaaagaaggtcacgtaaaagcaatgaaggattttcaacagtggtgtgatacccagaagttagccaactgggaatacgccgtaatcgtggaacggatcaaagaactgatccttgagaagaaaggcactataaaatgattcaactgaaattagacacccaagcgctgaacaacctgttcccagaaggaacacaagcgcgaatggatctgcaagccgctgtcatcaagaatgttgttgacagcgttatcggtaagcgcgtaaccgaagaaatcgaaaacatggtgatcaagcacgtcaatttgatgatgccagccaatcacgaaatcgaaaagattgtgcataaagagtttgctgattacattcagaaacgctatgcatacagcaatgttttcgatatcaattcaggcggcatccgtcagatcaaagaactgatcagcgaacacgttaagaaacagtgtaacgacctgctggattcaatcaagctggaagcaatcaacgatgcaaccaaaaacctcaaagcggacgaagaagcgtttatggctcgtgtaaccaaaaacctcgaagtaacggttcgtcaggaaatcgttaagcgcgtgaataatgaattcccgcaaattatcgacgaagcgatcaaagcccgtttgttcccagaggcgaaaggctgatgaactttgaccgcatctataacatggatgtggttaacggtaaaggaatccgtgtagtgttgtttgtgactggatgcaatcataaatgcgaaggttgctacaacaaatcaacatggaatccccgcaacggtacaccatacaccgaagagactgaaaacgagttgattaaactcctttcaaatccccatgtggacgggttgacgcttacaggcggcgatccgttttaccgcaccaatcatccaacgctcttaaaactgcttgagcgcgtccgtgcgacgtttcctgataaagacgtgtgggtttggacgggatacaccctcgaagccttacagagcgatacagaacgttctaagctgttaccattcattgatgttctgattgatggacggtacgaaaaggatcaaccgactaagaaaccgtttcgcggttcggataatcagcgaatgattgagttcaaaaagaattccatcgaaattaaaaatatcgcttgacctggttggtggttctgttaagatatccacgtagcataaatttaacccaattgagagataatatcatgatcctgaatttcaaaacccgtaaagaagcccgtgactattgctggaagtggtcgatcccgctgaaaaacatcaccaaaggaagtggttcacatccgtggacggtgagaaccaaagaaacccgcttcgaaactggtaaagattacaagctggttgatgtcgaaggtttcactgacaacggcaaaaacattgcgaacagtgttcaatcaaaacagatccaccaattactgaacggtgttgtaaacatcgcaagccgtaacggtgatcgctacaccttcaatgctccggcaggtgttgctatgaacacccttcgtgcatgggaagcgaaatacttcacagaagttgctccggctaaagccccagcgccaaaacgcgctaaaaaaccaaaaccagtaggcaaaccgtctgttgcacctgcaccagcgaaaccggatctggattctgaactggatggtggtgttaacctcgctccggcagtaaccgaaccgtctgttgctaaacctgctgcaccacagccagcgctcgtagaagcgatgcctggttgttttgttgccgaccgtccgtatgttctggtagatgaaccaggtttcctgcgctctcacaccgcgaacaaacgcattgtgcaacacatcaaaaacaacaacggtgttctggtgttttcgaatgttgacggcgacggtgacgcgacaatcacgcaagatcgtagcctcccgtttgtgatgcaccgtgagcgtaaattcttccgtgaactgggtactggtaatccggcaaacactccagcagttcaggcggttgatatttccaaacagcaacacgatcaactggtcatcgctgctgcacaggcagtagaagacgcactggcagaacaccagaaagcgatcgaagttgtagcgcagaaagctcgcgcagttcgcgaagccgccgcaaaacttgcactgctggcaaataagtaatataattcgggggtgcttacggcatcccctttttatttgaggtaatcatggaattattcgctggaaaaacttacggtttaaccgtatcccctgaaatctttgcagagaaaacctggaaaacaggtatcgcaaacatcattcgtgaaaaaggttacgtgacgattgatcgcacctcgatcggtgagttcgaagaccgcgcgtttatcatggacggtggttacgaatatgaactccctgcatcactatggaaatggttcaaggaagtaacgccggaagagggtgaattcaccccagaagaacctgaagaggttaatctcggtaacggggtcgagactgaaaatggtatgcgtatcgcaacgccggaagaggtttccgctggtgtcactggttcggatctgtgcctgatggatatccctaaattcacgtatcgccctgtacaggaaaatcctttgcgtgatctccgcatcgatccatcatttggggctaacctggaaacgttgagcatcgcaccgatgccagtacgtaaatctgatgcaatgcttcgtttcgccttgcaacatgttttcagtggtggtagcatctatcaaatcaacatggaatctgaactgaaaatgcaggaagaccagattgcaaacctgttcgatctgcacactcaattaaccgctgttgaaaatatcgaaaaactgttaggcaaagagaaaaagcgtattttgcaggatctcaaaccatacgggaagaagaatgaaagtcgaaatatacggaatccccgaaagtcttcataactgttacgggtgtatacaagcacaaaagctgttgacagaaaaagggatagaatatacattttatcccgttctgaaagaagcgaaaaacgatctgggctttgaatacgatcgcccacgtatcgaagagttagcaaaacgggtaaggcaacgcagtttagcgtttcaatacccgcgtatttttgtcgataacaaacttatcggcggttatctgcaattgaaacaacttattggtgattaaatgagccgtgaaattttactccctgctgcaaatgctgttcatgctgaaacaatggaatacatggagaaattcgttgaacgcgataacaccgcgatcatcactcctactcacctggacgcgctcgaagatcgtcttcataagcagattaaagatcaatttcctgaaaaggttagccgcaacttcattcgtcaggaaatcgttgcaatgatactgaaacattacggcgttgaaatcttcggtgtcgaaccactgaaaccgaagaaagcacgtcaaatgcctaaacagatcaccgacgaagcaatcaagaaataccagaagaaatacgctaagaataaatgatctttaatacgattgaatgtgttccttcaagcggtaaaacaaaggcgattctgaaccatatcaatcaaacgggcgaaaaagcaatcatcgcttcgatttccatgatgttatcaaaacagtcttatgactattacatcaaccaggtaaaaggaaaacgggcggtgattgtggacacggatcaccgaaccaaaagaaccaataacgatgcgctgcgtgaagtagtcaatgattacgatgtgatctttatcactcatgcagcactcaaaaacattgatgactttgatttgtataaggatttttccctgtacattgacgaagttcctgatttggttgcgttcgaaagtctgcgatttaatagcaatatcaagcacatacgcgagatttgcttgccgtttagttgcaatgccgatgatatcgttgatttaaaacttgacgaagaaaaacgagaactggttacacgattagcctatgatgggcttcgtaaacgtgatgatatcgcaatgaagatgttcccgctttaccgtgctctgttaggggctattccggtgaagatgcaatgtagcgattcgggatatgtctgttacttcgtagaggatcatgacgtaagccagtggaagttcaaaaatgtaaccattgcttcatccaacatcaaagacacgattacagggaagatcctgcaaacgtttcatgatgtggagttcaaagattcaccgcttcaaaagctggttgactttaagcaatacaaaaacactgggcgcatacatatacatgtgctcgcagagggggattattcgcggtatacgggcgatctctctcaatctgggacgacagtatacactcagattaaaaaacgcgtggaggcgcttttagggggcgaacagttcatctattgcaccaacacatacagatcgaagtttagcgaggggcaggaaatcccgtataactcgcacggattgaacttctattcaagttatactaacgtggtggcattattcagttacaacccgttaccctggcttcgtcaaatgttgcgagcggttgcggtgtcctctggacttgaagaggaagaattagttgatgcttatgttgtcagtaaatattacgaaccagcctttcagttatgcgctcgttctgatatccgacacaacaacagcaaaagaaagattaatttatttgtgcctgatatgcggttagcgaaatacatgaaggaaaaatattttcctgatgccattatcgaaaccacagaagcagttcaaacgaaaaggcaacgcaaatcatttcaaacccttttccaaatgacggacaaagagaaaaacgcttttacgccatacaagaaaagaaacaaattagattatgcgaatcctcttcatcacgcgattgttaaagattggctgaacaattaccgtgagaaaaaggcgacttgagggtcgccttttttgtttataaatatcagtattgaataagataaaggaaaacgataatggtagctaaatcattccgcgccacaagtggccttgatgctgctggcgaaaaagttatcaacgttggtaaagcatcacgctctgtgttgagcgacggcgtgaacgttgacttttttaacgaatttaacacgatccaacaatacgattctacccgtggttatgctgcgtttatggctatcatgtacgcgcgtcgtatttggtacgctcgcgcagatattccatcaccagcgggtgctttcgatgaaacaaaatggatctcaacccgtaacgatccaaaatgggtatataacaacgtaacgagcactgacggtctccctcttgaatccggtacgtacttaatggctgatggtcgtttctctgaactgacctatattctgccagatgcccctgttgagggtgatattatcaccattaaagacggtggcggtcttgcaggggttaacaacctgttagtacgttcaaacacccgtcagatccgtttacgtgatattcagtcaagctcttatcgactgactcacccatatataaccgttgcgtttatttttaacggcaacttatggcgtgttgctgaaatgcgtgataaccgtgattcgcagtttgttaatgcgactggtttaaccgctttccaaatgcaagcgggtatggtaacattccgtaacagtggaacgggtaaaattacgttgcagttgcctcgttacgcaaatgatggtgactcaatcacaacttacgatctggatcgccttgcttcggtgaacgttgcgactctgcaagtttatcctggtagcggacacacgatcagttatgacggtatcaataacgtaccctctgtgacttcacagcgttccggttatggtattttcatgttcgatcaggctaataaccgttgggttgtttatgacggtgatcagcgcgttcgtctgcgtcgtatcagtgatgacctgaacatgttgccgaacgattacgtgttcattactcctgttgctggtagtcctccaactgtgcgtaacgttacgctgactcttccgcaagatgttgccgaaggtgatcgtgtgtatatcagtatgtacatgatggggaaaacgcagaactgcacgatcaaagttaaagatggttccggtgaaaagatccgcaccaacaaaaacatgatgcagttcccacagcgtaaggattatccgcctaatgattggttcagtgttgacactctgactttcaatgccgatactgactatcttccatacatggaattgtcgtatctgaaagatacgaaagaatgggtagttgcacagtatcgcccgatcattgaacgtgtcgatccaacaaaccgttctcgtctgggtgtgattgcgctggctacacaggcagaagtaaacaagaaccatgaagatacgccgtctgatgaactggcagtaaccccgcgtacactggcgaataaaacctctactgaaacgcgtcgtggtatcgctcgcctggcaacaactgcggaagttaaccagaacacgacagcaaccttccttgatgacgtgatcgtgacgcctaaaaagctgaacgaacgatcagcaaccgaagatcgtcgtggggtgctggaaatcgctacccaggcagaaacaaacgctggtactgatgacactaccgcaatcacgcctaaaaagctcgatacacgccgcgcgaccgaaaccttagcaggtatcggaaaactcgttacaacgggcgctacgacagcggagggggctttacgtggggatgctggtactaacgtctacaacttcaataacggtgttgatctgatcaccccgaaatcattgaacgagaagacggcgaccgaaaagtcaaaaggtctggttgttctggcgactgaaaacgaagtggtaactggtgctgctgcgggatctgcttcaatgccgatcgtagtaactcctgaaatgctgcatcgtaaaacgtctactgaaacgcgtatcggattgattgagatcgcaacccagacagaaacaaacacgggaactgacgatctccgtgctgtaacgcctaagaagctgaacgatcgtaaagcgactgaatcacttgatggtattattgccctcgctaccactgcggaagttgcagcaggtacggtaacgaataaggcggttgttccggttaagctgaaagagttcttcgacgttacaagtcatgttgcggttgctaccgatgacggtttaactcagtccggcactatctggacaacgattaacctggggattgcgtctgctactgaaacacagcgcggtactttacgtgttgcgactcagggtgaaactgatgcgggtcttctggataccgtgttcattacgcctaagaaactgcaagcgaagaaagcgacggataccgccgaaggtattattcgttgtgcgactaacgcggaagcgggtgcgggtactgctactaacctggcaattactccggctaccatgcagttcttgaacggtactgatccggcgtggggtgcaacgacaaatcgacgcggtgcggtgtttatcactaccaaagcaaacactttcatcggtgataatctggttggttctactcaggccgttgacgattatcttgaagatttctatgctgtatcgcctcgcggtctgaactttgctctgcaaaacttcttaccgaaaatggcaacggcgcagaatagtttgagtctgggcggtgtggttgctgcaagctggatgcgtcgtgatgcaaaccagacggtaactggaaataacacgtttaacggtacaagcaacttcgttggtaacgtaaccactaacggaacactgacggctaacgctgcggtaacggttaacaacaccgtaaccacgaacaataacattaaccagtctgcgaaagcaaacactgtttatgcaaatactgttctgagtggtgaggctgcgggaaccaaaaacttgcttcgtacattccgtggtggcgtggcggatacgatctggcatgaaactgttcagggaagcacgtatcgcctggcgacgggcacaacggatctggttgacgttctgacagtaggtgatgtcggtaacggcacaatggcgtattccggtacgaacattcgtctgaatggtaaagctctggctaacatcaacacggcgggtgatttgtttgttgcaagtacagcaacgcctacggtacaattacgaaccgctgcaactaatggttggaacggtgtaacaatcagtaatgacggcggcacaaccactgcaaccgtgatcaacacccgaaactttacccagcatcttgacagtacctatgtcaacgtagcgggtgatactatgactggtgcgctgtcagttagcgtaaacggtacgggtggacgctttaccagtgtgagcggtacggcacatgttcaggcgggtgatttctctgggaacgtccagaaaatgcgcttaactggcattgacgataaggtattgactgagttcaacatcaatatcaccgattacaacaaagcgatgatcaacggaaacctgatctatcatgcaggtcgtaaaccgactccggcagaaatcggggcggtggcggtagcgggttcaaccgtcgatactctggttgtacgtaactatatcaaaatcggtaacgtgaaaatcttcgcaaacccagcaactaagacttgtgaatttgtgtgggaggaataatttaaatggcgaataacgaatttatggcgttattcggccctgatagtttcacggcgagtgtgttttcagaagcaaacgccgtgaaatatcgccttgttgtccgtggaacgaataacgattctgcggtcaactcggttgaggtatctatcaatggggctgatattattaaccgaaacgtacagcgcggtcgagggattaaccttgctgtaattgacggtacgagtttggctttgctggatttcaaaacttttgatatgtatggtgatcctactacgaatgggactgcgattagtgattacctatctacacttccagcaaacagaattgtatgtttctatacgttcgatgctataaaatctaccgatgcgtttttgagttatatgcgcacaatcggatcagttgcatggcctgaaacacgattctttaacacgccgtcatcatcaacaaacaacccgcaccgttcatcctattcagcaatctattcatccacgatgaaaaagatctgtatggaaaacttcgtaggtggttctggtactggactcaaagacaacacgacgagttttgttgaggttgtattcgatgaattcagtgatatcggggtaactggtattcctgaaagaatggttgatgatgttcaggtatatcagaacagtggcagtgcttacggcttccatttatatgggatgtgggatattggttctactgttttcttgggggacatctttaagttcactggtgatgtttattgctcgcaagaacttcgcaatgctggcggcgaatgttatctctatatgtggacacagaacgcctctggtcaatggatatcctctgcggtactgcgaacaactgggttagctcctgatgaatggcattctctgtcaggatatttcactatccctacggacgcgctaaacgtgaagatgggatgtatggtatatcactacccgtctaccgtgaaagtggggcttgctcagtgtcgcaatgtccagatcagtaaagttccacgaatcgaaaccgatcgcaacggggcggcaattggtgtaaatggtatcaggatgcaaacgctttccgaagttgatgatgctggaacccaaaacccgattgataaattgctttctctgcctgtttcgcctactggggttattagtgacaagaaaatcagttcgcataactttgctgaacttgattatattgtttctgatccggttgaatacacttcgacaaatacagcggagtaccagttcaaagaatggactgctacccagcaagcggcggtaacgaaagcatcactaagcagttacggattaaaagctggtgatacgatccgtatgcaatgccaaatgaaacgcgatgcaaatgcgattgctaacaataaaggcgcatatattgtaatgcagttctgggacgcgaataatacgtatatttcagggatcaacatgcgtgatgttggtacgatcccgaacgtatattcattctacaaaaacgaaggggttattcctgctggtgcggttacgtttgatttcggtttatatcgttatccaaacaacacaaacatcggtacgatatccgctaaagacgttaatttgtcaatcgtgagataaaggggcgaaagcccctttttcataaatacagtcattacaggagaaatttttatggctgatttgaaattaggtacaacgctgggtggtgcgggtatctggagtgcttctaaccttcctctattgccctctggtggacaattaacgtataaaggctggagagtatacacagaaaatgatcgtccaacagcggaggatatagacgcactatcgacgattaacggcggtactgttgcgaagaatactacattcaatcagaatttggttgtgggtgcttcattaactgctaacttgattcaatcgaatagtgttcttaccatccaacgtagcgcaaaccctgcggaaatgattttctatcgtcccgatattacggcaaccccgtcatctgaagcatgggttttaaacatgtatgcgaaagatggtttgaatcgaggcatgggttcgttgattatttctgctagtactgacggtggaaataaagtatatctgcgggcgaataaagacggttcccctaatacaagtttaacgctggattcgcaaacccaacaggtaacagttgagcaaggatcttttcgcgtaatcggtactacgaatcttggtgtgacgaacgccgcatcaatggcggttagcggtgcggtaactgcgaatacagtaaccccgacaaactgggctaaccatgatgaacgatatatgacgggcattcctcgcggtatgtctggaacaagtttcggtgctgctgttgtaactgaaaagaacgatgttctgtcggtaggcggtaacatcaccgacggtccatatggtaacactacgtattacgggcaggttgtcaactatcgccgtacattgaatagtggtgtttctctggttcagacttactatgatataacatcaacatggattcgtgctgcgacgggttctcctggtgcatggtcttatagtgcgggtgatgctaatggatggagaagaatttatgatacttcgcttcctccgactccggcggaagtaggggcagtcaataaatccggtgatgcgatgactggtgttctaacactggcaaacatatctcaaccacttaaaacacccggcggtggtgttctggctaatgacgggaacgtgtatatcaacaaaagcgggtttgcaggatggattgatgctttattcttgaaaaatacaggtggtactgtaacaggaacaatcaaccagacaggcgggtattttgatacatctgccgaagggagaggttcatgggcttcacaaaacaccgcaaaagctccaattttccaaaccattaacacaacagcaacttccgaatactggcctattgttaaacagtattacacacaagctggtggtgcttggtctatgggtacgttggtaaacactaaccgatttaccgttcattaccgcacgagttcggtagatcggcagtggtattttgacaattcaggtgaatttgtatcatctggtgatattattaccacctcggcaaacggatttcgtatcgcatatggcaacaccggatcatttattcgtagtgacggaaacaacacgtatttcctactgacaaatagcggtgatgtttatggtggatataacaatttgcgtccgatttattacagcaacaccacgggtgctgttacaatgggacatacgttatccgttaatggtcgtattagtcaatctagtagttatattgacaatggaaatttaacattaaacggtagcggcaacggacgcgttgaatttattcgcagtggtgcaaaccctcgcgatatgtatatgttccatgctggtgatgcttctcgtggaaaccgtattgaaatctctgatagtgcatcatatctggtttattttgaacgcaacccttcatccggcattcagttggtaatgaacggtaacggtagctttaacgatgtgtatattcgttctgatgaaagactgaaaagcaatttcagtaagattgaaaatgcattggataaagttgatttgcttgatggtatggtgtacgacaaagcaaatcatatcgggggtgaagaaactacccgtgaggctggtttagtcgcacaacaactgcaagaagtattaccggaagccgttaagaaaggtgttgatggtgaacagaacgagatcttaactgtttcttcttctgctgttatcgccttgctggttaacgcggtaaaagaactccgtgaggaagtcagggaacttaaatcccgctaattaaaagcccttcggggctttttctttttataaatatcataaaagcatttgaggatctaataatggcagatttaaaagcgggtactaccgttggcggtaatactatctggagtcaggcgaacttgcctttgctcccttctggaaacacaatcacatataaaggctttaaaatctacaccgaaaacgataagccaacaaaggcagaaatcggattaggcaacgtaacgaacgatgcacaggtgaagaaagctggcgacgatatgaccggatctctgaaccttacaggaccggatagtcaattaactgttccgtatcgcctcctgatgaaacgagcggcaaatggcgatccctatgtgttgtttgtacgtccagacaacaacccaacaacggtcggttatccatcaaacacacttcgtgtaatgactatcactgctcgtgccgcaactacagcagatccggtttctggtgctcaattggctaacgtattagcagatcagacagcacagggtaacggatcactaacattgcaagcatttgcagccccaaatacaaccacaggcgcaagcggtgcgcgaacagcagagatttacctaaacggcaacgggcaagtatctatgacgggttccggtttaacgataggaatgcagactgttgttagtggtactatttttggtacacaaatggctattaaaggcgattcgaaccgaaacctatacttccaggatgctggcggtaatgagcttggtttgatctatgctgatacaggaaagaacttatatgttcgtactggcggtggtgcatatgcaactcgttttgcatctgatggaactttagttctcgctaaccatctaaccgttcctggtcaggctacatttaatggtctgggtgtgttcaataaccgtgcttctgtaggcgtagattatgattcgcaaggaataaactcagcgattcttcgtgttgaaacaaacggtgatggaaacggggttggtgatggtgttacccacttaggctataaagacggcaacggacgatataaccattatttccgtggtactggttcgacttctatcaacaccaaattggggcttaacgtaaacgtaccatcgtattataacgacgttccacagggcacaccagcgcaatatttcttacctactgttggacagggcgggaaaaactatttgcgtcagttccgaggcggtaacgcggacacaatctggcatgaaactgttcagggtggtgtgtggagactggcaacaggttctacagacggacaggaagaattgcagatttctactgcgggttatgctcgattccgtaacgaagttcaaagcgctacgtctggttctggtggacagttccgcgcggtacaaggaaactacggggtaatacaccgaaatgatggtggtaactactataccttgatcaccaactccggcgatccttatggaacatggaacagtttacgcccgattactatcagcttgactactggtattgtttctataggaaacggcgcgaacattaacggttctgttaactttggcaacgcggtaaacttcaacggaacggtcgaaacaaacggtattggttgtggtacgccaaacggattgggtacgactggtatttctctgggtgataacgatacaggtttcaaacaggaaggtgacggtattctcaacgcctatgcaaatagccagcgtattatgcgatggactactggtgcaactgctaactataaacagttacaggttcagggtgttaacgggccagcattacttctgaataacacagcgactaaccaatcatgttatttgctgattactttggcaggtaacaacggcgcatacttcgggtttggtggtgctgatgataacgtatcggtacacaactaccgactgaatacgaccttacagttgcgtacttcggatctgtatatgaaccgtggtctgtatgttgaaggtaacgtaaacgccaacgatgtgtatattcgttccgatattcgactgaaatctaatttggttgaattgaaagattcattaagcaagattgaacagcttaaaggttatatctacgataagcaatcaaaagatgctgatgatatcgtataccatcgcgaatccggtctgatagctcaggatgttgagaaggtattaccggaagcagtgcgcgaagacatcgacactggtatgttaaccatttcaccttcgggaattaacgcgcttctggttaacgcaatcaacgaactgcgtgaacgtctggaagcaatcgaaaacaaattaggggcttaattgcccctctttcatgaggtatttttatggctattgtaggagtccctggctggatcggttcgtctgcggtcacagaaacagggcaacgatggatgtctgctgcgggtaatgcggttcgaatcggaacaccgttttatatgtctcgaatggcgggacaatcggtatataacatcaactttacggtgtatgagcgttactataacaacgcccgttatcgtggtcagtggggggttggttggtattcaccatattcgaaaccttccggtcatgatgcggttggtggtagttttaacggcaacgcattcggtactgtagttgcagcacaatcaacacctgatatcagtgtaattactattcaaaacggtcctgctgtcaacctacgtcttactatggatgacggcggtgtattcgattttgacaacaacggacgtatacatgatggatatcgtcaatatcaggttgtttcttctcaggcgaccagttggtatgactatctgaacgcccgtacaggtcagaaccgttctggtttggttacgcaacgttaagtaaattcctaaatatattcgggggtcggcatccccgaacttgaggtttaaacatggcactattacaagataaattggcggtgcttgaacgggtaatatcgttcatcatggcggtcaaaacatggaaacagttattcattaaattggttcttatcgtcactattttcattatgttcgtaacatggtacaagtgggatgacttattttcagtctggaaaacatcttcaagcgttatagacgtgccgacgatggagattgaaaaggcaaaaaagtttgaatccgtatccatcgaacagttaaacatagtgcatttaactacgggtgcggatttttcggcaatctttgggttcagacctaagaatgtcaattattttgttgatataattgcgtatgaagggaagttaccgcaacagattaacccgaaaaatctgggtggctatcctatagacaagacatcggaagagtataatagacatataaacgggctgtactatatctcagatattgcaagcccgtatcttccaacaaaagaccttgttccggtagcatatacctttagttgtccttatttcaatctcgaaaactactattctggatcgattctaatggaatggtatatacagaagcccgaagtcgccgatacgaagttgatgatcgtgtgcaatcaggccgcaagaattttaggcaggattcgatgataatttcagtttcaaactactcaaagcccgattgatgaaatcttttactttcgtcatcgggcttttatcgtatatgtcccatacgcgcatgagttcgtaaggtgtcggaacatattcatcgttccagtatccaacattacctatcgtaatgcgccggaaaccagcctctacgctgtgatatacaaagaacccagccttacccacaggggcgactttaaaaccgcgtgtagcggctttcatggcttcgtcgtgtgtcatgatagaatcacttcgcctctgtattgattgtgatagatgtatggacgaacacccagtgggtgattatctatgactaagatcgggtcaagttcgtcgttgttatcatcttctgcaactatatcccagtcggtcgctttctgttcttcaacactggcaatgaatacctggttaatctcaaccttacggtgagaacggcgaatgatcgtatccccttcgcggaacacgatcatatctgggttaatcgggcggtacgcggttttacccgcgcacacttcattaagcatttcttcgtatgtcattataatacctttactcgctgaacgattgtttgtttaacttctttgtattcgttgtgaagtttaggtgtcgctttgaagcgaatcacatcaccctcttcaacaattttgtttccgtagtagataaccacgttaccatctacgttgattttggtcatgaaacgttccacttcggtgtaataagaaacttgggtatatccgagagaaatcactttctcaacaaccccgctcatttccatacgcttaccgatttccccgatgtgctgtgctgctgcgatcttcgcctggcgctctgcttcccattctgcgcggatctcttcacgtttagcgatgtaatccttctccagcgctacgcccatgcagtaagagcaaatagcctgaaatactgggctatcgttgccgttttctttgcactgatcagcccaccacagaatcgtatacatcggcatatcagcaatcacttcacctttacgcttaccgattggcatgatgccctgttccagcagttccaggttttcggtatcctgtacggacagtttaccgcgacgttcaaacagatcgaaatctgcgaagccctggaacaccatctggaaagtatcggtttggttcagacgatccaccatgcgatcgaagtattcacgcgctttcgcttccgctttatctgggtcagtagacaggttgcagatatagttatcagaagtgaattcacctccacgacgctctacacgcagagtgtacatagcgtttttagcgccagaagaaatgaaatatgtcgcggtaactttagtcaggttagtcatggtgaatctccttagtggtttcgtttcgacaaggccaatataacaaaagccctcaaccgaagtcaagggctttttatcatgcgttcgaatctttcataactttatgaagatggatatcaaaaattttccagtatgcttttccgcgaggataaatttttgctttatcaatgtcttcgttgcttccccatgtattgtttgggttacgacaacgattttttgcataatccatgtgccagaataagcgctgcaccgatgaatctgtgcctaatggatcttctttgctgaacagaatttgtgaactcataagaagaaacctgttcgaactactaaatcgatctgtttttccggtatcagtggcgctttatcgtcaacgttgcactgataatacatcccgacatactcatgaggaacgttggattcgctcgcccatttcaggttgtcatctgtacgcggccctaacatgaggttaacgatattgacagcgtgatcctgttctggggtattgttgcatccgttcacataatgtccgtgagcggttttgaggatttcaatgatatcttcgtcggcttcaacgagatacagccccgtgttttctgggatttcctcaagaataatcaaagcggttttcatcacacttacctttatgtttctgcttacgttttgcttctttaagtgctcgcttgcgatcgcggtgagtagaagcgcggttgaaatcatgtttcgctaccaggttgttcatcgaggatataatggcacatgatgttgaatactgacttcgccatacagttttacgatagttaagctatcagatcctttaacaattctgtatttttctggaacaacgcggtcgatttcttttttgacaaagttaagcaatccgaagtcatctatatcttttggtgctttggaaatagaagacaacgatactcgttgacgtgaatcatagtacgaagaaattacaaacatatattattttccttattggggcttttcagccccattttagataattaatccagcagtttgcggatcttatccgcgatacgtccggcgcgggttgcgcttgcggtgtgatcgctttctttggtagccagttcagccagcttacgctgatgttcttcttccgctgctttgcggtctgctgctacctgttcgacctgcttctgatcatgcgcaatacgcgcttcgagttcggtcagggttttgtcaaaagttgctacgatttcgtctacagaacggattttggaaaacagtttcatattcattatctcaattagtatggttggaattcaaagtcaaacagatcatttagtgcgcggttgtattcagtatagttctcaccatccccgaaccgcatctgaatcgcgctttccgctattgtaccagtaagatttgagaaaccaaagaggtttttaatcttatcgtgtgcaacgaagtacagagaagcactatccagcaaggccaccatcgctgatggttcatgttcgcggcgtttgatgcgtaacagagtacggtttgcgccagtcttacggcgttgatttggggctacgtagaatcgaaatactactttacccgttttatcatcaactaccaggtagaagccgtgttctttcaggtcaaccccttcgaacttggtgaagtcaccacgcttcatgtcacctatcttaacagcatatttgtggatgtcaagccttgtcagaattcttttcatttttcttcaccagtttatttcctaatttggtgtttacaccagttttcatattcattgtcagtaccagcaagaagatagggcatgacaaaatcaagatcgttgcgccgaacactaagcgaactaagcgaatcaacaacgtcccgatccatttcatcggtatctctacccacttctgaaccgttgcgagtaccagcataacataacccagattaaatgcaagggctgttgcgataataccgtaaggttttttgaagtatgtctgttcaccgtcttctgtacgtccagcggtaacgttgcctccgttccagatttctttagcggttttaatggctgtttctgccccgctcaagttctgccagtagtcgggggtactctgtaggaatttcataatcgaatcctccgcgcctgaatcgctccaggcgctgttttggggttagtagtgactgaatcccacggttacatcacgcatcacctgataacggcatacacgcatcttagcgttgtcgtaatctgtcgggattgctacaacatcgcgaggattgaccttaacctgaatgactcgcccacgtccaccgccataatgaggcaggtacgattttgcggcaacatgcaaaccgcatgaacaggttcggtttttattctcgtctacctggttacgtggcatttccaccacaacaccaggggagttatcgaacttaccggaagccagatcgcggaagtcttcacgaacacgtttccacgcgtagaaatctccgtcatctgccagttcgatatcattatgcaccatgaacccataaagctgatacacagcatcgcgtgaagggttttccatcaacttctcgaagaagttaaccaggtgctcgtaagggcggtcgttgtacatttcacgaacgatacgttgcgtgatgccgctgtcaaacacgatatctttgtacaggactttatgcccgatgattttaatgttgcctttgctgtaaatcttcaacgcttgcgttgtgtccaacagggtagcaactccctcgatgtctcccttaaccattaaagcgtgtgctttttcgaagttagggtgtgacgaatccgctgtgatgatcttgccgtccagtaccagagtaatgaacgattcagaaccaatcattttagatttgacatctttttgcggaagtggtttcgtcgcttccgtattatacttagcgtgttgctcggtaataacgcgcccgatggttcggacgcttacaccaaattgtttagccagtgcggttttgttcgcgctggtaagaaagccctcatagactgctttcttctgtacatcgtcaaggatcttaacgtttctcattatttccaccgtataaggttaatcaggttcgtcttgatcttatcgtccgtaatcatagtacggcctaaagagtaagacgaattgcgcaacacatacaccaatgcagggttgcgttcttcaaacaaatcaaaggcggtatcaacacgttctttcatatctttcagcattttgtaatgcttcacagacatttcacgaagtaacgggttacgcaccacatttttggatttgtttttgttctcgatagtatcgtaggtaaacttaccatcaagataatcaagcaacaaatacaattctgaattatagcggtttttcaccatgcgatcaagagtcacctccagataatcgcgaagggttcgaacctcgctaccgtgtttagacgagatccaggctggataccagttaggcttcatctttttcaccgcgtcggcaaaacgctgtaccagatagtcatcaagacatttcatgttgctatctggaatgcgactccacagagagtttcgcagaaccataacgcctttcagcccagtaactttcaacagggtcatcatactgctggcaatactacccagtgtatagttcggtgcttctccgtccagtcggctatattcatcaagcccatagaggcgcatagcgtacatttcatccagtttcacgaactgtgctttagtcaggaacagatcatttttctgtaagttaccctggtcatccaggaagtaatgatatgccgtaggcgttttcggacgtggttcagaatcaccagaagatgattcacgcgttgctttccagcgcttgcgatcttcggtgtacgtttcgaattctttggtcaattcactggttttcagtgtaacgatctcagattcatcgaaatagccagtttcaatcaactgacgcacagagtcacttttacgatcggcagttacgaaactgatacgatccgaaccgttcatcatgcagtaaccgatcagatacgggcggagtgaacgcgcttcgttatcattttcaacgatgaacagtttcttctgtcgccacggttggatcatgcgcataacgtcctggcgtttggtggtttccgctttatacttctcataacggcgaccagaacccacacgttcgaatacgcaatctttcccgtcatatgggttagcccagaagccccacacatattttccggttgctgtatcagggtttttgatgcgcgtcagaatttcagccagcgattctttacccacacggaaacggttatcacgggttacgaatgtctgtaacaagctaggcagattattgaaccatacgagtttatcgcgggttgtcttctgctttttatactgttccatcaactcttcatcaaagcgtttgttgattttatccagtcgatccgtaatcactttcttcgtgactttatcaaggctcaactcttcacgcgacggcatgaagtccagcgatcccagagggaaatccagaatatatgcgtaattgctgttacggtagcagtagaacagcgagttttcaaacatatccaggtcgattggatagcaaatgttacccatacgcgcgtatacgcctgaatagtttttagactgataacggatgatcccgcgatcgtctgcttcttttggttgccagttaacatcaatctgaacaccaataaagcgcggacggatacctgtaaacggttcataaacacgcgccgcttctctttcccattctgcgatatcttcaactttcacaggaacggtgatttgaacgccgttaggttcgtctgtttcgatttcgtagatttggtcaacgaaaggttcaccattatccatgtaagccgtgtatgcgcgtttaacgccgtcctggatggattcgatagtgaatgtttcggtgtaacagaacggggatttactacccagtcccagcgccccgatcagttcgtcggtgtcggttttggtggattcgaaataggttgcaaacacctctttaaccatccagtcacttaaccctgtgccgtaatcacggacgatgaaacgcggatcgagaacagttggtaactgaacatcgaacgggttcatgttacccgctaccatatgaccatcaatggcgttactggagatttcgcgaatgattgcgcggatcttgtatttgtagatggttgatgacatgattttgtatgttttcgcactggtagccattttaaacttcgtgcgttcgcctttatcgaagcccgtagtgtgaatggtttgtggtgctaactgacgcaatttcattgtttatatctcacttggtgttgaagatgatgttatcacatgaatatttcataggcttttgatcaagcccatactcaacaggtgtacacatccggtcaaggtattcgtaaacctgttgcttctgacgttcgcggtctttcatatccatgataccgaccacgatagcagttacaaaacatattgcaatagtacacagcacagctattgtaatatattttcccgtttttggtgcatcatatggtttcattgaatcgcctctgcatattgttctggtgtcaatttacgcgctactaagcgccctttggttgctcgtttgtttcttgaaatgtagatgtttgcaatgttgcgtttaccttcctggatctcattgtacatcttttcggtcatattgcactgataaacttcaccgttcggagttttcaggaaaaacgcgtatatgtctttttcgctttcctgaattactgatttctcacggatacggcttttgcatggtgtaggctgtgcgcccaactcgatagctttacgctgccatacgatcccgtgtccagccccttcggtcagagcatgtgcaatttcgtgcatgagagtatctaaaacgttctcgtagatatcttccttaacgtgagaacggcttaattcaattgacttgcgactgtaattgcattgtcccagagtacgcttgaaacgtccgttaattttgaaagaccaatgagataagccatgcttcgccatgatgcttttggcccagatggttatttccatatcgctacgagttttgaacattttatatcctccccaatcagtgaggacactatagcaaaaaagcctcccgcgatgcaagaggctttttgtaaattatttcaatttcttcgaaagttctttcaaatcattgagatattcagttttcggggttgtttcttcccagtatttcagttgcttacgcagttcgttcgcttcgtcttccagcttttgacgttcatccgtggttagatgatagatgttcatcgcaaccaggatttcggcgtggttctcgcaacccgtccacgtagagacaagtttaaccgcttcgctgcgactaagccccttcaacgcgtcaggttgtgcgatcatctggtcaatgaagtcaaccttcgccagcgccttatctaacgcttctttagtctcctggatgcgtttatcaatacgctgttggtaaacaccaatacggatatcaacgaagtctttcagcaacgtttcaggacgctcgtatgaatgcagtttcccgttaaagataacgttgatgttcgggtttgagttctcaatcaatccgaaatctttcaggatcttctcacgggtaagcccgtttgcgtactcacgtttaagggtgatttcgtagcggaaatcttcttttgatagatccttgtagcttacgatataccctttctcttccagcttatccaggatagagatatatttcacgcgatcgtacttgaccggaatctctgtgatcaccagtttggttttaccctggagttcatacttgccgtaaatagtaccgttttcaatgtcacctttgaaatgcgggtatttcagatccagtgtgaaatctttcccgttcaggtaactaacacatccattcagaaccgaaatcggatcgtgtggtggaatgttggtagcgtatgctttcgcgatcccgctgaacccgttaaccagtaccatcggaatgattggcaggtaataggctggcggtacgtgttcaggatcttcatgtgggattgttaaatcctcgtccatatagatagccttgaacagcggagacagcttacatttaatgtaacgcggtgcgccaggtttcttaaccagacgggaaccaaagaacccgtcgcggtcaaaaagcgggatgttattgcaccagtgcgccgccataagagacaatgcctcttcaacggatgtttccccgtggtgataaccatacattgcaacaccgccagcgatagaggctactttctggaagcctgtaccgcctttcgctgcggaatgcacgaagaaacggtgaacgggtttgaacccgtctaccaggtgcgggatcgcacgagaataaattgtgtaaagagcaaatgtaagcccctccacctgtacaacgtctttaatacttctttccatcatttcaccgaaaatttatgttttccgttcacccagtctttacgcggatcggattcatcaccgaaacacagttccagaacgtctttgtattcgtcgcccagtacgattgtatcgtattttaactggtcgcccaacacccgatcgtaatcttctttacgtaaagaacccagccctttgatatatcgtacctctttcgccttatcgcggaacggtgcgaaatcttcaagggagtagaaccatttttcatctttaccgactttcgcaatgataatcggtgtgcggatataacggatctttttcttctcgaacaactcaggccagcggctaaagaacgcaatcagtagggtgagaatatcgcccccgtcaacgtccgcatcgaccatgatcccgatgttgtcgtaagtcatttcggaagagtcgcctggatggagattcaggatcgccatgagttcagacaattctttgtttttgagcacttctaagttactcattccccaggtgttcaacggtttgccacgtagcggaaatgcgccttgtgtctcttcgtttctgcactcgataaactgccccacagcggaatcaccctcggtcagaaacaaagtggtttctaccccgtcagtgtcgatccctgatgccggaacatgttttgcaaccttcgcctttttcgctttcttcttcgctttggtaatggctgcggcttctgctgcctgtttgcgaatcagagcggactcaatgatcggagtgattatttcagaagtatccataatctgtttcgcgatctttttgtagttcagtccggcgtggttgttgaactccccagcggtgttagtcagtttttctttcgtctgactatcaaaagctggtgcattgaagttatgcaaaaacacaaccaaagtcaagcattcttttacacgggctttcgggatctcgatagcgtgtgttttcttgatcatcggttcgagttcggaatagataccgtcgatcatggtgtcaacatgaacaccgccgtttttcgtatccagaccgttaacgaaggatttctgtttgaaaccgtcttctgtgctcgccaagatgaaactgattttgttgtttgtctgggtaatcgttttatcgccgtacatcgcgccatacatcgcgaatttgttcgggaggatatcgccgttatatgtgaatttaacggcagggaaagccactgcaagcgccataaggcgatctttgatgacttcctttgtctcttcgtcgataccgtccacaccgaagatagagaagtcaggggtaaacttaacggttgtcccttgctccttcgtcgggctggtgcggtaatccatgttctgcgccccgtccgtacagttgatcgtgactttgtgtttaccgttggatgtttcgccgataaagatcgcgctgtaacagtttgtcaggaaagaacctacaccgttcatccccattgttacgcggttttcgtcatcgaagttagaaccggatttagccattgtccaggctgcaacaggtttaggaacaatcttcccttccggcgttctcacgtcatcttgtggaataccgcgcccgttgtccgaaatcgttaccagattgtgatcaatcttcacttcgattttgttcgcatatttgaaatcagttcggatcgcttcgtcgatggagttatccaggatttcgttgatgattttcaccaacccttccacgtattccactttgcggaattgccccatgataaaacgttcatgggcttctttgttcactgaacccacgtacatattcggacgtttgcgaatgtgatcgcgatcgctcaagcagaatgattcatccaccttagcgccctttgctggggcttctggtgctttctgcggctcgttatcgtccattaagaaatctaaactcatattcacctcgttattagttctcaggcattatatagggttctatgaaaaagaaaacccctttcggggttttacttgttgtacgggaatccgtctttcaccatctgcggcttatcaaccgttcgtttcgcctcgcccccgcaatcacaatctttcggttcgtcgcggcttgcgatgctggacattttcggaaattctttttcgcacttggtgcatttataggtatatgttggcattaataaatctctgacaatggaataaaacggatcggggttgcggctttgctgaaaacacattgcttgttccctgcaaacatgagatcagtttcgtacaccatacaaatatatccctgattctccaaaatttgccgctcccagctatcgaaccatttagacaacttctgcaatgaagagaagccgaaaatatagctacgataatttttaccatgttttttgaggttacgcattaaacgaaggtcttcgcatggtgcggggtgacgagtctcggagataccgaagtttaaaccgaactcgattccatgaatatcgagatactcatagagatcgtcttcatcaccgacacaacccgtatacggccctaactgtttgcaccaaccatcatatgacgaaaagatagacgctttcaattcaacgcgataaaccaacatgatccgatcctcgtaattgattaactacaagtatcgtaccacttatctaatttcttatcaagcagtttgttgatcacctgtgcgatttctgttgttccgtgggttgtgctcaatttcaggtaaatcacatccagtgcgcacacgatcgcatcaacgctttcttcgacgatatcaccgccgcgttgaggctgaacgagacattcggagatctccccaacctctgcggacaggtggtgaaccacgtcgctaacggttcgttttttgacgctatgagcggtcttgaaaaacttatccagaactacagcggaattttcgcgcgttacttcctcacctttattgacgtggatcgtaatttcagtttctggttctggtgcaacccataccggattgaaaagccctttcatatcgttgaacttgataggaacgggaataccttcaagataaagaatccctgtttcttcatacaccatactgatccggcgtggtgaattgaagtccatcgggttcttacgcaacgcatcatacatacgacgaatcgggtcggcttcggatgccatttgacacacagccattaacatagatttcggggcgtacatatcaccaattttatacttgctcatttacaatacctttatgataaccaacaataaaacagttcacttctggacgttcgccgggaaaatgcacacattgcatgacgcgttcagccatgagttcttcgcccaaataaacagaggttgtttcttcgttgtaatggcaatcatacgaagttttaacactcataccaggcaatccggcaatatgcataaactttgagttcgtgcatggttttccctcgatgctttttccgtttacatcaaacgtcatatgcatttcggttttgctgttctttgggcgtctgctcatttattcacaacctcattatatgttttcaggttccattcatgcacttccggcactttggagtaatgatccaggaatactaactggacttgcataacactagcacgatccatattgaaaaggaagcgttgcggggaagtaatacacagaaaatcttcggtacttcctctgcttgcgctaaactcttttgtttctccgccgtcaaatttagcatatacaggcgtagaaaaatacggggcgaatagttcgcgtttggaatcgtccgtaatcgcactgaaacacacgtctacgagctttccggttccttcccgtctgatggtgagcattgtccctttcgtgcgccctaagacgtttacagagcgcgtagtgacatcaccaaaagcgtttgtgtaactcacagtctccacaaagcccatatcacgacgctgttgtagcattgcttcgtgttgtgcttctgcatcctgttctactactcgttgtgcggcttcatacgccgctttgttcggatctcttgattgccatgcgaagaataaaacccctgcggctatcagtccgaagattgaccaacttgcggtcgctgatagtttcattttaatattccaaaggggccgaagccccgattttagcgaagatagcgaacgtacccgctacggtcgatcgcgttctctgggttgttgaagatattaccgcgaatacccttagcaggtgctttccatcctgcggctttcaggatattgccgtcattgtcgatgaagccagcaactgaacgctgattgaacatttcaccagtttctttgttgcgggtatcctgcacgatacggtgatacttacggcctttttccagaacgaacacagtttcggtgtaatcgctgaaccacatgccagtgttacggcctttatgcatcgcgtccagtaaaggctgtgctgcggctttcagttcgtcaaaagtatacatggtaaaatctcctaagtgtgtttcgtttctatgggataactatatcaaagctatcccatgaagtctttagcaaaaagtgctatttgttaaacccgtttcccttgataccatttcgggaaaacaacccgctcgataaaagttcttcccaggttgaaactatcaccgaacaggagaacaccgaacagcggatcgcgtttgatgtcatttttcccaacagttttcattttcccttcatggatcacggtgtcgcccaccgtgatatccttgatgcttacttttacatgatgcatacgatcacctctgcgagtttagcaggttttgcttctggtctaactttcaacgcatcattcagattcttttcaaccataactactgcgtcgttttcgttgaaaccgttcttaaccaggactttaactactttggcttctaagtttttcatgatgcgttccttttgtctgtttcgtttcgatgtgtgtaatatactgcatatcgaaattcaggtcaatacccaaatcaaagaaaatcgtatttttcttttaatttttcgtaatacgtatcccatgcggcttcgtcgttgatgatctcagtaccgaaccgataagcacgtttgcgcagttcgaaacgttcacgaatgcgctcaacattgattttcactgattccggcgttggttgccaatctgcgcacaaatgacgatgaaacagggagtttgacagcggactaagatcgaaatcttcgtatgtaccgtccatgtattctttaccattacgcgcgaggtattcagcacgtaatgcagcatgacgatcgcgaaggtatcccagcttattgtaaaagaaggttacgtgtccggttcccagcgtatacacagcagggatttttgacaggttgatttttgccttaccggataaaacggcattgggaatgcgagggagttcgcgcagttctgcaatcaggtgttcgttcagaagaagagaaggatcgattgtgttaatacgtgtcatagttgcctccgtttggtatgtgcgcaatatacaaaaaagccccttgcattgcaagaggctattaaaattattttgaaagaggtataagcatctttcgcataccgccgttttgtgtggcatcatacacgcgtttagcatccataagggagagttcaacatggtatgatttccctttcccgtcaaaatcaaacgttaccgtaccgcttgctacgcttacatgagtaaagatgaactcacccgcgaaatgctttcgaaacgctttgtcgtgatccaggaaccattcaaacgcttccccgtgctggtacagtctgacgataatcattgaaactatgatgaaaatcagaactgctgcgacgatcgtaagctctttcatcacttacccctgtttacagattgacggtgtaacgcacggttaacgcgtggcgcttgataaggtttcattttgtacggtgttggatcagagtattcgatccggttaggtaatgaatacatttcaacatttggctgaatccagcggattgagtcgattaacccttgagttaacgcacgaccgaaacctacaccaactaaacataaacgcataatatccccttactgtgccagaatgtgaagccattcacccaaccacacgatcgcctgataagacaaccacaccgcgccggacacacaagcaatcacaccaatgatcgcgaatccgattaaaatgttcaaaccttctttcaaatcaccaaacatgttttatcctcttttgtttcagtccctacaaaataacaaagcccctgcacgaatgcaagggctttttatcataattcgactaactgaggcaatttcagaaccatccctggaaggatatagcttgcattgctaacggttttgcggttcaacttagcgatagactgccagcgctcaccacaaccgtataatttttcagcgattgaatacatgctatctccaggctgaacaacatattcatcgtattcgactttaacgaacgcggggttcatgagaatgtcaaacatctgcgctttcgcttcgttcagtgtttttgcatgtacagttttacctacaaatgataatttaatcatcttttcctcggcagactcaatggatcggtttcttcttcacttgggggttcttccagccccagcgcatatctcaatgaatagactatcatcaaaacatctttcgcgcaatcgtgaattgaattatgcatcacaaaaccatcaagcaaccctttccgaagaggacaggtcgaagcatcacgcgttaacaggcggttttcgatacatgtacgcacatcgcgactattccagaacacggtcggcatatcttcgaagatgtcgatcttgccaaccatcttacgcacgatatcaaccaggataccgcgatcgaattcagggccacgaacataatcgagtgattgccaacggctcacaccgtccgcttttaggtcttcaaagaattgtcgatgtcctgcatagagttccagatcttccggcgacggtttcaggatttgacgggcttcttcgctttgctgtttccaccaggcaattgttccctgatcagcaatacgatcaggctggttacgcaaatcaaatttgtactttcgtccccgtgcaaccagttccgcgaacgttggcgggttgtgtggatcatcaacaaacggaacgtatgagagttcgatcaccttcccgttcggggaagggccaaccgtttcataatcccatacgtaatctacgggtaaatgactcatgccgtcctctgcttgatatattccataaaacaagccagcgccagcgcaacttctgggttgatgtcgatggtttcaaactctttgctttgcaaagtcatcataccgaactgacgcagaccggaattgtagatcgccttttccagacgggtagcatgatctacagcatcgaaaaattcatacagaatatcataatcaatgtgtaaagggatctcgattctgggtatcttcgaaatcaggtcagcaattgcttccgcgtggaggcgagggatctggatagatatatcttttttcatgatattagtgtccatatgtctttatcttcacgaatgtttcgtgccattcgaaggatcagcacgataacgccatattcatcataagtcagttcaatttcttttgcaataggagaccatgaataacttggcccgttcggagaatacagaacatcgttagatttttcaatgaagcgcaaacggtgaataacttcttgcggatctgctgcgctatacatcccgaacatattgaacgcatgtgggtctttttctcgaattttatcgagtgcttccagaattcggggaatgtcttttacaaggataatcaatttcataataacctcaaaaggggcaaagccccttatacataatcaacggtgtaacgtgcgcgggttactcccacatagattaactgcttacacagatcgtaatctgcgaacgcatacgcatcgcgcgtgtacatgtacgcatggtcatacgtgctcccctgcgatttgtggtacgtacaaaccggaagaggcttaacatcctggaacttgtttttaatcgcccagaacgaatgccacggggctttatagcctgtttgctgcttgatgcgcttataagtgctcgcaacgtaggccagatagttgcccagacggtctttcatcaccggatcaacaacaacttgaatctgtgcttcggtttcctcttcgagcgataccgttttcaggagatagaattcaagttcgatcttctcgtcgcacttctccgccttgataacttcccgacgcgggatgatttctaagactcggattttttcgttgttattatacacaatctcggtaaagatctgcccgttcaaccgcatttcctgaactaacggttcctgcatcacgatcacttcatcgagaatgaaaggttctgttgttttgtacaggtgtttacggatcgttgcgttcagcttgtccacgttgtcgttagtgtaagcgaacatgcggttctcgatcaagtcatccggcgttttgacacggcggaaatactgacggaggaagtcaacagcgttagcatgttggaacacacccagatcaccgacagacatcggtttcagcatcttaccatcacgtacagcccgtgaaacctgaataatcgggttcccttctgcctgacgcatgattttatccatacggatgacatcaaagatttcttcatcaaagaacggggagagttcaacgcgtccatcggcgtttaccggacggatctgatctttatcacccagtcccaaaataacagcgttgcttggaatactgcgccggatgattcggaacagatccatatcaaccattgagacttcttcaacaacgaacacgcgacaggtagacagatcaggcgctttctttcctttctgctgttcgaacacacgcagttcttcgttagtcacagggctaatcttcaatgcagaatgaatcgttgttgcgtccattccggtagccgctgctaacacgtttttagcctggtgtgttggggcagttaaccaaataccgctaatccccaaccctttcagagtgttaaagacaaacttaaccagtgttgttttaccaacaccagggccacccgtaatagttgtatgaatggcgttctggatgttgtggatcacgcgatcatgcgcggacttctgatcgtcgctcagatcatcaaatgttaactcgctcataatttgagtaataccccttgaattttcgaattctcaataaaccaacgcatctcttttttctgttcttcggttgctggtagttgctcggttttgcggaagaaactgaaacgcggttcgtccggcgtgtagttcagtttggtttcgtagcacttgcggataaaatctaatttatcttttgcaagttgcggtgatgcaaacagttccggcgttttcccgttttcaacgtgtggaatagtaaagccgtctttgtctttcgtaacaatgatatagtatttgtcaatcattttcgcccctcatagatgacgtagaaaaaacctataacccatagcaatgataatactatcaaagcggcttttctgtcaacaccgttaacgtggaaaacgcaccatccaaagagatacgttatcaccgcgcaaacgatataagacaaagcaaatacggcatgtagcgcggtgagttccattagtagttgttagcccaacgacgcaggttttccgcctgtttcagagcatacagcttgtagatggtttccgcatccagtcccagcgcgaggaacttacacatgaagaagtgccactggtcaatcagttcaaacatgatttccagcttgtcttcttctttcatttctgcgaatacctggctacgcagttcctggtgatttgctttccacggtttccagacaccggaagccgcttttgcaccgcgagacataccgcccagagcggtgtaaagttcgcgggtttcgtctgcgatcgcatcatcttgcagtttcagccagtccaggatctcaccgcacgttttcagttcgttcggacgtggaacccaattcagggtatcagacaggctttgttgtgcatggttttgcaagtccagcatcttttgcagcgggtcaattccgttctgcaatgcattgcggtagaaaccttctaccatttccagatcatcggctttaaccaggtgcgcacagctattaaacacaggagttttatcagtcatatcaatctcattttttcggtgatttgttccacgacttaaaccgaagttttgccgtgagtccagaaacagtattatctttcaaatactgcatgatttcaagtttagttgcgccgtccgtttttatcatttcgttgatatcttttgacggccacgggcatttgtcccacaacacaaccttttcgccagcctcaattaattttaaaaggcggtgagtagtatcagggtgtctcgcttcattgtcaagaacccagacacgcatatttttatacggaacgtcagacagcgccatttgtccgcccgtaatcgcaccagcattatctacaaacaggctatccagcggcccttcaagcaggtagacaggtttcaacggatcgatggtatcttgaccataaactttcgttgagtgttcacacgctttgattgtcatgtattttgcgttggcattgtcacgtaaggcacgtccctggaatgactcgattttacccttttcatcaaagatagggatcaccaaacgcggttcatccttcggtaaagggtatgcgtccgcattcacagagttaaccaggtgttgccattgacgcgtaaaccagaggcggtcatatttgtctttaggtatgtgacgacctgcaacatacttaacgataggg

SEQ ID NO: 147 - DNA, 40265 bp, Unknown
  source: /note="Description of Unknown: KP2-14 Bacteriophage Sequence"
aagacctctgagaccaacgcgtaccaatgggcgcagcgtgctgaggactctccggtacagggtagcgagttctctgcgtatcattactccctcaagtccgcaaaaagtgcaacagccgcgcatacgtctgaggtcaacgctaagacctctgagaccaacgctaagtcctctgagactaacgctaagacctctgagactaacgctgcatcgagtgctgctaaggcttctgaggaggctgctaagctgactaacatgaatgactttgctgccgctattgattcagtcaacggtaacaatgttgtcatgaagggtgacttcaccattaaaggaaacggtaaagtatcaatactgaaccacagtgggctataccaagataagaccgttaatggcgtgaactatgccaacaggatttatatggatgatgcaggggccatgcacttcgagaactaccgtgtgtctggtgcttcatccaccttacgtgctggttttgttattacagataccaacaggtttgactttacagggccaacgcgagttaatggtgaatctaccgtatatgtgtatgcgccccctaatccggctattggtcaatacctcaatgctgtggcagttcgctcacagcttcggggccgtggtggtaatggtgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcaggttctgatgttagaatcaaggatgatatcactaaacctcttgatggtgctggtgagcgtattgacgcaattggcatagtggaatacacagagattgccaccggggaacgtaaacgtgggtggctggcccaacaacttgacacgattgacccgctgtacacatacctaacgaccaccgcagaaggtagtcttttgaataccaacgacagggcgttgcttgctgacgtaataactgagcttcaagcactgcgtcaacgcgttaaagaactcgaaggacaatcaacaaagccagcggacggcacaacataaggagaacacaatgctttcttttgacttcaataacgaggtcgttaaggctgcgccgattgttggcacaggggtcgctgatggtgcggcccgactcttttggggactatcgttaaacgaatggttctacgttgcagccatcgcctacacagtggttcagattggtgccaaggtagtcgataagattattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatccttggcggtctcgcggctggtctggaagactacaacaaagtggtcggccctaatggtctgactgacgatgagaccatcacgctacagtaagtgacatactcaaggttctccacgtggggagcctttatggatgttatttggtgcatctgtgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactgccagaagataacggtagatgcgagtttaatggtcgagccgaactacacgagtcagatgctaagcgtattatcggaataacccaagctgccgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtattggtaaatcattcatcacctgtgcgttcgttgtgtggacgctatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggcatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagttatcattcgtgcagccagaacactggacagtaccagcaacgcatcctcgtgattgaccctagtggtcgaggtaaggatgagactggttacgcagtgttgttcaccctgaatggctacatctatctgatggaagctggcgggttccgcgatggttattccgacaagacccttgagtccctcgctaagaaagcgaagcagtggaaggttcagacggtggtcttcgagagtaacttcggggatggtatgtttggtaaggtattcagccctgtgctcctgaaacaccatgcagcctctatggaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggctcgtgagaagggcgctgtggcccacgatgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttaccgctatggttgacgggatggaactctattgggaggatgacgatgcgaatagcaacaggttcattgactggtagttatgcatattgagtgcataaggaagcatcgagaccacggatggtcactttaagaaactccttaagaatcaatgagtttgaattaaccctcactaaagggagagaggggacttaaagctactatataggttagtcattcaggttatgcaatgaccttttatgcactttaagtctacctctgtgattggtgatattatcattatataatcacctaccttagagcaactgaaaggaggtggctcaatgttacgcttgctgattgccctgctgcgtcatagagtcacttggcgatttcttctggtacttactgctacccttgggtacgcaggccttactgaccacctcggtcaactggaagtggccttttgctctatactctcttgtggggattaaattattgttgatgacagacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttctggatgcgcctatggtctcacctatggtgtggccttacctaaagtggttgcctaaagagaccctttaagaatttaccacaaaaatctgaatgggtatctcacagttcaagaaaccaaagtacccccatagccctcctaaagccacctaaagccagccctacccctagggtttaaccttcggttaaccttgggtatctcctcaagtggcctataggatagcctaaagtgttgcataaagtcaatacctaaagaggcggatggcttaaagaggccttgaagagtgtcctagtgtaccagttcgatagtacatctctctctttgtgtccctatctgttatcctcctaaagtaaaccctaaagccatcacctaaagccaccacctaaagaccagacctaaagccatcacctaaagagtgccgctatcttaaagacaaccagaccgatagacccattgttaacctgtagtgatgccttgtagttatctgtagtcatttcataaaccctcactaaagggaataagggatacttaaagagggaataagggatttaataaaaagatttaatttaatggttgactttaagtaacccttaaggctattattcatcacgtcaacgggacaacggccttaaagccactccctgagatactggagtcaaccggataagtagacagcctgataagtcatacgaaaaacaggcattgacaacatgaagtaacatgcagtaagatgtaccacataacgttaaccaccgctctggtgtcttctaggtgacttaagcgcaccacggcacataaagcgaaacaaaaatggttgacaacatgaagtaaacacggtacgatgtaccacatgaaagacaccgagtgtcgtaggtgtaaaaacgcgacatagtggatagatggcgaaagcacaagcgaccacgataataaagagcttgtcgcacttataacgcaagtgacggctaacactgaaatagcctcggctcaacgaaactgtagcctaaagttctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagcattccgttctaaccttgatgatgaggtgaacatgagtcgccaccgccacatggtgagcgaattacgtgccgcaccgggtatctacggcgagcttgagtctaccgatttgaccgggtgctatcgtgagagtatcgcactggctccaaccgaggaaaagaccatgcgtgtactctgcaagaacaaagagcaggcactacaggtagctcgcttagcttgcaatgagtatgagcaagattgcgtactggtatacaaatcacagactcacacagcgggattggtgtacgctaaaggtatcgacgggtataaggctgaacgcctgccgggtagcttccaagaggttcctaaaggcgcaccactgaaagggtgctttacgattgacgagttcggccgccgctggcaagtacagtaagtgatagactcaaggtcatgcacgatgcgtggcctttatgattatcactttttgactatgaaggaatcacaccatgcgcttaaataaagacacagcggtagctatgcggtcagcaatcgaatcaagagccgcacacaacgtgggagggattgctgatgttgcacgggtttataaggagaaagggcttacattccgcagattcatgtgggactgttatcatgcagtgggctttaaagagactacaagaatcatcgcagagcacaacacggtgacagttatcggcgggcacataacagatatcaatgattcgcacatcgaaactatgctcaaggttgcactgaaagacatagcttattagtaattaactacaggtcgttagctcgtagcggcctgaatgataattactaaacaaacctgagaggatatgactatgaaacaatacgccatccttattcccggctggtgctactcaatgacctgctacgggtacaacgaaagggacgctcgtgccagattcagggatcaacaaggcttcggcaagcgtttacctaatggtacggctgtatgggaggttatgtaatgagtaagttactggcaacctctaaaatcaaaggccaatgcactgtaacgctgcgtgagtattaccacgggtcaatgggatgcacctatgttgtgcgatacggtaaacaggtcacgcactgggtaaaccttgttttggcacaagaggagtaccaagcctgtgtgatacaccaagcaacatgtgcaggctggaacgactgacaacagacttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctgtgcatcgctatgtactttatgcgagactttaagcgcggtctggcaatacacaaggcaacgctgagttactttaagtggggattcatcccacggtttacggttcgtgaacgtaacggacgctttaaggccaacaaggtgggagtattctacattgctacgcactaactcaaaacacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacaatgactttcaccgaagcacaagccgcactcgaagctatccgcaacctgccgattgaccgcttggatgaacgccagcccatgctggtggctcttgcggctgctatcgtgaacgatgagactcaagacggcgaactgacgcaggccaaaggcaattggggcttggagtctatggactactggcagacactggctgagcgtatgcgtgatgttggatttgtacgcttgggtaacggtcactttagcgcagcatacgagcacgcattgttaccgggcaaggttatcaaggtaggctttaagaaagaggactcaggcgctgcctatgctgccttctgccgcatgaatcagggtcgtgagggtatccctacggtgtacgacattcagcgtcatacaggctgctacacggtggtcttggactatctgacaccgcttaacgattggtgctacggtgaaagcgataagattcgtcaccactttcaggccgcacgggaaatcattgaggaggattgcttcgataccgccgaagagtacccgataagtgacgggttcattgagacctgcaaggatatccgcaagttcttcctaggcattgcatcgttcgattgtcacagcggtaacatgatgaaagaccaaatgggccgattgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggagactttcaggcagcacgtaaagcccgtgccaaatggcgcagaaaggcctctaagcgtgctaaacgtgacgctaaggtaatcgctaagatgcgcatggatgacaacgagcaacgcagggccgagccgagggcgcgcatgttgtggggcgataagcactggcgtaacgcttgggtgcagcacatgaatgttgacttcgcacggctcgaactgttagcagccgcacagatggcacagatagaccacaaggctatcgtatggggcaagccgttacacatagacgcataccttgacaagagactgcaaggttgatagagtcttttcttacaggtcatcatgaggtggcctgaataggaacgatttatccatagtgaggcaagcaatgaacatcatcgaaactatcgaaaagaatgacttctctgaaatcgaactggctgctatcccgttcaacacgctggcagaccactacggcagcgcactggctcgtgaacaactggctttagagcacgagtcttatgagttaggtgagcgccgcttcctcaagatgctggagcgtcaagcgaaagctggtgagattgcagacaacgcagccgctaagccgttactcgctacgcttctccctaagttaaccgcacgcatcgttgagtggctcgaagagtacgcctctaagaaaggccgcaagcctagcgcatacgcgccgctccagttactcaagccggaagcctccgcgtttatcaccctgaaagttatccttgcatcactgaccagcacgaacatgacaaccattcaggccgctgctggtatgttggggaaggccattgaggatgaggcacgtttcgggcgtatccgtgacctcgaagcgaagcacttcaagaagcacgttgaggaacagcttaacaagcgccacgggcaagtctacaagaaagcctttatgcaggtggttgaggcagatatgattggtcgcgggctgctgggaggcgaggcgtggtctagctgggacaaggaaaccacgatgcacgtagggattcgactgattgaaatgctcattgagtccacgggtctggtggaattgcagcgccacaacgcaggtaacgcaggctctgaccatgaggcactgcaactggcccaagagtacgtcgatgtgttagcgaagcgtgcaggagcactggcgggtatctctccgatgttccagccgtgtgtcgtaccgccgaaaccttgggtggcaatcaccgggggcggctattgggctaacggtcgcagacctttggcactcgttcgcactcactctaagaagggactgatgcgctatgaggatgtttacatgccagaagtttacaaggcggtcaacatcgcacagaacaccgcatggaaaatcaacaagaaagttcttgcggttgtcaatgaaattgttaactggaagaattgcccggtagcagacattccatcactggagcgccaagagttaccgcctaagccggacgacattgacaccaacgaggcagcgctcaaggagtggaagaaagccgccgctggtatctaccgcttggacaaggcacgagtgtctcgccgtatcagcttagagttcatgctggagcaggccaacaagtttgcaaacaagaaagcaatctggttcccttacaacatggactggcgcggtcgtgtgtacgctgtgccgatgttcaacccgcaaggcaacgacatgacgaaaggtctgctgaccctcgctaaaggcaagccaatcggtgaggaagggttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggagttgcgcaccacggtcttagctacaattgctctctgccgctggcgttcgatgggtcttgctctggtatccagcacttctccgcgatgctacgcgatgaggtaggcggtcgtgcggttaaccttctgccaagcgaaaccgtgcaggacatttacggcatcgttgcacagaaagtaaacgagattctcaaacaggatgcaatcaacggcacgcctaacgagatgattaccgtgaccgacaaggacaccggggaaatctcagagaagctcaagctgggaacctcaacgctggcgcaacagtggctggcatatggtgtaacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgcctgacggcttcccggtctggcaggaataccgcaagccactccagaagcgtcttgatatgattttcttagggcaattccgtctgcaaccgacgattaataccctcaaggattcaggcattgacgcacacaagcaggagtctggcatcgctcctaactttgttcactcacaggacggtagccacctacgcatgacagtcgtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccagctacacgagacacaactggacaagatgcctccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttccttaagaacatctttaagttaaaccgcttgacttccgttaagttctacgcttggatgcccggtagtgatgacctccgcaagactgaatttaagttaggcttaggccgtgcggtaaggtggtcacgaagttggaatgttactcaacggcctccgggatggtcatcttccagaccactgaggacaacgaaatgaaatccttctactacccgaaaggttcaacatgtggtcgtatcgaacgggcatacagttaaccctcactaacgggagagttaaacttaaggtcatcaccagcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaactccacaagcaacagcgcggtaactcacagaaacgggagtggaactaatgatgggacgtatctatagcggcaacctgaacgattacaaagatgcggtagagcgtctacaggaagaccatgacgtgaccgtgaaggtggagtcattcagttatgaaaacccagcgaagatgtgcaggtcatccggtgaggttctccgtgtgttcacacgctccgggcatctggtggcatccagaaccttcgagcacagcgacagcgatgtacaaatcaacgcgcagactgcacggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgaaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgacaagtttggtacggtcagtgtcgaagaggaaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctaatggctgatatcaaatatgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcatcttcccggatggcttcatgctggatggtgaactgatggtcaaaggcgtagacttcaacacggggtctggcctactgagaaccaagtggctcaagaagaacaacttcatgtttgaccgtggtggtgttgagccgctgaaaggttccaaagtagcctttgagttggacactaagcgcctgagcgtgcgcctgtatgcggtcatgccgattcacattgcggagtctggcgaggactacgatgtacagaacctgctgatgccgtatcatgtggaagccatgcgcgctcttctggttgaatacttcccggaaatcgagtggcttatcgctgagacctacgaggtctacgatatggattcgctgactgaactgtacgaagagaagcgtgccgaaggtcacgagggtctcattgtgaaagacccacaaggcatctacaagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttaacgggtgggcctttcttcgttctagggaattaaccctcactaacaggagacacaccatgtggcttatcctattcgctatcgtcgcaacgcttggattaatggctgccgacgacaacatttggcctgattgttaaggagacaacatcatgcgtttacacttcaacacatcaaatggtatcttttcggttcgccgtgaagaccgctctacagcagtggcctctgagcgcaacgccaagctgccgctgattggttcggtcgtcccattgtcgccgcgtgttcacctactgatcactcgtggagagttcattaaggcgatgaacaaagagcgcccgcatctggaagccgtggtcacttactggcctcgcatccgtctgttcgttaagtggattaaggaggttctgtaatgctacaacatcattggaacaaaccagacttagaggctcgcttcccggttaactctgctgtgcgatactccggcgacttcctcaagcgcttcttaggcatgagcggagtggtcactggtcactcgaacacaggtcgcgttaaggttcgcttcggtaatcagcacgctgagtttcttcctgacaacctgattccgctgcctaaagctgacgttaagactccgaacgtggaagcaccgaaggcagaattcaagtctgacgtgacccacccgaaccattacatgctgttcgacaacgtggaagccattgaggttatcgcccggtcaatgaccgtcgaggcgttccgtgggtactgccttgggaatattttgaagtaccgcctgcgtgctggcaagaaatctgaactggcaactatggagaaagaccttaagaaagcggctttctatcaggaactgtttgataaacataaggggctgtgttatgacgcttcgtgaatgctgcgattggtgtgccgctaagtggaaccaagctattgaggatggtgataaggcggctgctgacgcttaccaacaattgtacgcgctgtgggagcggcgctttaaggaggctcaaagtggagcaacgtgaacagaaatacctcctgacgatagaaggcaacaccgagtcctttgaggttccggtattcgcccggtctctcgaagaggcaacgctacaggctgaacattatgaggacgctgggttcgtagtgactcgcatccgtccagaagtgaaagcctaattaccctcactaaagggaacaacccaatcattaaccacaaaggagaaacattatggctggtttcaagaagaaaatctacacctctggtcttggcactgctgagccttatgcttacctgagtaagccggattatggcaacgaagagcgtggcttcggcaaccctcgtggtatctataaggtagacctgactctttccaataaagacccgcgctgtcaggcaatggtcgatgaaatcgtgaagactcacgaagaggcttatgctgctgccgtggaagagttcgaggctaaccctccgcaggcacagcgtggtaagaaaccgctgaaaccttacgagggcgacatgccgttcttcgataacggtgacggtacgactaccttcaagttcaaatgctatgcgtctttccaagacaagaagaccaaagagaccaaacacatcaatctggtagtggtcgatagcaaaggtaagaagattcaggacgttccgattatcggtggtggctctaagctgaaagtgaaatactctctggtgccttacaaatggaacaccgctgtgggcgcaagcgtcaagctgcaacttgagtccgtgatgctggtcgaactggctaccttcggtggtggcggtgaagatgagtgggccgatgaagtcgaagacggtggttacactgcgagtgaatcccgtcagtcccgcgatgagcaggagtggcaggaagacgagcacgaagaaaccccggatgaggatgaggatttttaaatggaacttaaagagaaactaaaggcttacagcgaagtttctcataacgggtgctgggagtggcaacgctaccggatgccctgtggttacggtaggattagacacggaggccgaatggaactaacgcatcgtctatcctacctagcattcaacggggatatacctgagggtcttgttgttcgccataagtgtgacaacaaatgctgcgttaaccctgagcaccttacgctaggtactcaaaaggacaacgttaaggatgcaatagaccgtggtcaattcgtctacagggagaacccgaaaggcgcaaagcaccacatggctaaacttaatgagaaacaggttatggaggtttacaactcgacacagacccaaagcagcctagcagagacctatggtgtatctcgacaattaatcagcgcgattaagagaggtaaactatggcagcacgttacgcagcacgtggagttaaacgagtagggtcatatagaagcggcttagagcagaagaacatggagatgctggaacgtaagggaatcaagggacagtatgaaatgtggtctattccctatgttgtccctgcatcgaaccacaagtacacaccagacataatcctacccaacggaatcattattgagaccaagggtctatgggatagtgaagaccgtaagaaacacttactgattcgtgagcagatgcctgagttggacattcgtttggtattctcttcgagccgctctaagttatacaaagggtctccaaccagttacggtgagtgggccgaaaagcatggtattctatttgctgacaagctgattcctgtggagtggcttaaagaacctaagaaggagataccgtgggataaactaattgcaaagaaaggagttaagaaataatggctaaggtacaattcaaaacgcgcgcttctacggaagcaatctttgtgcactgtagtgcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgttaaagattacaaccacaactccgtaggcgtatgcctcgttggtgggattgatgataaaggcaagttcgacgccaactttacacctgcgcaaatgcaagcgctgcgtagtctactggtcacgctgctggcgaagtatgagggttcagtccttcgtgctcaccatgacgttgcacccaaagcctgcccgtccttcgacttgaagcgctggtgggagaagaacgaactggttacatctgaccgagggtgatgccatgaggatgatttgtattcgctgtgataaaccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacaaagagcgtgaagcaaagttatcaacgagaagacgcacaggaggcagtaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgccgactaccgagaccagaatggctccatcgtgtcgcagaaggtgcgcgataaggacaagaactttaagaccaccggaagccacaagagcgatgcattgttcttgaagcacctctggtctggcggtaagaaaattgtggtcacggagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgatatggatgatgcaggccgtaaggcagttgaagaggccgcacaggttctcccggctggcaaggttcgtgttgccgtgttaccgtgtaaggacgccaatgagtgtcacatcatgggtgaagacaaagcaatcttggagcagatctggaacgcgaacccttgggtgcctgacggtgttgtttccgcgttatcactcaaagaccgcgttaaggaagctatgacctccgagtacgctgtaggtttattatttgatggctgtcaaggcctgaacgatagaaccttgggtgcccgtggaggcgaagtcatcatggtcacttccggttcaggtatgggtaagtcaacgttcgttcgtcaacaggctctgacttggggcaagcgaatgggtaaacgtgttggcctagcgatgctggaggaatccgttgaggataccattcaggacatgatgggcttgaacaataaggttcgtctgcgtcagtctgatgaagtcaagaaggctatcgcggaggacggacgtttcgatgaatggtatgatgaactatttggagacgatacgttccacctttatgactcctttgcggaggccgaagctgacaggctgttagcaaagctggcctacatgcgaacaggcttagggtgtgatgttatagtgctagaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaagcgcatgaagaaggacgcgctgtgtctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgctggatacatggagtacaacagagaaaccgggtggcttgaaccgtctagctacactggcgaagaaggagaaggagatactggctggactgaacaagacggacagtcagacttctaaaggatgcccgtgtgggcattccgattgcgatggaatcatgtaccactaattaaccctcactaacgggaacaacctcaaaccataggagacacaccatgtttaaattcattaacactttaggcaagctggtagtaaaactgtacttcatcgaagccaagaagctggacaagaaggccaaagctgattcacagcgagccattgagttggcgaaacagtcccgcgagaaatccgatgcggctgttagtggcatccacaagtcggcagcgattgcagccaaagcacagtccatgagcaaattctttgagtaaggatcgaacactatgagcaagtcaatcactcacgcaaacaccatccgtctgccagacaccgccgaccagttctcccgccgagtacacatcaatgtgcgcggcgagaaggtcacgatggtctaccgctggaaagaccacaagtctccgaaagcacacactcaacgaatgaccttggatgacaagcaggtcggtcgcttgatgggtgcccttactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagagtatgttgatggtgctgagtgggtttcgttcaacgagccgatgatggcgtataacgttcaagacgttgttgtcactgtcaagctcttagagaaattccttacagacctccactacttccctgctggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacgtacaggcaagccactgccgagttatcctcgcgtggtctatccgaaacagggtagcgtgtacaagaagcctcgtaataaggcacagcgcgaaggtcttgaaccttgcgacttggacacgagggactacatggagggtgctccgtatactccggtagagttcgttacgttcaagccaagtagccgtgaccacattcagaagaaactacaggaggccggatgggttcctgagaagttcaccgagaagggtgcgcctgtggtggacgatgaggtcttggagcatgtacgagtagatgaccctgagaagcaggcgtgcattgacttgattaaagagtacctgatgattcagaagcgtatcggtcaggcggcagaaggagacaaagcgtggttacgttatgttcaagatgacggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagcagggatagacgccagtggcttagagttgcgctgtctggcacacttcatggctcgattcgacaacggagagtatgcgaatgagattctcaacggtgacattcacaccaagaaccagaacgctgcggaactcccaacgcgagacaacgccaagaccttcatttacgggttcctttacggagccggagatgagaagattggtcagattgttggggcagggaaggagcgcgggaaggaactcaagaagaaattcttagagaacaccccggcgattgcagcgctacgagaagctatccaacaatctctcgttaagtcttccgcttggattggcggtgagcagaaagtacagtggaagcgccgttggattaaaggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgctgggttggtgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtatgagatagaccacttgtgtctcaaccgtgggtgctgcaacgtagaacacttacagtgcataccgaagcgtgaacacataatcaaaaccaacaaagagcgcagtctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggtctgacacacgggccggaaggtgctgctgcgttctgtatcaagcaaggtctccgtgagtttatccgcgatggtcacagtgagttaagctctaccgagcagaagctgatgagattctcacctgcaaccgtgcgcgaggtgttcaaatgagtgaatacctgaaagttctggcagctatcaaaggttgccctaagtcctttcagtcgaactatgtgcgaaacaatgcggctctcgtagctgaggccgcttctcgtggacacattagctgtttgactgtgggtggtcgaaatggtggagcatgggaggtcacagcctctggtgtgcgcttcctgaaacgaatgggaggttgcgtatgattatgcctaagagtgacaccgtaacgatgacccgtgatgcgtggaacgatgttagcgcgtatattgataagctggagaaagacctagagttcctgaatgcgcttaaggcgtgtggtgtggataattgggacggatactctgatgcagtcgaaatggtttacggggaggatgacgaatgagcctaatcacattgaaagacttcgtggagatgcgtgaaggtaagcctatggagaatggagtgctggtcatggatggtgactggttggtatatcagtcaatggctgctgccgaagttgagacggattggggagatgacatttggactcttgagtgtgaccacgccaaggcacggagcattctcgattctgcaatcgaatcgtaccgaacccgtaagaaggcttggagtgacgctatggttgttctggcgtataccgacgatgtgaactggcgtaaggtactggttgatgagacctataaggagaaccgtaaggcgacccgtaagcctgtgggctaccgtgacttcctgtcgaagttgtgggagcgcgatgagttcattcacatcaaagaggacatgctggaaggtgatgacgttatgggtatcattgggtctggtcacgaggtcttcggcttcaagaaagctgtgttggtctcctgtgataaggacttcaagactatcccggacgttgacttcctgtggtgtaccactggtaacatcttgacgcagaccaaagataccgctgattggtggcatctcttccagaccatcaagggtgatatgactgatggctactcagggattcccggctggggcgatacggcagaagccttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagctgattaccgtcgctgtgctggtaggtatgctggcgcgaggtctctggatgttcgctctcatagtccgagacgttaatcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcaggcctatgtggtggagtccggggagtaccgtgcgctccgcgctgcgggttactctgagtctttcattgctggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgctgaaccagcacctttgactgaacctccgaagtctgtggtatggggaggcgatgatgacgaggacaccagcgtgtcttcctctgaggtgccaacctcaccgagcagcggtaagagcagtctcaaggtaaagctggatgacagcgcagccaagaacaagagtaaatcctccattcgctcaaaggcgtttgggtaactgagtcatagtatagggagaaacatcatgggattcttcaagaaaatcaagaaggctgttaagaaagttgtgaaggaagttagcagaccagtcgagaaggcaggtaaggaagttggtaaggttgttggaggcgcgctgggtgcaggtaagcaggagattatccaacaagaggctccagcaccagtagtagctgcaccgccaccagcacagattgtagacgtacctgaacaggataaggctgagggcgaggatgaggcgcaaaccgagagcgcacgtaagaaggcacgcgctggcggtaagaaagcacttagcgtagctcgcagttccggcggtggaatcaatatctgaggaggactgaatggctgattcaaaacgtacaggattgggcgaagacggtgctaaagctacctatgaccgcctgacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacctatcctactgacgctatgccctacattccggttcgcatggttcgcattgatggcgagtcttacggtcgctcctactgtgaagaatacttaggtgacttaaggtctcttgagaatctccaagaggctatagttaagatgagcatgattagtgcgaaggtcataggtctggtgaatcctgctggcattacgcagccccgtagattaaccaaagctcagactggtgacttcgttcccggtcgccgagaagacattgatttccttcaactggagaagcaagctgactttaccgtagcgaaagctgtgagtgaccagatagaagcacgcttatcgtatgcctttatgttgaactctgcggtacagcgcacaggtgaacgagtgaccgccgaagagattcgatacgttgcgtcagaactggaagatacgcttggtggcgtatattcgattctgtctcaagaactgcaattgcctctggttcgtgtgctcttgaagcaactccaagcaacctcgcagattcctgagctaccgaaagaagccgttgagcctactatcagcacaggtctggaagcaatcgggcgtggtcaagacctcgataagctggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgccgccgccactggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcatacttagcgaggaacctagttcttatgacgatgacccttatgcggctggtgaagacccattcgctgatggtgaagacgatgagggccgcattcaggttcgtatcagtgaagatggtaacgaagctgagttcgacactggtagcgataacgctgaggtggataccgaaggtgaggccgctgagtttgagccgctgggtgacactccagaagaactgagccaagtgactgaacaattaggtaagcacgaagaaggctttcagtcgatggtcgagcaggccgttgagcgtggactgagtgcagagtctgtgactcgtatctacgaagagtacgaagccgatggcatctctgagaaatcctatgcggaactcgaagctgctggatatagccgtgcctttgtggactcctacatctccggtcaggaagcccttgtagaccagtacgtcaatcaggtggttgcctttgctggtggtaaggagcgctttagcgcaatctatacgcaccttgaagcgaccaacccggctgcggctgagtcccttgagactgccatgatgaaccgagacttggcgactgtcaaagcaattatcaatctggctggtgagagttacacgaagaaattcggtaagccagccaaccgtagtgttaccaagcgtgctactccggttaaacctgtagctcgtcagaaagagggctttacgaatcaggctgagatgattaaagctatgagtgacccgcgttaccgtagtgatgctgcctaccgtcaaatggtagaacagaaggttatcgactccagtttctaattaaccctcactaaagggagagaccatagatgactacaatggttgaatcacctgagcacagaactttgtggacgctcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgactgctttcgctcgcacctccgtgaccatgcctcgtcacatgctgcgctctattgcttctggtaagtccgcacagttccctgtgattggtcgcaccaaagccgcttacctgaaaccgggtgagaacctcgatgacaaacgtaaggatatcaaacacaccgagaaggtaatcaacattgatggactgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgactccaatgagaacatcgagggtctcggtaagcctaccgtactgactctggttaagcctaagactggcgacctgactgacccggttgagctgggtaaagcgattatcgctcagttgactatcgctcgtgcgtccctgaccaagaactacgttccggctgctgaccgtaccttctacaccactcctgataactactctgcgattctggccgctctgatgccgaacgctgcaaactatcaggcactgattgaccctgagcgcggtactatccgtaacgtgatgggcttcgaagtggttgaggttccgcacctgaccgctggtggtgctggtgatacccgtgaggatgccccggctgaccagaagcacgctttcccggctacttccagcgctaccattaaggttgctctggataacgttgtgggcctgttccagcaccgctctgcggttggtacggtcaagctgaaagacttggctctggagcgcgctcgtcgtgcgaactatcaggctgaccagattatcgctaagtatgcgatgggtcacggcggtctgcgtccagaagctgctggcgctatcgtgctgccaaagacttcgaaggcttaatggtagcgcctttgagtatgaacgcggagagtgaagtggagccgacccaagaggtagccgccgaagtagctctcacgcctcaacagaaggccgccattactcgtgctcgtaacaaggcacttaagtctcaataacaacaagcaaaccccttgggttccctctttgggagtctgaggggttttttgctttaaaccctcactaacaggaggtaacatcatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtccgtaatggcaaccagcggtcagacccaatatatcaaccgtggtggctatctctatgaccgctctgcgaagactgacagatttccttctggtgttcaggtcaacctgattcgtctgagagagttcgatgagatgcctgagtgcttccgtaactacatcgtcaccaaggcttcacgccagttcaacaaccgattcttcggtgcgccggaggtagacggagtgttgcaggaagaagaacaggaagcgtggcgtgcgtgcttcgagtacgagttagactacggcaactacaacatgcttgatggcgatagtttcgttcagggtctattgacgcgttaatagtaaggaggcacttatgccagcacatagaaaagaaataatcaacgggtgtaaagagtgctctaagtgcctcacagttaaaccgttggaagagtttggtaagtcgagcagaccgggtggtcaatcccaatgcaaagagtgccgtcagtcaggtaagcgcggcaggcctgtaagccccacacaacgtgagtctcaccgggcgtgggtgttgctgaacacctatgggataaccgttgatgattttaacaaaatgcttgaggatcaagcgggtgtttgtaagatatgcggtaagggcccttctggtcgattcaagcacctgtgcgtagaccactgccacacaactggacaggtgagaggactactatgccacgcctgtaacaagtcattagggttccttgaggatgaccctgataggattaaacgtctaatagcttatttaggaggtacacaatgtcactaattagccagtcgattaagaacctcaagggcggtatcagccaacagccagatattctccggttcgctgaacaatgtagcgtacagattaacggttggtcttctgagtccgagggtctccagaagcgcccaccgatgattcaccttaagacccttggcgctgctgggtatgtgggtgcgcaaccttacgtgcatcttatcaaccgcgatgagttcgagcagtatttcgcggtgttcactggtgaagacattaaggtgttcgacctcgatggtaaggagtaccaagtacgtggagaccgctcttatgtacgaacagccaacccacgggaagaccttcggatggtaacggtggctgactatacctttgttactaaccgcaaggtggttgtgcagagtaacgaccaatcggtcaaccttccgggctttaaagaccaaggtgatgcgctgattaatgttcgtggtgggcaatatgggcgtagactctcaatcgagttcaacggggctgagcgtgctgctattcaactaccagacggctcacaaccagcacacgtcaatgaggttgacggtcaggccatcgctgagaagctggcggctcagttgcggaataacctaggtaacccaaacaatgaacaaaacccaaataagtggcgcttcaacgttggccccggattcatccatatccttgcgccaaataacgataacgtttggggactacagactaaggatggttacgcagaccagctaatcaaccctgtaacccactacgctcagtcgttccagaagttgcctattaatgctccagatgggtacattgtgaagattgtaggtgacacctcaaagactgccgaccagtattacgttaggttcgacctcaaccgtaaggtgtgggtagaaacaatcggctggaacacaaggacttacctgcactaccacacgatgccttgggcgctggtacgtgcttctgacgggaactttgacttcaagtaccttgagtggggtgctcgtactgttggagatgatacaactaacccatacccatcgtttaccggacagacaatcaatgatattttcttcttccgtaaccgtttaggcttccttagtggggagaacatcatcttgtctcgcacctcgaaatacttcaacttcttcccggcctccgtgtcaaactactccgacgatgacccaatcgacgttgcggttagccacaaccgggtgtcaaccttgaagtatgccgttccgttctcagaagagttactcctatggtctgaccaagcgcagttcgttctgacagcttctggtatcctttcgagtcgctccgtagagttgaaccttacgactcagttcgacgtgcaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggggtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccctgatggaaagattatagaggtagacccgccaatcaacggttggagcagtgacccggtgttacgacttgatgggaaccaagagggccaagtggtttacattgggttcaacatcccgttcacttatacgttctcgaagttcctcattaagaagactgctgaggacggctcgacggctaccgaggatattggtcgcttacagcttcggcgtgcgtgggtaaactatgaggactctggagcgttcaccatccgtgtgaacaacctgtcccgtgagttcatctacacaatggctggcgctcgtttgggttctgacaatctgcgtgttggtaggtcgaacattggcacagggcagtaccgcttcccggttgttggaaacgctcagacgaacatagtaactatcgagtcagatgcgtcaactccactgaacatcattgggtgcggctgggagggtaactaccttcgtcgttcttcgggcatttaacttaaagtctccctgcggcgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggcaatcagggagaccgagtgtggttccttacctctaagtacgtcccactgtttaacttaaaggagcgcttagagtttcgcaagttaatagtcgaatatcgtgatacgatgctgaaccagtacgagtccatttggaacttcgtatgggtaggcaataagtcacacattcgtttcctaaagacaatcggagcggtattccacaacgagtacactctcgatggtcagttccaactattcacaatctcaaggaggcagcgtgaagagatgtaagaaatgcggagaacttaaggctgtctccgagttctataaggacaagaagagtaaggacggcctacggagtcactgtaagccctgtcactacgtgtattacaagaaggactactcaaaggcgcgagagtttaaccttaagcgactgtacggaattactctggaagaatatgaagcgatgctccttaagcaagatggagtgtgcgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaattgattatgtgttggatggcagcaatcccaatcgccatgatgggtgcccaagctctaagtagccagaacagtgctgacaaggcacgagtggcacagacagaagctggacgccgacaggcaatggagatggtcaaagagatgaatatccaaaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggcaaacagtgtcaccgagaattaccgccgagactacgctagtatctttgcgcaacaattgggacgcactcagtccacagcaagtcaagtagatgcagtgtacaagagcgaggccaagggtaagtctggtctgatgcgtgtactagaccctctgtccattatgggtcaggaagctgcaagtcaatatgcggctggtggatttgacaagaaaggcggcaaccaagcagcacctatcagtgccgccaaaggaaccaagaccgggaggtaataatggctagtaaactaaatagtgttttaggcaatatggcgactcccggtatggaacgactccggggcgtcaaaggtatggactaccgggcagcaaccattcaggctgaacaaccaagggcgagtcttctggactccattagtcgattcgctaaggctggtgccgatatgtatatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagacagggcgtaacgctgcgttcctcgttgacgatgaggttcaacaggccatcaaagagggtcgcttccgtactcgtgaagagatggagcagtatcgtcactcacgcctacaggaacagtcgaagtcgttcgctgagcagttcggcatcaatgagatggatgaggagtaccagaagggtttcaatgcgaacatcaccgagcgtaacattgctctgtatggcgcacatgataccttcctgagtgaccaagcgcagaagggtgctatcctgaactcgaaggttgaactcaacggtgtcctgtctgaccctgacctactgtctcgtcctgagtccggtgagttcttccagaactacattgacaactccttggtgacagggatgaccgacaatcaggctcagcaggttatctcttcgtccttgaatgacgtgctacagcgtccgggtggtgccgccttcttgcagaacattgagaaccgcaaggtaactcttaatggcgctacgactacctatcgtgaactgatgggtgatgaacagtggcaggccatgatgattaaggcacagcacactcaattccagaacgacgcgaagttgactgagaggttccaactgagtatcaactctgcgcttaaccaagaggatactggcaagggatgggaggcgctccaaggtatcaaggcggaactcgacaagattcagcctggagaagaacttacgcctgagcgccagcagctcaatgatgcccaagcgcatatgcagacgcgcttcaaacaagaggccgctgagactgcgaagctgatggacaagcagcgtaagaccctgaataaatctttggtcatcgacaagcagttccagaagagaatcaatggtgagtatgtctcaactgactacaaagatatgccaacaaacgagaacactggagagtttgtccatagtgatatggtgaactacgcgaaccagaagttagcgcagattgacgctatggacattccagaggcgcagaaggatcgcatgaagttgcagtacctccaagctgactctaaagatggtgcattccgcactgctgtaggtcagttggtgtcagatgctcgtggtgagtggaaggcggctgtcatcaatggcgagatgcctgatagcacaccagcccttgactccctacgcaagatgcgcaacattgaccccggattgttcgcagcactgtatcccgacgatgccgagctgtttcacacaatggatcaattggatcgacaggggataaagccgcaagccctcattaacgccaccaaatcccgtcaagggaaaacgcgtgaaatgcagattgaggatgagcgtgcgttcagcgagctgatgaacaactctgagcagcccgaactgaaataccttccggcttccatgcgtgagtacgctcagattatttatgactctgagaagtacctaacaggaaaccctaaggatgccatatcagcggttagttcgttcctaaaggacactacctatacattctcttcggataacgtagatggtggaacctacggtgtaatccctcgcaacatgatgcaggtaacagatgaccctaaatcttgggagcaaggtaaggatatcattgagcaagctgttaagaagtaccaagagcaaaacccttgggttaccaacaaacagcttaaggttagccaacagggtaacttaatcaagatttacgataccactaccaacttgggcataagttatgataacgcactgctacgcaaggtgtataagaactatgctgagcaacaggctgcatcggctgagaagaaagccttaacggaagccaataagcgagcacctatcgtcgcggcaaccaaggcccgtaaagaagcagctaagcgtgtccaagagaaacggaacaaggttcctaagtttatctatggacgtaaagaagactaacagtaaactataaggaggctccatgagctacgacaagacgaaaccatccgagtatgatgggttatttcagaaagcggcagatgaacatggggtctcctatgacctgcttcgtaaattagcattcaacgaatctggcttcaatccgaaagccaaaagccctaccgggccgttgggtatcatgcagttcactaaaggtacggcagcggggcttggactcaaggtgacagggggagatgacgatgagagattcaaccctgagttggctgtggacgcagcagctcgtcacctgagcgacctcgttaggaaatacgacggggatgaacttaaagcggccctagcgtacaaccaaggagagggacgcaatggcgctccacaaatgcaggcttatgaccgaggcgattgggcctctatcagcgaggagggccgcaactacatgcgtaaacttctcgatgttgctaacagcccgcgcaagggagacttggaggcgttcggtgggataaccccaaaggctaaagggattcctgctgaggacgcctttgctggaatcggtaaggccgggaaggtaggaactgagcttccacaatcaactggctttaagctggagggtgtggaacaacaggaacctgccgtaccgttcactaaggatttctacgataaacatggaactaccgttgaggaatatgaaaaccgttcaacattcttcgggataaaggacaccacaagtgccgagcttcataactcgctattgggtgttgccttcaatgctgcgcgttttgatgatagttttgacatcttcaaggacgctattaccccaactcgatggaactcctaccagccgacagctgaggatcttgacaagctccgcaacagtgggcttcctccgagttactactcagtggtgacaggtggtgacggtgataactgggatgacctgattaagatggcgaagagaaactacgagatggacgtgaaggctgctgatgctggtgtgggagcacaattggttggcggaatcgtgggagctggtgttgacccattgagctatgtgccgcttgttggtgttgctggaaagggtctcaaggtggtaaacaaggcgttcgttgttggtgcccaaagtgcagccttgggcgcagtttcagaagctgttcgcacatccgttgctggtggtgaggcgcactatcaagatgcaatccttgggggtcttatgttcggggccgggatgagcgcaatagctgatggagtgagtgcagcattgggccgtgttcgcgctggtcaagttagtaacgacttcgaccgcatggctactcgactggaggcgcgtgagtctgcctttcaagctggtggcgaggacttaacacgtatgccaacagagggtcgtacatttgacggggaacatgcgggtgtaaactactctcaacttgaaactgaaccgggggctgtggtgctgccgcaaggtcaaatcttgagtgacaccaacccgattaaccctcagacacttcatgagttcgagcaggttaaccctgagcgagcggctcgtggtatctctttgggtggattcgctgagatcagcctcaagacccttcggtcggagaatgagactgtgcgctccattgcgagtgaccttgtgcgttctccgacagggatggaatcaggctctaacggtaagttcggtgcgactgcttctgacattaaggagcggctccacgcgaacaatcagcgcacctacaatcagctttatgatgctgtgcgtactgcaatgaaagaccctgagttctctacaggtggtgtgaagatgagccgtaaggaagtacgtcaggaaatctataagcgtgctgccttagcgattgagagaccagagctacaatcgggactcacaaagggagaacgtaaggtgatggatatcctgaaacaacacttcgacctcaagcgagaactcatggaaaaccctgctatcttcggtaacgccaaagctcgtagcatcttccccggctcacgccataacggaacctacgtgcctaatgtgtatgaccgcgccataaagttgtacatggtgagtcgctacggtaacgagggactacaacgggcaattgcagagtcgtggcttacatcttaccgcgctcgtccagaagtcaaggcgagagtcgatgagtacctgatggagcttaacggtctcaagacggtacaggaagtaacaccagatatggttcagaagcacgctatggacaaggcgtatggtatatcgcacactgaccaattcacttcctcctctatcattgatgaaaaccttgagggtctggttggcatcgagaacaataacttcttggaggcccgtaacatgttcgacagcgacatggctgttaccctcccggatggtagcacgttctctgtgaacgacctgcgtaactacgatatggctgacattcttcctgcttatgaccgtcgagttgacggtgacgtggctatcatgggtggttcgggtaagacgacgaaggaactgaaagatgaaatcatggcgctggacaagcagtctgagggtaacggctcactgaaaggtgaagtcgaagcactcaaggacaccgtgaagattctgactggtcgtgcccgcatgaacccagagggagctttcggtacgattcttcgctccatgactgacttggctttcttcgctaagaacttctatatgccgttccagaacttcactgaggttgctgctatgttgagtaaaggaaacacctctgcggtacttcatggaatcccactgcttaacgattgggttagccggaggaagcctatgagcggctctgagattaaggagattcacagtatggtgttcgggaaggaactagaccagcttatgcgtccggggcgcgaagaccatatccgtcgccttcgggagtctactgacactaacgcagtggtggctaatgtggttgggactattcgcttcggaactcaggaattgtctgcgcgctcaccttggacgatgctgcttaatggaacctctaactacatcatcgatgctgccagacagggtgtactgggtgatgtggctggggcagcgctcgctgggaaaggatctaagttcggtaaagcgaattaccttaagtctgcctctgtgtcacctgagcagtggaagggaataaagcagttgttccgtgaccacgccactcgtgatgctgacggtaagtttacaatccgggacaaacaggctttcgccaatgacccacggactatggacttatggcgtctggctgataaggttgctgatgagactatccttaggccgcataaggtttcctcacaggacgccaaggcttacggagcggctgtcaagatggtgatgcagtttaagaacttcgtaatcaagtctcttaactcgcgcttcgtcagattgttttatgacgcgactaagaacaacagggctatcgattctgcgctgactgcaatcatctctatgggtctggctggtggttactatgttgctcaggtgcacttgaaggcttacggcctacaggagcacaagcgtaaggagtacctaaagaatgctcttgaccctaaaatgattgcccacgcgtcattatccagaagttcacaccttggttccccactgtctgtctatgatatgattggtggcttgttcggtaatgatacctaccagtacacccgctcaacggtgttaccaaaggaaaagaccgaacgtgaccgaaacaaggcttggactggtaaggaggttgcgggtaacatagtaggggcgatatccaaccaagtaccagctgtaggactagttgggaatattgggtctaccgccatgaatgcctctacgctacttagctctgatggtaagcagagtgaggtagagttccgtactggtgtgttcaacgccatgcgtgagcttgtccccaatgacccgctgacacaacagttgattatgcacatcttcgaagagcagggcatcaagattaaggatgatgcaacacgccctcgccaataaaccctcactaaagggagagaggtcacattctggcctcttctctcttaatgctaatttacaaaggaggtcacatggctacaaatattaagaccgtgatgacttacccgctggatggctccactacggacttcaatattccgtttgagtatctggcgcgtaagttcgtcagagtgacacttatcggtgttgaccgaaaggaactcatcttgaatcaagactatcgttttgcaactaagaccacaatctccacaacgagagcattggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaatgatggcaaccttgatgctcgtggtcgtcgtatcataaacgtagctgatggtgttgacctcggtgatgttatcactttaggtcaagtcactcggtggaacgagtctgccctgaactctaagaacgccgctgctacctctcaggccgctgcc

SEQ ID NO: 148 - DNA, 40420 bp, Unknown
  source: /note="Description of Unknown: KP2-15-2-1 Bacteriophage Sequence"
acctaaagccaccacctaaagaccagacctaaagccaccacctaaagaccagacctaaagccaccacctaaagaccagacctaaagccatcacctaaagagtgccgctatcttaaagacaaccagaccgatagacccattgttaacctgtagtgatgccttgtagttatctgtagtcatttcataaaccctcactaaagggaataagggatacttaaagagggaataagggatttaataaaaagatttaatttaatggttgactttaagtaacccttaaggctattattcatcacgtcaacgggacaacggccttaaagccactccctgagatactggagtcaaccggataagtagacagcctgataagtcatacgaaaaacaggcattgacaacatgaagtaacatgcagtaagatgtaccacataacgttaaccaccgctctggtgtcttctaggtgacttaagcgcaccacggcacataaagcgaaacaaaaatggttgacaacatgaagtaaacacggtacgatgtaccacatgaaagacaccgagtgtcgtaggtgtaaaaacgcgacatagtggatagatggcgaaagcacaagcgaccacgataataaagagcttgtcgcacttataacgcaagtgacggctaacactgaaatagcctcggctcaacgaaactgtagcctaaagttctttaacaatctggataatagctcttgagtgtaccgatgtataagcgaataactcaaggtcgcactgaaagcgtggcctttatgatattcacttaacacgaactaacatgaggtaacaccaaatgattttcactaaagagcctgctaacgtcttctatgtactggtgtcagcattccgttctaaccttgatgatgaggtgaacatgagtcgccaccgccacatggtgagcgaattacgtgccgcaccgggtatctacggcgagcttgagtctaccgatttgaccgggtgctatcgtgagagtatcgcactggctccaaccgaggaaaagaccatgcgtgtactctgcaagaacaaagagcaggcactacaggtagctcgcttagcttgcaatgagtatgagcaagattgcgtactggtatacaaatcacagactcacacagcgggattggtgtacgctaaaggtatcgacgggtataaggctgaacgcctgccgggtagcttccaagaggttcctaaaggcgcaccactgaaagggtgctttacgattgacgagttcggccgccgctggcaagtacagtaagtgatagactcaaggtcatgcacgatgcgtggcctttatgattatcactttttgactatgaaggaatcacaccatgcgcttaaataaagacacagcggtagctatgcggtcagcaatcgaatcaagagccgcacacaacgtgggagggattgctgatgttgcacgggtttataaggagaaagggcttacattccgcagattcatgtgggactgttatcatgcagtgggctttaaagagactacaagaatcatcgcagagcacaacacggtgacagttatcggcgggcacataacagatatcaatgattcgcacatcgaaactatgctcaaggttgcactgaaagacatagcttattagtaattaactacaggtcgttagctcgtagcggcctgaatgataattactaaacaaacctgagaggatatgactatgaaacaatacgccatccttattcccggctggtgctactcaatgacctgctacgggtacaacgaaagggacgctcgtgccagattcagggatcaacaaggcttcggcaagcgtttacctaatggtacggctgtatgggaggttatgtaatgagtaagttactggcaacctctaaaatcaaaggccaatgcactgtaacgctgcgtgagtattaccacgggtcaatgggatgcacctatgttgtgcgatacggtaaacaggtcacgcactgggtaaaccttgttttggcacaagaggagtaccaagcctgtgtgatacaccaagcaacatgtgcaggctggaacgactgacaacagacttcaagtctatcaggtggtaaactcaaggtcgctccatgcgagtggcctttatgattaacattacgatagaggatgagagtatgggatacgaagacacgaagaacctgataattctctgtatagcaatacccgctgcaatcaactttgtgtacgaggtatggattaagaaatgattatcgcactaatcgcactggtctatctgtgcatcgctatgtactttatgcgagactttaagcgcggtctggcaatacacaaggcaacgctgagttactttaagtggggattcatcccacggtttacggttcgtgaacgtaacggacgctttaaggccaacaaggtgggagtattctacattgctacgcactaactcaaaacacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacaatgactttcaccgaagcacaagccgcactcgaagctatccgcaacctgccgattgaccgcttggatgaacgccagcccatgctggtggctcttgcggctgctatcgtgaacgatgagactcaagacggcgaactgacgcaggccaaaggcaattggggcttggagtctatggactactggcagacactggctgagcgtatgcgtgatgttggatttgtacgcttgggtaacggtcactttagcgcagcatacgagcacgcattgttaccgggcaaggttatcaaggtaggctttaagaaagaggactcaggcgctgcctatgctgccttctgccgcatgaatcagggtcgtgagggtatccctacggtgtacgacattcagcgtcatacaggctgctacacggtggtcttggactatctgacaccgcttaacgattggtgctacggtgaaagcgataagattcgtcaccactttcaggccgcacgggaaatcattgaggaggattgcttcgataccgccgaagagtacccgataagtgacgggttcattgagacctgcaaggatatccgcaagttcttcctaggcattgcatcgttcgattgtcacagcggtaacatgatgaaagaccaaatgggccgattgattatcacagacccggtatcgttcagcgcagacaacaagttaaagccgggtgagtttcactgtgacccggatgaactaatcgctgagattgaggcgctgagggcgcaggaagcgattgaccgctgtaaggcacgcaaggcacgccgtgaccctaaaggagactttcaggcagcacgtaaagcccgtgccaaatggcgcagaaaggcctctaagcgtgctaaacgtgacgctaaggtaatcgctaagatgcgcatggatgacaacgagcaacgcagggccgagccgagggcgcgcatgttgtggggcgataagcactggcgtaacgcttgggtgcagcacatgaatgttgacttcgcacggctcgaactgttagcagccgcacagatggcacagatagaccacaaggctatcgtatggggcaagccgttacacatagacgcataccttgacaagagactgcaaggttgatagagtcttttcttacaggtcatcatgaggtggcctgaataggaacgatttatccatagtgaggcaagcaatgaacatcatcgaaactatcgaaaagaatgacttctctgaaatcgaactggctgctatcccgttcaacacgctggcagaccactacggcagcgcactggctcgtgaacaactggctttagagcacgagtcttatgagttaggtgagcgccgcttcctcaagatgctggagcgtcaagcgaaagctggtgagattgcagacaacgcagccgctaagccgttactcgctacgcttctccctaagttaaccgcacgcatcgttgagtggctcgaagagtacgcctctaagaaaggccgcaagcctagcgcatacgcgccgctccagttactcaagccggaagcctccgcgtttatcaccctgaaagttatccttgcatcactgaccagcacgaacatgacaaccattcaggccgctgctggtatgttggggaaggccattgaggatgaggcacgtttcgggcgtatccgtgacctcgaagcgaagcacttcaagaagcacgttgaggaacagcttaacaagcgccacgggcaagtctacaagaaagcctttatgcaggtggttgaggcagatatgattggtcgcgggctgctgggaggcgaggcgtggtctagctgggacaaggaaaccacgatgcacgtagggattcgactgattgaaatgctcattgagtccacgggtctggtggaattgcagcgccacaacgcaggtaacgcaggctctgaccatgaggcactgcaactggcccaagagtacgtcgatgtgttagcgaagcgtgcaggagcactggcgggtatctctccgatgttccagccgtgtgtcgtaccgccgaaaccttgggtggcaatcaccgggggcggctattgggctaacggtcgcagacctttggcactcgttcgcactcactctaagaagggactgatgcgctatgaggatgtttacatgccagaagtttacaaggcggtcaacatcgcacagaacaccgcatggaaaatcaacaagaaagttcttgcggttgtcaatgaaattgttaactggaagaattgcccggtagcagacattccatcactggagcgccaagagttaccgcctaagccggacgacattgacaccaacgaggcagcgctcaaggagtggaagaaagccgccgctggtatctaccgcttggacaaggcacgagtgtctcgccgtatcagcttagagttcatgctggagcaggccaacaagtttgcaaacaagaaagcaatctggttcccttacaacatggactggcgcggtcgtgtgtacgctgtgccgatgttcaacccgcaaggcaacgacatgacgaaaggtctgctgaccctcgctaaaggcaagccaatcggtgaggaagggttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcacctttctgtttcctcgcgttctgcttcgagtatgcaggagttgcgcaccacggtcttagctacaattgctctctgccgctggcgttcgatgggtcttgctctggtatccagcacttctccgcgatgctacgcgatgaggtaggcggtcgtgcggttaaccttctgccaagcgaaaccgtgcaggacatttacggcatcgttgcacagaaagtaaacgagattctcaaacaggatgcaatcaacggcacgcctaacgagatgattaccgtgaccgacaaggacaccggggaaatctcagagaagctcaagctgggaacctcaacgctggcgcaacagtggctggcatatggtgtaacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgctaagctgctggctgctgaggtcaaggacaagaagaccaaggagattctgcgccaccgttgcgcggttcactggactacgcctgacggcttcccggtctggcaggaataccgcaagccactccagaagcgtcttgatatgattttcttagggcaattccgtctgcaaccgacgattaataccctcaaggattcaggcattgacgcacacaagcaggagtctggcatcgctcctaactttgttcactcacaggacggtagccacctacgcatgacagtcgtttatgctcacgagaagtatggcattgagtcctttgcgctcatccatgacagctttgggactattccggcagacgctggtaagctctttaaggctgtgcgtgaaacgatggttctcacctacgagaacaacgatgtgctggcagacttctatgaccagtttgcagaccagctacacgagacacaactggacaagatgcctccgcttccgaagaaagggaacctgaacctgcaagacattctcaagtctgactttgcctttgcataacaagcacttagcattaaccctcactaacgggagactacttaaggtctcccactttaagacactttaggtactaagagattaaatttatgattaacattaagactttccttaagaacatctttaagttaaaccgcttgacttccgttaagttctacgcttggatgcccggtagtgatgacctccgcaagactgaatttaagttaggcttaggccgtgcggtaaggtggtcacgaagttggaatgttactcaacggcctccgggatggtcatcttccagaccactgaggacaacgaaatgaaatccttctactacccgaaaggttcaacatgtggtcgtatcgaacgggcatacagttaaccctcactaacgggagagttaaacttaaggtcatcaccagcggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaactccacaagcaacagcgcggtaactcacagaaacgggagtggaactaatgatgggacgtatctatagcggcaacctgaacgattacaaagatgcggtagagcgtctacaggaagaccatgacgtgaccgtgaaggtggagtcattcagttatgaaaacccagcgaagatgtgcaggtcatccggtgaggttctccgtgtgttcacacgctccgggcatctggtggcatccagaaccttcgagcacagcgacagcgatgtacaaatcaacgcgcagactgcacggctccgtaaggttcacagcgatttgaaacactggaagtaataaccctcactaaagggagaacgaaaggaggaaacattatgagaatttcatttgacttaatgagtccttcctttctctcatgggatacgggtcgtcacactggcggctctattcgaaacggctatagaagggttcgttatgaaggtaagtggttaaaccatcacatactcatttgggaacacttcaacggtgcagtcccggagggaatggaagtagaccacattgaccgtaacaaacttaacaacgcgcctagtaaccttagacttgtgacccgctctgagaacaacagaaatcggtcagtacaccggaacaacaagtcaggaatcaaaggtgtctactggcacaaacaccgacaagtttggtacggtcagtgtcgaagaggaaacaaaacatttatcaccgctggttgctccacgaaggaacaggcggcagaacttttagagaaactcaaagaggaaattaattatgatgattttcaaaaccgtcccgtataaggctgtgtcattcgtagagtctgccgttaagaaagcgctggagacctccggctacctaatggctgatatcaaatatgatggtgtgcgcggtaacattgtggttgacaacgtggctgaggccgcatggttgtctcgcgtatccaagttcatcccggcgctggaacacctgaacggtttcgataagcgctggcagcaactactgaacgatgaccgctgcatcttcccggatggcttcatgctggatggtgaactgatggtcaaaggcgtagacttcaacacggggtctggcctactgagaaccaagtggctcaagaagaacaacttcatgtttgaccgtggtggtgttgagccgctgaaaggttccaaagtagcctttgagttggacactaagcgcctgagcgtgcgcctgtatgcggtcatgccgattcacattgcggagtctggcgaggactacgatgtacagaacctgctgatgccgtatcatgtggaagccatgcgcgctcttctggttgaatacttcccggaaatcgagtggcttatcgctgagacctacgaggtctacgatatggattcgctgactgaactgtacgaagagaagcgtgccgaaggtcacgagggtctcattgtgaaagacccacaaggcatctacaagcgaggcaagaagtctggctggtggaagctcaagcctgagtgtgaagctgatggtatcattcagggtgtcaattggggaaccgaaggtttagccaacgagggcaaagtgattggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaaccctcaagagaaaatgtaaccaactcactggctcaccttaacgggtgggcctttcttcgttctagggaattaaccctcactaacaggagacacaccatgtggcttatcctattcgctatcgtcgcaacgcttggattaatggctgccgacgacaacatttggcctgattgttaaggagacaacatcatgcgtttacacttcaacacatcaaatggtatcttttcggttcgccgtgaagaccgctctacagcagtggcctctgagcgcaacgccaagctgccgctgattggttcggtcgtcccattgtcgccgcgtgttcacctactgatcactcgtggagagttcattaaggcgatgaacaaagagcgcccgcatctggaagccgtggtcacttactggcctcgcatccgtctgttcgttaagtggattaaggaggttctgtaatgctacaacatcattggaacaaaccagacttagaggctcgcttcccggttaactctgctgtgcgatactccggcgacttcctcaagcgcttcttaggcatgagcggagtggtcactggtcactcgaacacaggtcgcgttaaggttcgcttcggtaatcagcacgctgagtttcttcctgacaacctgattccgctgcctaaagctgacgttaagactccgaacgtggaagcaccgaaggcagaattcaagtctgacgtgacccacccgaaccattacatgctgttcgacaacgtggaagccattgaggttatcgcccggtcaatgaccgtcgaggcgttccgtgggtactgccttgggaatattttgaagtaccgcctgcgtgctggcaagaaatctgaactggcaactatggagaaagaccttaagaaagcggctttctatcaggaactgtttgataaacataaggggctgtgttatgacgcttcgtgaatgctgcgattggtgtgccgctaagtggaaccaagctattgaggatggtgataaggcggctgctgacgcttaccaacaattgtacgcgctgtgggagcggcgctttaaggaggctcaaagtggagcaacgtgaacagaaatacctcctgacgatagaaggcaacaccgagtcctttgaggttccggtattcgcccggtctctcgaagaggcaacgctacaggctgaacattatgaggacgctgggttcgtagtgactcgcatccgtccagaagtgaaagcctaattaccctcactaaagggaacaacccaatcattaaccacaaaggagaaacattatggctggtttcaagaagaaaatctacacctctggtcttggcactgctgagccttatgcttacctgagtaagccggattatggcaacgaagagcgtggcttcggcaaccctcgtggtatctataaggtagacctgactctttccaataaagacccgcgctgtcaggcaatggtcgatgaaatcgtgaagactcacgaagaggcttatgctgctgccgtggaagagttcgaggctaaccctccgcaggcacagcgtggtaagaaaccgctgaaaccttacgagggcgacatgccgttcttcgataacggtgacggtacgactaccttcaagttcaaatgctatgcgtctttccaagacaagaagaccaaagagaccaaacacatcaatctggtagtggtcgatagcaaaggtaagaagattcaggacgttccgattatcggtggtggctctaagctgaaagtgaaatactctctggtgccttacaaatggaacaccgctgtgggcgcaagcgtcaagctgcaacttgagtccgtgatgctggtcgaactggctaccttcggtggtggcggtgaagatgagtgggccgatgaagtcgaagacggtggttacactgcgagtgaatcccgtcagtcccgcgatgagcaggagtggcaggaagacgagcacgaagaaaccccggatgaggatgaggatttttaaatggaacttaaagagaaactaaaggcttacagcgaagtttctcataacgggtgctgggagtggcaacgctaccggatgccctgtggttacggtaggattagacacggaggccgaatggaactaacgcatcgtctatcctacctagcattcaacggggatatacctgagggtcttgttgttcgccataagtgtgacaacaaatgctgcgttaaccctgagcaccttacgctaggtactcaaaaggacaacgttaaggatgcaatagaccgtggtcaattcgtctacagggagaacccgaaaggcgcaaagcaccacatggctaaacttaatgagaaacaggttatggaggtttacaactcgacacagacccaaagcagcctagcagagacctatggtgtatctcgacaattaatcagcgcgattaagagaggtaaactatggcagcacgttacgcagcacgtggagttaaacgagtagggtcatatagaagcggcttagagcagaagaacatggagatgctggaacgtaagggaatcaagggacagtatgaaatgtggtctattccctatgttgtccctgcatcgaaccacaagtacacaccagacataatcctacccaacggaatcattattgagaccaagggtctatgggatagtgaagaccgtaagaaacacttactgattcgtgagcagatgcctgagttggacattcgtttggtattctcttcgagccgctctaagttatacaaagggtctccaaccagttacggtgagtgggccgaaaagcatggtattctatttgctgacaagctgattcctgtggagtggcttaaagaacctaagaaggagataccgtgggataaactaattgcaaagaaaggagttaagaaataatggctaaggtacaattcaaaacgcgcgcttctacggaagcaatctttgtgcactgtagtgcaaccaagccaagccagaacattggcgttcgtgagattcgtcagtggcacaaagagcagggctggttagacgtaggatatcacttcatcatcaagcgtgatggcactgtggaagcaggccgcgatgaactggctgtaggttcccacgttaaagattacaaccacaactccgtaggcgtatgcctcgttggtgggattgatgataaaggcaagttcgacgccaactttacacctgcgcaaatgcaagcgctgcgtagtctactggtcacgctgctggcgaagtatgagggttcagtccttcgtgctcaccatgacgttgcacccaaagcctgcccgtccttcgacttgaagcgctggtgggagaagaacgaactggttacatctgaccgagggtgatgccatgaggatgatttgtattcgctgtgataaaccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacaaagagcgtgaagcaaagttatcaacgagaagacgcacaggaggcagtaagcctatgagctatgacgtatggaatttcggcgacagcaacggtcgatactctgacctgactgcccgtggcatctcgaaggagacatgccaaaaggctggctactggctggcgaaagtggacaaccgaatgtatcaggttgccgactaccgagaccagaatggctccatcgtgtcgcagaaggtgcgcgataaggacaagaactttaagaccaccggaagccacaagagcgatgcattgttcttgaagcacctctggtctggcggtaagaaaattgtggtcacggagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgatatggatgatgcaggccgtaaggcagttgaagaggccgcacaggttctcccggctggcaaggttcgtgttgccgtgttaccgtgtaaggacgccaatgagtgtcacatcatgggtgaagacaaagcaatcttggagcagatctggaacgcgaacccttgggtgcctgacggtgttgtttccgcgttatcactcaaagaccgcgttaaggaagctatgacctccgagtacgctgtaggtttattatttgatggctgtcaaggcctgaacgatagaaccttgggtgcccgtggaggcgaagtcatcatggtcacttccggttcaggtatgggtaagtcaacgttcgttcgtcaacaggctctgacttggggcaagcgaatgggtaaacgtgttggcctagcgatgctggaggaatccgttgaggataccattcaggacatgatgggcttgaacaataaggttcgtctgcgtcagtctgatgaagtcaagaaggctatcgcggaggacggacgtttcgatgaatggtatgatgaactatttggagacgatacgttccacctttatgactcctttgcggaggccgaagctgacaggctgttagcaaagctggcctacatgcgaacaggcttagggtgtgatgttatagtgctagaccacatctcaatcgtcgtgtctgcctctgaggaatcggatgagcgtaagatgattgaccgcctcatgactaagctaaaagggttcgctaagtcaactggtgttgtgctcgtagtgatttgtcacttgaagaacccggagaaggggaaagcgcatgaagaaggacgcgctgtgtctattactgacctacgtggtagcggtgccttgcgtcagttatctgatactatcatcgccttggagcgtaaccagcaaggtgatatgcctaacttggtgttggttcgcctgcttaagtgtcgtttcactggcgacactggaattgctggatacatggagtacaacagagaaaccgggtggcttgaaccgtctagctacactggcgaagaaggagaaggagatactggctggactgaacaagacggacagtcagacttctaaaggatgcccgtgtgggcattccgattgcgatggaatcatgtaccactaattaaccctcactaacgggaacaacctcaaaccataggagacacaccatgtttaaattcattaacactttaggcaagctggtagtaaaactgtacttcatcgaagccaagaagctggacaagaaggccaaagctgattcacagcgagccattgagttggcgaaacagtcccgcgagaaatccgatgcggctgttagtggcatccacaagtcggcagcgattgcagccaaagcacagtccatgagcaaattctttgagtaaggatcgaacactatgagcaagtcaatcactcacgcaaacaccatccgtctgccagacaccgccgaccagttctcccgccgagtacacatcaatgtgcgcggcgagaaggtcacgatggtctaccgctggaaagaccacaagtctccgaaagcacacactcaacgaatgaccttggatgacaagcaggtcggtcgcttgatgggtgcccttactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccccgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagagtatgttgatggtgctgagtgggtttcgttcaacgagccgatgatggcgtataacgttcaagacgttgttgtcactgtcaagctcttagagaaattccttacagacctccactacttccctgctggtatggacttcacgaagtacgatgcggatttattctggcgtgaagctggcgagtctgtggatattgaacatcgtgcagcgtggctgttagcgaagcaggagcgtaacggcttcccgttcaacacacaggccattgaggaactttatgtagaactggcagcgaaacgcgccgaacttctgcgaaagttaaccgaaacgtttggctcgtggtatcaaccgaaaggtggtaaggaactcttcaagcacccacgtacaggcaagccactgccgagttatcctcgcgtggtctatccgaaacagggtagcgtgtacaagaagcctcgtaataaggcacagcgcgaaggtcttgaaccttgcgacttggacacgagggactacatggagggtgctccgtatactccggtagagttcgttacgttcaagccaagtagccgtgaccacattcagaagaaactacaggaggccggatgggttcctgagaagttcaccgagaagggtgcgcctgtggtggacgatgaggtcttggagcatgtacgagtagatgaccctgagaagcaggcgtgcattgacttgattaaagagtacctgatgattcagaagcgtatcggtcaggcggcagaaggagacaaagcgtggttacgttatgttcaagatgacggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggtgcaagcagggatagacgccagtggcttagagttgcgctgtctggcacacttcatggctcgattcgacaacggagagtatgcgaatgagattctcaacggtgacattcacaccaagaaccagaacgctgcggaactcccaacgcgagacaacgccaagaccttcatttacgggttcctttacggagccggagatgagaagattggtcagattgttggggcagggaaggagcgcgggaaggaactcaagaagaaattcttagagaacaccccggcgattgcagcgctacgagaagctatccaacaatctctcgttaagtcttccgcttggattggcggtgagcagaaagtacagtggaagcgccgttggattaaaggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgctgggttggtgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtatgagatagaccacttgtgtctcaaccgtgggtgctgcaacgtagaacacttacagtgcataccgaagcgtgaacacataatcaaaaccaacaaagagcgcagtctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggtctgacacacgggccggaaggtgctgctgcgttctgtatcaagcaaggtctccgtgagtttatccgcgatggtcacagtgagttaagctctaccgagcagaagctgatgagattctcacctgcaaccgtgcgcgaggtgttcaaatgagtgaatacctgaaagttctggcagctatcaaaggttgccctaagtcctttcagtcgaactatgtgcgaaacaatgcggctctcgtagctgaggccgcttctcgtggacacattagctgtttgactgtgggtggtcgaaatggtggagcatgggaggtcacagcctctggtgtgcgcttcctgaaacgaatgggaggttgcgtatgattatgcctaagagtgacaccgtaacgatgacccgtgatgcgtggaacgatgttagcgcgtatattgataagctggagaaagacctagagttcctgaatgcgcttaaggcgtgtggtgtggataattgggacggatactctgatgcagtcgaaatggtttacggggaggatgacgaatgagcctaatcacattgaaagacttcgtggagatgcgtgaaggtaagcctatggagaatggagtgctggtcatggatggtgactggttggtatatcagtcaatggctgctgccgaagttgagacggattggggagatgacatttggactcttgagtgtgaccacgccaaggcacggagcattctcgattctgcaatcgaatcgtaccgaacccgtaagaaggcttggagtgacgctatggttgttctggcgtataccgacgatgtgaactggcgtaaggtactggttgatgagacctataaggagaaccgtaaggcgacccgtaagcctgtgggctaccgtgacttcctgtcgaagttgtgggagcgcgatgagttcattcacatcaaagaggacatgctggaaggtgatgacgttatgggtatcattgggtctggtcacgaggtcttcggcttcaagaaagctgtgttggtctcctgtgataaggacttcaagactatcccggacgttgacttcctgtggtgtaccactggtaacatcttgacgcagaccaaagataccgctgattggtggcatctcttccagaccatcaagggtgatatgactgatggctactcagggattcccggctggggcgatacggcagaagccttcctgaatgacccgttcattgtggagcctgtagagtccgtgttgaagtctggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagctgattaccgtcgctgtgctggtaggtatgctggcgcgaggtctctggatgttcgctctcatagtccgagacgttaatcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcaggcctatgtggtggagtccggggagtaccgtgcgctccgcgctgcgggttactctgagtctttcattgctggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgctgaaccagcacctttgactgaacctccgaagtctgtggtatggggaggcgatgatgacgaggacaccagcgtgtcttcctctgaggtgccaacctcaccgagcagcggtaagagcagtctcaaggtaaagctggatgacagcgcagccaagaacaagagtaaatcctccattcgctcaaaggcgtttgggtaactgagtcatagtatagggagaaacatcatgggattcttcaagaaaatcaagaaggctgttaagaaagttgtgaaggaagttagcagaccagtcgagaaggcaggtaaggaagttggtaaggttgttggaggcgcgctgggtgcaggtaagcaggagattatccaacaagaggctccagcaccagtagtagctgcaccgccaccagcacagattgtagacgtacctgaacaggataaggctgagggcgaggatgaggcgcaaaccgagagcgcacgtaagaaggcacgcgctggcggtaagaaagcacttagcgtagctcgcagttccggcggtggaatcaatatctgaggaggactgaatggctgattcaaaacgtacaggattgggcgaagacggtgctaaagctacctatgaccgcctgacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatcgtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtgtacacccatgtgtatctcgatgaagagtccggcgattacctcaagtacgaggaagtagaggacgttgagattgatggctccgatgccacctatcctactgacgctatgccctacattccggttcgcatggttcgcattgatggcgagtcttacggtcgctcctactgtgaagaatacttaggtgacttaaggtctcttgagaatctccaagaggctatagttaagatgagcatgattagtgcgaaggtcataggtctggtgaatcctgctggcattacgcagccccgtagattaaccaaagctcagactggtgacttcgttcccggtcgccgagaagacattgatttccttcaactggagaagcaagctgactttaccgtagcgaaagctgtgagtgaccagatagaagcacgcttatcgtatgcctttatgttgaactctgcggtacagcgcacaggtgaacgagtgaccgccgaagagattcgatacgttgcgtcagaactggaagatacgcttggtggcgtatattcgattctgtctcaagaactgcaattgcctctggttcgtgtgctcttgaagcaactccaagcaacctcgcagattcctgagctaccgaaagaagccgttgagcctactatcagcacaggtctggaagcaatcgggcgtggtcaagacctcgataagctggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgcggcccaaacaggtatcgagaacgccgccgccactggtggggctggtgttggtgctctagcgacctcaagtccagaagctatgcagggtgcagcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagtacacctactgaacacgaacagaatatgctgagtctcgatgttgctgcccgtgatggcgatgatgcaatcatacttagcgaggaacctagttcttatgacgatgacccttatgcggctggtgaagacccattcgctgatggtgaagacgatgagggccgcattcaggttcgtatcagtgaagatggtaacgaagctgagttcgacactggtagcgataacgctgaggtggataccgaaggtgaggccgctgagtttgagccgctgggtgacactccagaagaactgagccaagtgactgaacaattaggtaagcacgaagaaggctttcagtcgatggtcgagcaggccgttgagcgtggactgagtgcagagtctgtgactcgtatctacgaagagtacgaagccgatggcatctctgagaaatcctatgcggaactcgaagctgctggatatagccgtgcctttgtggactcctacatctccggtcaggaagcccttgtagaccagtacgtcaatcaggtggttgcctttgctggtggtaaggagcgctttagcgcaatctatacgcaccttgaagcgaccaacccggctgcggctgagtcccttgagactgccatgatgaaccgagacttggcgactgtcaaagcaattatcaatctggctggtgagagttacacgaagaaattcggtaagccagccaaccgtagtgttaccaagcgtgctactccggttaaacctgtagctcgtcagaaagagggctttacgaatcaggctgagatgattaaagctatgagtgacccgcgttaccgtagtgatgctgcctaccgtcaaatggtagaacagaaggttatcgactccagtttctaattaaccctcactaaagggagagaccatagatgactacaatggttgaatcacctgagcacagaactttgtggacgctcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgactgctttcgctcgcacctccgtgaccatgcctcgtcacatgctgcgctctattgcttctggtaagtccgcacagttccctgtgattggtcgcaccaaagccgcttacctgaaaccgggtgagaacctcgatgacaaacgtaaggatatcaaacacaccgagaaggtaatcaacattgatggactgctgactgcggacgtgctgatttacgacattgaggacgcgatgaaccactatgacgttcgcgctgagtacaccgcacagttgggtgaatctctggcgatggcggctgacggtgctgtgctggctgaactggctggtctggttaacctgcctgacgactccaatgagaacatcgagggtctcggtaagcctaccgtactgactctggttaagcctaagactggcgacctgactgacccggttgagctgggtaaagcgattatcgctcagttgactatcgctcgtgcgtccctgaccaagaactacgttccggctgctgaccgtaccttctacaccactcctgataactactctgcgattctggccgctctgatgccgaacgctgcaaactatcaggcactgattgaccctgagcgcggtactatccgtaacgtgatgggcttcgaagtggttgaggttccgcacctgaccgctggtggtgctggtgatacccgtgaggatgccccggctgaccagaagcacgctttcccggctacttccagcgctaccattaaggttgctctggataacgttgtgggcctgttccagcaccgctctgcggttggtacggtcaagctgaaagacttggctctggagcgcgctcgtcgtgcgaactatcaggctgaccagattatcgctaagtatgcgatgggtcacggcggtctgcgtccagaagctgctggcgctatcgtgctgccaaagacttcgaaggcttaatggtagcgcctttgagtatgaacgcggagagtgaagtggagccgacccaagaggtagccgccgaagtagctctcacgcctcaacagaaggccgccattactcgtgctcgtaacaaggcacttaagtctcaataacaacaagcaaaccccttgggttccctctttgggagtctgaggggttttttgctttaaaccctcactaacaggaggtaacatcatgcgctcttatgagatgaacattgagaccgcagaagagctatcagccgtcaacgacattctggcttccatcggtgagccaccagtatcaacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtccgtaatggcaaccagcggtcagacccaatatatcaaccgtggtggctatctctatgaccgctctgcgaagactgacagatttccttctggtgttcaggtcaacctgattcgtctgagagagttcgatgagatgcctgagtgcttccgtaactacatcgtcaccaaggcttcacgccagttcaacaaccgattcttcggtgcgccggaggtagacggagtgttgcaggaagaagaacaggaagcgtggcgtgcgtgcttcgagtacgagttagactacggcaactacaacatgcttgatggcgatagtttcgttcagggtctattgacgcgttaatagtaaggaggcacttatgccagcacatagaaaagaaataatcaacgggtgtaaagagtgctctaagtgcctcacagttaaaccgttggaagagtttggtaagtcgagcagaccgggtggtcaatcccaatgcaaagagtgccgtcagtcaggtaagcgcggcaggcctgtaagccccacacaacgtgagtctcaccgggcgtgggtgttgctgaacacctatgggataaccgttgatgattttaacaaaatgcttgaggatcaagcgggtgtttgtaagatatgcggtaagggcccttctggtcgattcaagcacctgtgcgtagaccactgccacacaactggacaggtgagaggactactatgccacgcctgtaacaagtcattagggttccttgaggatgaccctgataggattaaacgtctaatagcttatttaggaggtacacaatgtcactaattagccagtcgattaagaacctcaagggcggtatcagccaacagccagatattctccggttcgctgaacaatgtagcgtacagattaacggttggtcttctgagtccgagggtctccagaagcgcccaccgatgattcaccttaagacccttggcgctgctgggtatgtgggtgcgcaaccttacgtgcatcttatcaaccgcgatgagttcgagcagtatttcgcggtgttcactggtgaagacattaaggtgttcgacctcgatggtaaggagtaccaagtacgtggagaccgctcttatgtacgaacagccaacccacgggaagaccttcggatggtaacggtggctgactatacctttgttactaaccgcaaggtggttgtgcagagtaacgaccaatcggtcaaccttccgggctttaaagaccaaggtgatgcgctgattaatgttcgtggtgggcaatatgggcgtagactctcaatcgagttcaacggggctgagcgtgctgctattcaactaccagacggctcacaaccagcacacgtcaatgaggttgacggtcaggccatcgctgagaagctggcggctcagttgcggaataacctaggtaacccaaacaatgaacaaaacccaaataagtggcgcttcaacgttggccccggattcatccatatccttgcgccaaataacgataacgtttggggactacagactaaggatggttacgcagaccagctaatcaaccctgtaacccactacgctcagtcgttccagaagttgcctattaatgctccagatgggtacattgtgaagattgtaggtgacacctcaaagactgccgaccagtattacgttaggttcgacctcaaccgtaaggtgtgggtagaaacaatcggctggaacacaaggacttacctgcactaccacacgatgccttgggcgctggtacgtgcttctgacgggaactttgacttcaagtaccttgagtggggtgctcgtactgttggagatgatacaactaacccatacccatcgtttaccggacagacaatcaatgatattttcttcttccgtaaccgtttaggcttccttagtggggagaacatcatcttgtctcgcacctcgaaatacttcaacttcttcccggcctccgtgtcaaactactccgacgatgacccaatcgacgttgcggttagccacaaccgggtgtcaaccttgaagtatgccgttccgttctcagaagagttactcctatggtctgaccaagcgcagttcgttctgacagcttctggtatcctttcgagtcgctccgtagagttgaaccttacgactcagttcgacgtgcaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggggtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaatgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccctgatggaaagattatagaggtagacccgccaatcaacggttggagcagtgacccggtgttacgacttgatgggaaccaagagggccaagtggtttacattgggttcaacatcccgttcacttatacgttctcgaagttcctcattaagaagactgctgaggacggctcgacggctaccgaggatattggtcgcttacagcttcggcgtgcgtgggtaaactatgaggactctggagcgttcaccatccgtgtgaacaacctgtcccgtgagttcatctacacaatggctggcgctcgtttgggttctgacaatctgcgtgttggtaggtcgaacattggcacagggcagtaccgcttcccggttgttggaaacgctcagacgaacatagtaactatcgagtcagatgcgtcaactccactgaacatcattgggtgcggctgggagggtaactaccttcgtcgttcttcgggcatttaacttaaagtctccctgcggcgaattaaccctcactaaagggagacactaatagatacgaggggttaaagcattatgtacattacaaagtgtttacaaatccatgccgacaactttcagccgtccatagaggacattctggaagctgaggcactaggtgttgaaccaaaggtaattcctgatgagaacactgtggcaatgcttagcgataacgctgtgttggcaattggtggcaatcagggagaccgagtgtggttccttacctctaagtacgtcccactgtttaacttaaaggagcgcttagagtttcgcaagttaatagtcgaatatcgtgatacgatgctgaaccagtacgagtccatttggaacttcgtatgggtaggcaataagtcacacattcgtttcctaaagacaatcggagcggtattccacaacgagtacactctcgatggtcagttccaactattcacaatctcaaggaggcagcgtgaagagatgtaagaaatgcggagaacttaaggctgtctccgagttctataaggacaagaagagtaaggacggcctacggagtcactgtaagccctgtcactacgtgtattacaagaaggactactcaaaggcgcgagagtttaaccttaagcgactgtacggaattactctggaagaatatgaagcgatgctccttaagcaagatggagtgtgcgctatctgcggtcttaccgagagagttgagggacgggcgttagcggttgaccattgccacgccactggcgctgttcgtggtctcctttgctctgcctgtaacatcgctcttgggaagttcgaggacgacaccgagcgtcttcggaaggcaataacatacctaggagggaattgattatgtgttggatggcagcaatcccaatcgccatgatgggtgcccaagctctaagtagccagaacagtgctgacaaggcacgagtggcacagacagaagctggacgccgacaggcaatggagatggtcaaagagatgaatatccaaaatgccaacgcctcgctggaacaacgggacgcccttgaagctgcatcctctgagttgacttcacgtaacatgcagaaggtacaagctatgggaaccatccgtgcagctatcggcgagagtatgctagaaggcgaatccatgaagcgcatcaagcgtatcgaagagggcaactacattcgggaggcaaacagtgtcaccgagaattaccgccgagactacgctagtatctttgcgcaacaattgggacgcactcagtccacagcaagtcaagtagatgcagtgtacaagagcgaggccaagggtaagtctggtctgatgcgtgtactagaccctctgtccattatgggtcaggaagctgcaagtcaatatgcggctggtggatttgacaagaaaggcggcaaccaagcagcacctatcagtgccgccaaaggaaccaagaccgggaggtaataatggctagtaaactaaatagtgttttaggcaatatggcgactcccggtatggaacgactccggggcgtcaaaggtatggactaccgggcagcaaccattcaggctgaacaaccaagggcgagtcttctggactccattagtcgattcgctaaggctggtgccgatatgtatatggcgaaagatgaacgtgataagcaacgagccgatgagcgctccaacgagattatccgtaagctgacccctgagcagcgccgacaggctatccagaatggtacactgctgtatcaggatgacccatacgcaatgcaagccttgaagttcaagacagggcgtaacgctgcgttcctcgttgacgatgaggttcaacaggccatcaaagagggtcgcttccgtactcgtgaagagatggagcagtatcgtcactcacgcctacaggaacagtcgaagtcgttcgctgagcagttcggcatcaatgagatggatgaggagtaccagaagggtttcaatgcgaacatcaccgagcgtaacattgctctgtatggcgcacatgataccttcctgagtgaccaagcgcagaagggtgctatcctgaactcgaaggttgaactcaacggtgtcctgtctgaccctgacctactgtctcgtcctgagtccggtgagttcttccagaactacattgacaactccttggtgacagggatgaccgacaatcaggctcagcaggttatctcttcgtccttgaatgacgtgctacagcgtccgggtggtgccgccttcttgcagaacattgagaaccgcaaggtaactcttaatggcgctacgactacctatcgtgaactgatgggtgatgaacagtggcaggccatgatgattaaggcacagcacactcaattccagaacgacgcgaagttgactgagaggttccaactgagtatcaactctgcgcttaaccaagaggatactggcaagggatgggaggcgctccaaggtatcaaggcggaactcgacaagattcagcctggagaagaacttacgcctgagcgccagcagctcaatgatgcccaagcgcatatgcagacgcgcttcaaacaagaggccgctgagactgcgaagctgatggacaagcagcgtaagaccctgaataaatctttggtcatcgacaagcagttccagaagagaatcaatggtgagtatgtctcaactgactacaaagatatgccaacaaacgagaacactggagagtttgtccatagtgatatggtgaactacgcgaaccagaagttagcgcagattgacgctatggacattccagaggcgcagaaggatcgcatgaagttgcagtacctccaagctgactctaaagatggtgcattccgcactgctgtaggtcagttggtgtcagatgctcgtggtgagtggaaggcggctgtcatcaatggcgagatgcctgatagcacaccagcccttgactccctacgcaagatgcgcaacattgaccccggattgttcgcagcactgtatcccgacgatgccgagctgtttcacacaatggatcaattggatcgacaggggataaagccgcaagccctcattaacgccaccaaatcccgtcaagggaaaacgcgtgaaatgcagattgaggatgagcgtgcgttcagcgagctgatgaacaactctgagcagcccgaactgaaataccttccggcttccatgcgtgagtacgctcagattatttatgactctgagaagtacctaacaggaaaccctaaggatgccatatcagcggttagttcgttcctaaaggacactacctatacattctcttcggataacgtagatggtggaacctacggtgtaatccctcgcaacatgatgcaggtaacagatgaccctaaatcttgggagcaaggtaaggatatcattgagcaagctgttaagaagtaccaagagcaaaacccttgggttaccaacaaacagcttaaggttagccaacagggtaacttaatcaagatttacgataccactaccaacttgggcataagttatgataacgcactgctacgcaaggtgtataagaactatgctgagcaacaggctgcatcggctgagaagaaagccttaacggaagccaataagcgagcacctatcgtcgcggcaaccaaggcccgtaaagaagcagctaagcgtgtccaagagaaacggaacaaggttcctaagtttatctatggacgtaaagaagactaacagtaaactataaggaggctccatgagctacgacaagacgaaaccatccgagtatgatgggttatttcagaaagcggcagatgaacatggggtctcctatgacctgcttcgtaaattagcattcaacgaatctggcttcaatccgaaagccaaaagccctaccgggccgttgggtatcatgcagttcactaaaggtacggcagcggggcttggactcaaggtgacagggggagatgacgatgagagattcaaccctgagttggctgtggacgcagcagctcgtcacctgagcgacctcgttaggaaatacgacggggatgaacttaaagcggccctagcgtacaaccaaggagagggacgcaatggcgctccacaaatgcaggcttatgaccgaggcgattgggcctctatcagcgaggagggccgcaactacatgcgtaaacttctcgatgttgctaacagcccgcgcaagggagacttggaggcgttcggtgggataaccccaaaggctaaagggattcctgctgaggacgcctttgctggaatcggtaaggccgggaaggtaggaactgagcttccacaatcaactggctttaagctggagggtgtggaacaacaggaacctgccgtaccgttcactaaggatttctacgataaacatggaactaccgttgaggaatatgaaaaccgttcaacattcttcgggataaaggacaccacaagtgccgagcttcataactcgctattgggtgttgccttcaatgctgcgcgttttgatgatagttttgacatcttcaaggacgctattaccccaactcgatggaactcctaccagccgacagctgaggatcttgacaagctccgcaacagtgggcttcctccgagttactactcagtggtgacaggtggtgacggtgataactgggatgacctgattaagatggcgaagagaaactacgagatggacgtgaaggctgctgatgctggtgtgggagcacaattggttggcggaatcgtgggagctggtgttgacccattgagctatgtgccgcttgttggtgttgctggaaagggtctcaaggtggtaaacaaggcgttcgttgttggtgcccaaagtgcagccttgggcgcagtttcagaagctgttcgcacatccgttgctggtggtgaggcgcactatcaagatgcaatccttgggggtcttatgttcggggccgggatgagcgcaatagctgatggagtgagtgcagcattgggccgtgttcgcgctggtcaagttagtaacgacttcgaccgcatggctactcgactggaggcgcgtgagtctgcctttcaagctggtggcgaggacttaacacgtatgccaacagagggtcgtacatttgacggggaacatgcgggtgtaaactactctcaacttgaaactgaaccgggggctgtggtgctgccgcaaggtcaaatcttgagtgacaccaacccgattaaccctcagacacttcatgagttcgagcaggttaaccctgagcgagcggctcgtggtatctctttgggtggattcgctgagatcagcctcaagacccttcggtcggagaatgagactgtgcgctccattgcgagtgaccttgtgcgttctccgacagggatggaatcaggctctaacggtaagttcggtgcgactgcttctgacattaaggagcggctccacgcgaacaatcagcgcacctacaatcagctttatgatgctgtgcgtactgcaatgaaagaccctgagttctctacaggtggtgtgaagatgagccgtaaggaagtacgtcaggaaatctataagcgtgctgccttagcgattgagagaccagagctacaatcgggactcacaaagggagaacgtaaggtgatggatatcctgaaacaacacttcgacctcaagcgagaactcatggaaaaccctgctatcttcggtaacgccaaagctcgtagcatcttccccggctcacgccataacggaacctacgtgcctaatgtgtatgaccgcgccataaagttgtacatggtgagtcgctacggtaacgagggactacaacgggcaattgcagagtcgtggcttacatcttaccgcgctcgtccagaagtcaaggcgagagtcgatgagtacctgatggagcttaacggtctcaagacggtacaggaagtaacaccagatatggttcagaagcacgctatggacaaggcgtatggtatatcgcacactgaccaattcacttcctcctctatcattgatgaaaaccttgagggtctggttggcatcgagaacaataacttcttggaggcccgtaacatgttcgacagcgacatggctgttaccctcccggatggtagcacgttctctgtgaacgacctgcgtaactacgatatggctgacattcttcctgcttatgaccgtcgagttgacggtgacgtggctatcatgggtggttcgggtaagacgacgaaggaactgaaagatgaaatcatggcgctggacaagcagtctgagggtaacggctcactgaaaggtgaagtcgaagcactcaaggacaccgtgaagattctgactggtcgtgcccgcatgaacccagagggagctttcggtacgattcttcgctccatgactgacttggctttcttcgctaagaacttctatatgccgttccagaacttcactgaggttgctgctatgttgagtaaaggaaacacctctgcggtacttcatggaatcccactgcttaacgattgggttagccggaggaagcctatgagcggctctgagattaaggagattcacagtatggtgttcgggaaggaactagaccagcttatgcgtccggggcgcgaagaccatatccgtcgccttcgggagtctactgacactaacgcagtggtggctaatgtggttgggactattcgcttcggaactcaggaattgtctgcgcgctcaccttggacgatgctgcttaatggaacctctaactacatcatcgatgctgccagacagggtgtactgggtgatgtggctggggcagcgctcgctgggaaaggatctaagttcggtaaagcgaattaccttaagtctgcctctgtgtcacctgagcagtggaagggaataaagcagttgttccgtgaccacgccactcgtgatgctgacggtaagtttacaatccgggacaaacaggctttcgccaatgacccacggactatggacttatggcgtctggctgataaggttgctgatgagactatccttaggccgcataaggtttcctcacaggacgccaaggcttacggagcggctgtcaagatggtgatgcagtttaagaacttcgtaatcaagtctcttaactcgcgcttcgtcagattgttttatgacgcgactaagaacaacagggctatcgattctgcgctgactgcaatcatctctatgggtctggctggtggttactatgttgctcaggtgcacttgaaggcttacggcctacaggagcacaagcgtaaggagtacctaaagaatgctcttgaccctaaaatgattgcccacgcgtcattatccagaagttcacaccttggttccccactgtctgtctatgatatgattggtggcttgttcggtaatgatacctaccagtacacccgctcaacggtgttaccaaaggaaaagaccgaacgtgaccgaaacaaggcttggactggtaaggaggttgcgggtaacatagtaggggcgatatccaaccaagtaccagctgtaggactagttgggaatattgggtctaccgccatgaatgcctctacgctacttagctctgatggtaagcagagtgaggtagagttccgtactggtgtgttcaacgccatgcgtgagcttgtccccaatgacccgctgacacaacagttgattatgcacatcttcgaagagcagggcatcaagattaaggatgatgcaacacgccctcgccaataaaccctcactaaagggagagaggtcacattctggcctcttctctcttaatgctaatttacaaaggaggtcacatggctacaaatattaagaccgtgatgacttacccgctggatggctccactacggacttcaatattccgtttgagtatctggcgcgtaagttcgtcagagtgacacttatcggtgttgaccgaaaggaactcatcttgaatcaagactatcgttttgcaactaagaccacaatctccacaacgagagcattggggccagcggacggttataacatgattgaaatccgtcgatttacctccgctaccgataggctggttgacttcaccgatggttcaatccttcgggcatacgacctgaacatctctcaggttcaaacccttcacgttgcagaagaggctcgtgacttaacggctgataccattggtgtgaacaatgatggcaaccttgatgctcgtggtcgtcgtatcataaacgtagctgatggtgttgacctcggtgatgttatcactttaggtcaagtcactcggtggaacgagtctgccctgaactctaagaacgccgctgctacctctcaggccgctgccaagacctcagagaccaacgctaagacctcagagaccaacgctaagacctctgagaccaacgcgtaccaatgggcgcagcgtgctgaggactctccggtacagggtagcgagttctctgcgtatcattactccctcaagtccgcaaaaagtgcaacagccgcgcatacgtctgaggtcaacgctaagacctctgagaccaacgctaagtcctctgagactaacgctaagacctctgagactaacgctgcatcgagtgctgctaaggcttctgaggaggctgctaagctgactaacatgaatgactttgctgccgctattgattcagtcaacggtaacaatgttgtcatgaagggtgacttcaccattaaaggaaacggtaaagtatcaatactgaaccacagtgggctataccaagataagaccgttaatggcgtgaactatgccaacaggatttatatggatgatgcaggggccatgcacttcgagaactaccgtgtgtctggtgcttcatccaccttacgtgctggttttgttattacagataccaacaggtttgactttacagggccaacgcgagttaatggtgaatctaccgtatatgtgtatgcgccccctaatccggctattggtcaatacctcaatgctgtggcagttcgctcacagcttcggggccgtggtggtaatggtgatccacttggtgcgtactgtggtatgtatattcaggagcacgttggtacagaccacgcgataatccttaacctcaatggttatagcaaggatactaactggcagctattctccaatggtaaaatatctacaccacttggtgatgtgatgacttcaggttctgatgttagaatcaaggatgatatcactaaacctcttgatggtgctggtgagcgtattgacgcaattggcatagtggaatacacagagattgccaccggggaacgtaaacgtgggtggctggcccaacaacttgacacgattgacccgctgtacacatacctaacgaccaccgcagaaggtagtcttttgaataccaacgacagggcgttgcttgctgacgtaataactgagcttcaagcactgcgtcaacgcgttaaagaactcgaaggacaatcaacaaagccagcggacggcacaacataaggagaacacaatgctttcttttgacttcaataacgaggtcgttaaggctgcgccgattgttggcacaggggtcgctgatggtgcggcccgactcttttggggactatcgttaaacgaatggttctacgttgcagccatcgcctacacagtggttcagattggtgccaaggtagtcgataagattattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatccttggcggtctcgcggctggtctggaagactacaacaaagtggtcggccctaatggtctgactgacgatgagaccatcacgctacagtaagtgacatactcaaggttctccacgtggggagcctttatggatgttatttggtgcatctgtgtgaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgaatacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactgccagaagataacggtagatgcgagtttaatggtcgagccgaactacacgagtcagatgctaagcgtattatcggaataacccaagctgccgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtattggtaaatcattcatcacctgtgcgttcgttgtgtggacgctatggcgtgaccctcagttgaagatactgattgtctctgcatccaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggcatcactggtcagttgactggtagccgtgctgatatcatcatagcggatgacgttgagattccgtctaactccgcaactcaaggtgcccgtgagaagctgtggactctggtgcaggaatttgctgcgcttctgaaaccgctgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcgagatgctccaaggtcaaccgactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagttatcattcgtgcagccagaacactggacagtaccagcaacgcatcctcgtgattgaccctagtggtcgaggtaaggatgagactggttacgcagtgttgttcaccctgaatggctacatctatctgatggaagctggcgggttccgcgatggttattccgacaagacccttgagtccctcgctaagaaagcgaagcagtggaaggttcagacggtggtcttcgagagtaacttcggggatggtatgtttggtaaggtattcagccctgtgctcctgaaacaccatgcagcctctatggaagagattcgtgctcgtggtatgaaggaactacgcatttgtgatacgctggagcctgtactctctacgcaccgccttgtgattcgtgacgaggtgattcgtgaggactaccagactgcccgtgacgctgatggcaagcatgatgttcgctattcgctgttctaccagttgacccgtatggctcgtgagaagggcgctgtggcccacgatgaccgacttgatgcattagcattgggtgtggagttcttacgctctacgatggaactggacgccgtgaaggtggaagctgaggtgcttgaggcgttcttagaggaacacatggagcacccaatccattcggctggtcatgtagttaccgctatggttgacgggatggaactctattgggaggatgacgatgcgaatagcaacaggttcattgactggtagttatgcatattgagtgcataaggaagcatcgagaccacggatggtcactttaagaaactccttaagaatcaatgagtttgaattaaccctcactaaagggagagaggggacttaaagctactatataggttagtcattcaggttatgcaatgaccttttatgcactttaagtctacctctgtgattggtgatattatcattatataatcacctaccttagagcaactgaaaggaggtggctcaatgttacgcttgctgattgccctgctgcgtcatagagtcacttggcgatttcttctggtacttactgctacccttgggtacgcaggccttactgaccacctcggtcaactggaagtggccttttgctctatactctcttgtggggattaaattattgttgatgacagacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttctggatgcgcctatggtctcacctatggtgtggccttacctaaagtggttgcctaaagagaccctttaagaatttaccacaaaaatctgaatgggtatctcacagttcaagaaaccaaagtacccccatagccctcctaaagccacctaaagccagccctacccctagggtttaaccttcggttaaccttgggtatctcctcaagtggcctataggatagcctaaagtgttgcataaagtcaatacctaaagaggcggatggcttaaagaggccttgaagagtgtcctagtgtaccagttcgatagtacatctctctttgtgtccctatctgttatcctcctaaagtaaaccctaaagccatcacctaaagccaccacctaaagaccagacctaaagccatcacctaaagagcagacctaaagcca

SEQ ID NO: 149 - DNA, 38138 bp, Unknown
  source: /note="Description of Unknown: KP2-16-1 Bacteriophage Sequence"
tcccttattccctttagtgagggttaatgaaacgactacagataactacaaggcatcactacaggttaacaatgggtctatcggtctggttgtctttaagatagcgccgctctttaggtgatagctttaggtgatggctttagggtttactttaggaatggctaacagatagggacacatagagatgtactatcgcactggtacactaggacactctctaagtcctccttaagccatccaccactttaggtattgactttaggcatcactttaggctatcctatagaccacttggagagatacccaaggttaaccgaaggttaaaccctaggggtagggctggctttaggtggctttaagagggctatgggggggtactttgggttcttgaactgtgagatacccattcagatttttgtggtaaattcttaaagggtctctttaggcaaccactttaggtaaggccacaccataggtgagaccataggcgcatcccgaagggatagctaggagacaccagaagaccctgtaagaccattacgaactacagggcatctttaggtataacctttagggttgactctacagggatgagttggtgtagtgaaactatacctacgaatccctcagagccgcttgtcgttcatcaacaataatttaatccccacaagagagtatagagcaaaaggccacttccagttgaccgaggtggtcattaagacctgcgtacccaagggtagcagtaagtaccagaagaaatcgccaagtgactctatgacgcagcagggcaatcagcaagcgtaacatgagccacctcctttcagttgctctaaggtagggtgattatacaatgataatatcaccaatcacagaggtagacttaaagtgcataaggggtcattgcataacctgaatgactaacctatatagtagctttaagtcccctctctccctttagtgagggttaatgcaaactcgttgattcttaaggaatttcttaaagtgaccatccgtggtctaattgaatccttatgcgctcaatatgcataactaccagtcaatgaacctgttgctattcacatcgtcatcctcccaatagagttccataccgtcaaccatagaggtaactacatgaccagccgaatggattgggtgctccatgtgttcctctaagaacgcctcaagcacctcagcctccaccttcacggcgtccagttccatcgtagagcgcaagaactccacacccaatgctaacgcatcaagtcggtcatcatgggccacagcgcccttctcacgagccatacgggtcaactggtagaacagcgaatagcgaacgtcatgcttgccatcagcgtcacgggcagtctggtagtcctcacgaatcacctcgtcacgaatcacaaggcggtgcgtagagagtacaggctccagcgtatcacaaatgcgtagttccttcataccacgagcgcgaatctcttccatagcggctgcatggtgtttcaggagcacagggctgaataccttaccaaacataccatccccgaagttactctcgaagaccactgtctgaaccttccactgcttcgctttcttagcgagggactcaagggtcttatcggaataaccatcgcggaacccgccagcttccatcagatagatgtagccattcagggtgaacaacactgcgtaacctgtctcatccttacctcgaccactagggtcaatcacgaggatgcgttgctggtactgtccagtgttctggctgcacgaatgatagctatgaatatcatcacccttaaggcccacgttaggtagctcttcattgcgattctgacgattcggaagccactggtaatgcattggggctttctcgaagtccagaccgcacacgatagcgtcccggaggcgtaaggggtacttctcggcatcactcaggttcgggttgagcatgaactgcaaagtgaagccagccttaccgtattccaactcacgctcacgcaggtcttccatatcgaagcgcacggggtcagttggttgaccttggagcatctcgaacccatcgttgaactcttcgcggagcatcggggccagacggtcgccatagtacaagtcttcctcgcggctacgcggatagagcgcaggccagatgattgtggtgtacccacggttatcttcgagttccttgtacaaggtcatttcggtttgaggcgtgccaaggtagataacgcgagaagtcggcagcggtttcagaagcgcagcaaattcctgcaccagagtccacagcttctcacgggcaccttgagttgcggagttagacggaatctcaacgtcatccgctatgatgatatcagcacggctaccagtcaactgaccagtgatacccaccgacttcacagacggagagtggtcaggcttggcagggccaacatcgaaactaatcacagagtcacgctgaccggggcgaggctttagctcagccaagaagggcagcaggtcaatgatgttcttgatgaagatggagttagcgtccgcacgttctttggatgcagagacaatcagtatcttcaactgagggtcacgccataacgtccacacaacgaacgcacaggtgatgaatgacttaccgataccacggaaagcctgtaggataaacttcttgttgtctccgttagccagacaccgggccatatcaatctgacacttagtcggtggcgggagagccaaagccttccacaatacgaacaggaaggccacaaagtcgcccttaagctgcgcgatgattagcgcattacggtttgcttgggtgtcgctcattctgcatctccttaatagtacgctggagcgctcttacgtgagcatcagcagcttgggttattccgataatacgcttagcatctgactcgtgtagttcggctcgaccattaaactcgcatctaccgttatcttctggtagtccggtaagggttttgatgcggactgacagccgcttattattactacgaaggtcattaagcatcctatcagtgctgccctcaatggctgcaatctcttcttggtactcacgggatacccgactgacctctgcctgagttgctgcggttgcttttgttttcgcaatgtattcattttggattacctccttccagtttgctctctcatgggttgaccctaagtgccagccacccataaagagtgtcccggcgagtacccaagggagtgcgctgcgtaaaagttttagcataacacctcccatcaattttcagatttcacgtagatgcaccaaataacatccataaaggctccccacgcggagaaccttgagtatgtcacttactgtagcgtgatagtctcatcgtcagtcagaccattagggccgaccactttgttgtagtcttccagaccagccgcgagacctccaaggatgttctcatccggggtcagcttactgatttggaacttatggcggtctaacagcttgccgattgcgttgtaaagctgtggcgttcggcgttcctcgctctggaggtcagcaagcatacgctgtgccatctccgtgtctagcatctccagcagcttgattaaagtcttgtcgctcataggttactccttgtttgcacgtttccagtcaatcatcttatcgactaccttggcaccaatctgaaccactgtgtaggcgatagctgcaacgtagaaccattcgtttaacgatagcccccaaaagagtcgggccgccccatcagcgacccctgtgccaacaataggcgcagccttaacgacctcgttattgaagtcaaaagataacattcttgttctccttatgttgtgccgtccgctggctttgttgattgtccttcgagttctttaacacgttgacgcagtgcttgaagctcagttattacgtcagcaagcaacgccctgtcgttggtattcaaaagactaccttctgcggtggtcgtgaggtatgtgtacagcgggtcaatcgtgtcaagctgttgggccagccacccacgtttacgttccccggtggcaatctctgtgtattccactatgccaattgcgtcaatacgctcaccagcaccatcaagaggtttagtgatatcatccttgattctaacatcagaacccgaagtcatcacatcaccaagtggtgtagatattttaccattggagaatagctgccagttagtatccttgctataaccattgaggttaaggattatcgcgtggtctgtaccaacgtgctcctgaatatacataccacagtacgcaccaagtggatcattcttagcaccacggccccgaagctgtgagcgaactgccacagaattgaggtattggccaatagctggattagggggcgcattcacatatgcgatgatatcaccattagctcgcgttggccctgtaaagtcaaacctgttggtatctgtaataacaaaaccagcacgtaaggtggatgaagtaccagacacacggtagttctcgaagtgcatgccccctgcatcatccatataaatcctgttggcatagttcacgccgttcacggtcttatcttggtatagcccactgtggttcagtattgatactttaccgtttcctttaatggtgaagtcacccttcatgacaacattgttaccgttgactgaatcaatagcagcagcaaagtcattcatgttagtcagcttagcagcctcctcagaagccttagcagcactcgatgcagcgttagtctcagaggtcttagcgttagtctcagaggacttagcgctggtctcagaggacttagcgttggtctcagacgtatgcgcggctgttgcactttttgcggccttgcgtgagtagtgatatgaggagaactcgctaccctgcaccggagagtcctctgcacgctgcgcccattcgtacgcgctggtctctgaggactttgcgttgctctcagaggactttgcgttagtctctgaggacttagcggcctgttgagatgcagcagcggcctgttgagatgcagcagcagcattcgcagagttcagtgccgactcattccatcgagagacttgacctaaagttattgcatcaccggggtctttagcgtccgcaacgttcacgatacgacgaccacgagcgtccaagtcaccatcgttgttaacgccaatcgtatcagcggtaaggtcacgcgcttcctcagcaacgtggagggtctgtacctgcgagatgttcaggtcatacgcacggaggattgagccatccgtaaagtcaaccagcctatcggtagcggaggtgaatctacggatttcaatcaaagtataaccgtccgctggccccaacgctctcgttgtggagattgtggtcttagtcgcaaaacgatagtcttgattcaagatgagttcctttcggtcaacaccgataagggtcactctgacgaacttacgcgccagatactcaaacggaatattaaagtccgtagtagagccatccagcgggtaagtcatcacggtcttaatagttgtagccatgtgacctcctttataaattagcattaggagagaagaggccagaatgtgacctctctccctttagtgagggtttattgtttcttcggcgtctcctttatgcggataccgttggcctcgtagattttcataatgagttgctgcgatagcgggtcattaggaatcaactcacgagaggtgttgaagaggcctgtacggaactccagagcggtagccttgttcggagaagacagcagggaagcggcgttaatagctgttgcacccacagagccaacaaagcctaaacccggaacctgctcaccaattgcacctgcgatagttgaagccacctgtctacctgtcactgccttgttagggtcacgcttctcggactctttagggagcaccgtagagcgggtgtacttataggtatcgctaccaaccatcccggcgaacatgtcgtagatactcaatggtgagcctaagtgtgaactacgagatattgacgcatgagcaatcatcttagggtcaagggcgttcttaaggtactccttacgtttgtgctcctgtagacttgcagccttaaggtgcgcctgcgcaacgtagtaaccaccagctagacccaaagagatgatatgagtcaacgcttggtctaacgcacggttgttcttcgttgcctcgtagaagctacggacgaaccgggagttaagggacttgatgacgaagttcttaaactgcatcaccatcttcacccctgcaccgaacgctttggagtcctgtgaggaaaccttgtgagggcgcagtatggtctcatcagccaccttgtcagccagtcgccacaagtccattgaacgggggtcgttagcgaaagcctgtttgtcacgaatggtgaacttaccgtcttctccacgagtcgcatggtctctgaacaactgcttgattccacgccactgctcagggctgatagaggcagacttaaggtagtttgccttaccgaacttagaggctttcccagcaagggccgctccagccacatccccaagcacaccctgacgggcagcatcaagaatgtagtttgatgttccgtttaggagcattgtccaaggagagcgtgcagccaactcttgagtgccgaaacgaatcgtaccgaccacattggcaaccgcagcgctggtgtcagtagactcccggagtcggcgcacgtggtcttcacgtcccggacggattagttggtctagttccttaccgaacaccatcccgtgtatctccttaatctcagaggcacgaagcggtttaccacggttgacccaatcgttaatcatagggatgccatgagttatcgcagagacgttacccttcgccagcataccagcgatttcagtaacgttctgtgcgcccatataggcgttcttagcgaagaacgtaaggtcattgacggagcgtagggctgtgccccaagcgccttccgggttccttcgagcgcgaccagtcagaatcttcacggtgtccttgagggcttccacttcacctttcagtgtgccgttaccctctgactgcttatccagcgccatgatttcatctttcaggtctttggtagtcttaccggaaccgcccatgattgcaacatccccatccactcgtcggtcgtatgcaggcagaatttcagccatgtcataggtacgcaggtcattcacagagaacgtgttaccatcagggagagtcaccgccatgtcactgtcgaacatgttacgggcttccaagaagttgttgttctcgatacccaccagaccctcaatgttatcctcaatgacagaggaggcagagaactggtcagtgtgtgaaataccatacgccttatccatcgcgtgcttctgcaccatctcaggtgtaacttcctgaacggatttgagaccgttaagttccatcaggtactcatcgaccctcgccttgacttctggacgagcacgataagacgtcaaccatgactccgcgattgctcgctgcaagccatcattaccgtaacgtttaaccatctcaatcttgatagcgcggtcgtacacgtttggcacgtaggttcccttgtggcgtgagccggggaagatactgacagccttggtgttgccgaagattgacgggttctccatgatttcacgtttgaggtcaaagtgctgcttgaggatgttcatcacgttccgctcaccccttgtcaggtttgcttgaagctcaggccgctcaatcgccaaggctgcacgcttgtagatttcctgtcggatttccttacggctcattgtggccccacccgtggagaactcagggtctttcattgcagtacgcacagcatcataaagctgattgtaggtgcgctgattgttcgcgtggagccgctccttaatgtcagaagctgtcgcaccgaacttaccattagagcctgattccatccctgtcggagaacgcacaaggtcactcgcaatggagcgaacagtcgggttctcagagcggagagtcttcaatccaatctcagtgaagccacccaaagagataccacgagaggcacgctcagggttgaccgcctcgaactcgctaagagtctgagggttcagcgggttggtgtcgctaaggatttgaccttgaggcaacacaacggcacccggctcggtctccagaggtgaatactcaacgccagcgtgctcacggtcgaacacacggttctcgctcggcatacgggtcaggtcttcaccaccagagttcagagcggtctcacgggcttccaatcggtgtgccataggagcgaagtcattaacaacctcagtaccacgggaacggcgaataccagccgcgatagcatcgcttattgcactcatcccagcaccgaacatcagaccgcctaaagcagcatcagcatagtgggcttctccaccagcgattgatgtacggataccctcagaggcaaccgcgaggccagcactttgagtacccacaatgaaagccttgttaaccaccttgagacccttcccggctacgcctactagcggcacgtaactcagcgggtctacaccagcaccgacgataccagcagtaagtttggcaccaacaccagcatcggcagaccgtgcgtccatctcatagttgtcattcgccatcttaatgagggcgtccagattctcaggagagcctccagtgactacgttgatgtacgatgggttcttcacttccttacggatacgctctagctcttctggagtccacgtatggctgttccagcgagtcggagtaatggtgtccttgaataaatcaaaaccgtcatcactacgagcggcacgaaaagccacacccaatacggagttgtgaagttctgcactcgtggcatctccgattccgaagaaggtcgaacgtgaattaaactcgtccagcgttgttccagtcttttcccaaaagtccttggcataaggcacgttaggtgctttctgctctttaccctccactttgaatccagttgactccggcaggtcagtgcctaccgtctgcttcttcccgattccagcaaatgcatcccccgatggaatgcccttagcctttggggtgataccgccgaacgcctccaagtcccccttgcgaggactgttagctacgtccatcaggttacgcatatagttacgaccttcctcagagattgaagcccaatcacctttgtcgtaggcctgtatctgtggagcaccgttgcgcccctcgccttggttgtatgctagggctgccttaagctcatccccatcgtacttccgaatgaggtcactcaggtgacgagcggctgcatccacagccaactcagggttgtaacggtcatcgtcatcatcgtcagtaaccttgaggccaagcgcagtggctgtacctttggtgaactgcatgagacccttcgggccagttggggatttggcctttggattaaagctggattcgttgaatgctaatttacgaagcaggtcataggagaccccatgattgtctgccgctttttgaaataacccatcgaactcgctaggtttgttcttatcgtagctcatggagcctccttatcactgttagtcttctttacgcccatagatgtacttcggagtcttcttccgtttctcttggacacgtttacgcgcttcttcacgcgcctgcgttgcgcgactgattggagcacgcttattggcctctttgagagctttctctcgcgctgcctcagcttgcatctgtgcggtgcgctgatactcacgcttgagcaactcttggtcataccgaatgcgaacctgtccggttgtgtccatcaggtagattgaatcaccttgctggtacaccgacagttgcttgttggtaatccaagggttcgccgctgtgattcccttaatggcttcgtccagaatgttcttcccttgctcccacgacttagggtcatccgaaacagtcaggatgttcttcggtaggacgccgtaggtatcaccctcaacatcgctactggagaacgtggtcgtagaatcggagaggaactttgcgacctgttcagttgccatgtcagggttccctgtccggtacttcacggaatcataaatcttccgggcatacccttggacactcgaaggcatgtacttgatttgaggattcgttgaatcgttcatcatagcagcccacgctcggtcatcctcaaactgcatctccttggtcttctgtgcgcgggccttatcagcgtcgataagaacctgcgtgtcgatgccttggttatccaacatgtccatcgtcaggaacaactcggccttgtcaggatacagagaggcaatcaggtcagggtcagtgttgcggatgcgacgaaggttgtccatcgctggtgtgctctcaggcatcttaccgttaatcaccgcagcctgccattcgttacccgcgtcagtaatcatctcaccaaacgctgcacggaaagcaccctccttggagtctgcccgtaggtagtccaatttcagtttgtctttctgttctggcgttaagtccatcgcttcgatttccgctaacttctggttcgcgtagttgaccatatcgctatgtgtaaactcaccagtgttctcgtttgtcggcatgtccttatagttggtcgagacgtattcaccgttgaggcgcttctggaactgcttgtcgatgaccaaagatttattcagggtcttctgttgcttgtccatcagcttggctgtctcagcttgttcctgcttgaagcgggtgcgcatctgttcctgtgcggaaatcaaccactcgcgctcaggagtcatctcttcacccggctgaatcttatcgagttcggccttgataccttgaagagtctcccaacctttaccagtgtccgcttggttaagcgctgagttaatatccagtcggaacttctctgttaacttcgcgttgttctggaattgagtgtgctgtgccttaatcatcattgcctgccactgctcatcacccatcagttcacgataggtagtcgtagcgccattaagagtcaccttgcggttctcaatgttctgcaagaaggcggcaccgcccggacgctgtagcacgtcattcagggacgaagagataacctgttgagcctgattgtcggtcatccctgtcaccaaggagttgtcaatgtagttctggaagaactcaccggactcaggacgagacagtaggtcagggtcagacaggacaccattgagttcaaccttcgagttcaggattgcacccttctgcgcttggtcactcaggaaggaatcatgtgcgccatacagagcaatgttacgctcggtgatattcgcattgaaacccttctggtattcctcgtccatctcattgatgccgaactgctcagcgaacgacttcgagtgctcctgtaggcgtgagtgacgatactgctccatctcttcacgagtacggaagcggccctctttgatggcctgttgaacctcatcgtcaacgaggaacgcagcgttacgcccggtcttgaacttcaaggcttgcattgcgtatgggtcatcctgatacagcagtgtaccattctggatagcctgtcggcgctgctcaggggtcagcttacggataatctcattggagcgctcatcggcccgttgcttatcacgttcatctttcgccatgtacatatcggcaccagccttagcgaatcgaccaatggagtccagaagactcgctcttggttgttcagcctgaatggttgctgcccggtagtccatacctttgacgccccggagtcgttccataccgggagtcgccatgttgcctaaaacactatttagtttactagccattattacctcccggtcttggttcctttggcggcactgataggtgctgcttggtttccgcctttcttgtcaaatccaccagccgcatattgacttgcagcttcctgacccataatggacagagggtctagtacgcgcataagaccagacttacctttggcctcgctcttgtacatggcatcgacttgacttgctgtggactgagtgcgtcccaactgttgcgcaaagatactcgcatagtctcggcggtaattctcggtgacgctattggcctctcgaatgtagttgccctcttcgatacgcttgatgcgcttcatggattcaccttcgagcataccctcaccaatcgccgcacggattgttcccatagcctgtaccttctgcatgttacgtgtagtcaactcagaggatgcagcctcaagggcgtcccgttgttccagcgaggcgttggcattttggatattcgtctctttgaccatctccattgcctgtctgcgtccagcttcggtctgtgccactcgcgccttgtcagcactgttctggctactcagagcttgggcacccatcatggcgataggaatcgctgccatccagcacatagttacctcctactgatagtgaataattggaattgaccatcagcgataaactcattatggaataccgcacctatggtctttaggaaacgaatgtgtgacttattgcctacccaaacgaaattccaaatggactcgtactggctcagcatcatatcacgatattcaatgataagtctacgaaactctaagcgctccttcaagttaaacagcgggacgtacttagaggtaaggaaccatactcggtctccctgattgccaccgattgccaacacagcgttatcgctgagcattgccacagtgttctcatcaggaattactttaggttcgacacccaatgcctcagcttccagaatgtcctctatggacggctgaaagttgtcagcgtggctttgtaaacactttgtaatatacataatgctttaacccctcgtatctattagtgtctccctttagtgagggttaattcaccgcagggagactttaagttaaatgccagaagaacgacgaaggtagttaccctcccatccgcacccaatgatgttcagtggggttgatgcgtctgactcgatagttactatgttcgcctgagcattgcctaccaccgggaagcggtactgccctgtaccaatgtttgagcctccaacacggaggttgtcagaccccaatcgtgcacccgccattgtgtagatgaactcacgggacaggttgttcacacggatgatgaacgctccagagtcctcatagtttacccatgcacgccgaagctgtaagcgaccgatatcctcagtagccgtcgagccgtcctcagcggtcttcttgatgaggaacttcgagaacgtataagtgaacgggatgttgaacccaatgtaaaccacttggccctcttggttcccatcaagtcgcaacaccgggtcgctactccacccgttgactggcgggtctatctctacaatcttaccatcaggaaagaccaccgaaatcttacccttcgtgaagttcatcccgtaaatcgctgagaggcttattgacgtctggtaggtatcgtcattgtatgtcccagcagggatggtgtaccttctcttagcgtcgatgtacagtctgtaaggctctcccggaatgtctatggagttcttcgtgaagtgtaagcgtcccatccacacagcatgttcattgcccatcaatacagtcattgttgagtttatcacctgtgctgcaaacaccgtaacgttgtccccaaagtcccaatgagaccacgactgctgcctgatttcctcatcaatatagaggaacttgtagatatacactcggttcggtgctccgctcgtaaggatagccgcgaagttctcagcggttgtacccgatatactgaatactccattcggtatgtagttcggaacgtgagccgtcatgtcctctgcgttcttcacagagcttacatcctgtaccgcatagtatcggttaatggatgtgaaggaagcgcgaggtgacgcaaagtatacattacgccccacaccgtgtggtcgcgccctgtcttgcacatcaaactgagtcgtaaggttcaactctacggagcggctcgataggataccagaggctgtcagaacgaactgcgcttggtcagaccacaggagcaactcttcggagaacggaacggcatacttcaaggttgacacccggttgtgactaaccgcaacgtcgattgggtcatcgtcggagtagtttgacacggaggccgggaagaagttgaagtatttcgaggtgcgagacaagatgatgttctccccgctaaggaatcccaaacggtttcggaagaagaaaatatcgttgattgtctgtccggtaaatgatgggtatgggttagttgtatcatcgcccacagtacgagcaccccactcaaggtacttgaagtcaaagttcccgtcagaagcacgtaccagcgcccaaggcatcgtgtggtaatgtaggtgagtccttgtgttccatccaattgtttctacccacaccttacggttgaggtcgaacctaacgtaatactggtcggcagtctttgaggtatcaccaacaatcttcacaatgtacccatctggagcgttaataggcaacttctggaacgactgagtgtaatgggttacagggttgattagctggtctgcgtaaccatccttagtctgtagtccccaaacgttatcgttatttggtgcaaggatatggatgaatccggggccaacattgaaccgccacttatttgggtcttgttcattgtttggattccctaggttattccgcaactgagccgccagcttctcagcgatggcctgaccgtcaacctcattgacgtgtgctggttgtgagccgtctggtagttgaatagcagcacgctcagccccgttgaactcgattgagagtctacgtccatattgcccaccacgaacattaatcagcgcatcgccttggtctttaaagcccggaaggttgaccgattggtcgttactctgcacaaccaccttgcggttagtcacaaaggtatagtctgccaccgttaccatccgaaggtcttcccgtgggttagctgtgcgcacataagagcggtctccacgtactagatactccttaccatcgaggtcgaacaccttaatgtcttcaccagtgaacacaacgaaatactgctcgaactcatcacggttgataagatgcacgtaaggttgcgcacccacatacccagcagcgccaagggtcttaaggtgaatcatcggtgggcgcttctggagaccctcggactcagaagaccaaccgttaatctgtacgctaccttgttcagcgaaccggagaatatctggctgttggctgataccacccttgaggtttttgattgattggctaatgagagccatagagcctccttatgattagcggttaagtagaccagaggtgaatgcgtcaccgtccagcatgttgtagttgccgtagtctagttcgtattcgaagcacgcacgccacgcttcctgctcttcttcctgcaacactccgtctacctccggcgcaccgaagaagcggttgttgaactggcgcgaagccttggtgacgatgtagttacggaagcactcaggcatctcatcgaactctctcagacgaatcaggttgacctgaacaccagaaggaaatcggtcagtcttcgcagagcggtcatagagatatccaccacggttgatatattgggtctgaccgctggttgccattacggacagatagtcagagctaaatggaatcataccagagaacgcatccggtagaagagtcacaccttcctcaatattgaatgtccatcctcgtgattgaatctgtcggttaatcttattgagtacacgtcgagcattcgcaacgtcagcattcgcatcaccctcaagggttgatactggtggctcaccgatggaagccagaatgtcgttgacggctgatagctcttctgcggtctcaatgttcatctcataagagcgcatggtgttacctcctgttagtgagggtttaaagcaaaaaacccctcagataccctcagagggcacccaaggggttcataaagtaatgaaggaaagtaaatccccggtaaagaccttagccttctacgggaggctctactgctttcacagtgaccttgcagacagccgtcaggccattcacagtagtagcagtgatgtcagcggagccagcgcccacagcagttacagtaccagaggcatcgaccgtagcaatcttcgcatcggaagacgtaaaggtcactgtctgtactgcatcagccggagttaccgtagcagtcagggctttagaagccccaacgactaagctcatagtcttctgactaagagtaactccagtggggtcgggaattactccgacacctttgggagaacgatagcgccagcagcttctggacgcagaccgccgtgacccatcgcgtacttagcgataatctggtcagcctgatagttcgcacgacgagcgcgctccagagccaagtctttcagcttgaccgtaccaaccgcagagcggtgctggaacaggccaacaacgttatccagagcaaccttaacggtagtgctggaagtcgccgggaaagcgtgcttctggtcagccggggaatcctcacgggtatcaccagcgccaccagcagtcaggtgcggaacctcaaccacttcgaagcccatcacgttacggatagtaccacgctcagggtcaatcagtgcctgatagtttgcagcgttcggcatcagggcagccagaatcgcggagtagttatcaggagtggtgtagaaagtacggtcagcagccggaacgtaattcttggtcagcgccgcacgagcaacggtcaactgagcgataatcgctttacccagctcaaccgggtcagtcaggtcgccagaggtcggcttaaccagagtcagtacggtaggcttaccgagaccctcgatgttctcattggaggcgtcaggcaggttaaccagaccagccagttcagccagtacagcaccgtcagccgccatagccagagattcacccaactgtgcggtgtactcagcgcgaacgtcgtagtggttcatcgcgtcctcaatgtcgtaaatcagaacgtccgcagtcagcaggccatcaatgtggattaccttctcggtgtgtttgatatccttacgtttgtcatcgaggttctcacccggtttcaggtaagcagctttggtgcgaccaatcacagggaactgtgcggacttaccagaagcaatagagcgcagcatgtgacgcggcatggtcacggaggtgcgagcgaaagccgtcaggacttcaccgccgaacactttcaggaacagcgccaatttgtccgctgcggactgacccttaccctgattagtaccaatttgctgtccgccttgaatgttagccatgttgaatctccttatgttaatttaaagaaaagtttggttactacttgaatcgagttggttctcaatgtttcacctacgggagtgaccacaaagttctgtgctcaggtgattcaaccattgtagtcatctatggtctctccctttagtgagggttaattagaaactggagtcgataaccttctgttctaccatttggcggtaggcagaatcgctacgatagcgcgggtcgctcatagctttaatcatctcagcctgattcgtaaagccctctttctgacgagctactggtttaaccggagtagcacgcttggtaacactacggttggcaggcttaccgaatttcttcgtgtaactctcaccagccagattgataattgccttgacagtcgccaagtctcggttcatcatggcagcctcaagggactcagccgcagccgggttggttgcttcaaggtgcgtatggattgcgctaaagcgctccttaccaccagcaaaggcaactacctgattgacgtactggtctacaagggcttcctgaccggagatgtaggagtccacaaaggcacgactatagccagcagcttcgagttccgcgtaggatttctcagagataccatcggattcgtactcttcgtagatgcgagtcacagactctgcgctcagtccacgctcaacggcctgctcgaccatcgcctgaaagccttcttcgtgctgacctaattgttcagtcacttggctcagttcttctggagtgtcacccagcggttcaaactcagcggcctcaccttcggtctcaacctcagcgttatcgctaccagtgtcaaactcggcttcattaccatcttcactgatacgaacctgaatgcggccctcatcgtcttcaccatcagcgaacgggtctacaccggatgcatatgggtcatcgttatgggaactcggttcctcgctaagtacgattgcatcatcgccatcacgggcagcaacatcgagactcagcatattctgttcgtgttcagtaggtgtgcttccggtcattaccgcgttgttcacaccgaaggacgcataaacgtctgcattagattcagccattgttaaatctcctaagttgttaaagataaagggaaaccaaaggactccaacctttagtcatcgctcatttcaaagatgaggtctccctttagtgagggttattaggtggcgtctaggccagcctgcgctgcggcaccctgcatagcttctgggcttgaggtcgctagagcaccaacaccagccccaccagcggcggcagcgttctcgatacctgtttgtgctgcatcctgcatcataagggcttgcttctgctcatccgtcagtaggataccagaagtatcaataccaatggcgttagcaatgcgcagcttaatgacagcaaggttaatgtctgggtctccctgcataggagccagagcagcccaagcggagatacagcgctccagcttatcgaggtcttgaccacgcccgattgcttccagacctgtactgatagtaggctcaacggcttctttaggtagctcaggaatctgcgaggttgcttggagttgcttcaagagcacacgaaccagaggcaattgcagttcctgagacagaatcgaatagacaccaccaagcgtatcttccagttctgacgcaacgtatcgaatctcttcggcggtcacacggtcacctgttcgttgtaccgcagagttcaacataaaggcatacgataagcgtgcttctatttggtcactcacagctttcgctacggtaaagtcagcttgcttctccagttgcaggaagtcaatgtcttctcgacgaccgggaacgaagtcaccagtctgagctttggttaatctacggggctgcgtgatgccagccgggttcaccagaccgatgaccttcgcactaatcatgctcatcttaacgatagcctcttggagattctcaagagaccttaagtcacctaagtattcttcacagtaggagcgaccgtaagactcgccatcaatgcgaaccatgcgaaccggaatgtagggcatagcgtcagtaggatatgtggcatcggagccatcaatctcaacgtcctctacttcctcgtacttgaggtaatcgccggactcttcatcgagatacacatgggtatacacatcgaccatttcgtccatcttcttctcaccaccagctttctctaccgcagaccgaacgtcttccgggagagcaccaaaggctatctggtcacgagtgacaatctgtaacacattgccgtatgcgtctctttggacaacataagaagacaatcggtacagcttcatcggattgtagctaccttcgggttccggtaagtaaagcagtgcattacctgccacgatcaactgcttgaggcactcaaagagcgtcacacggtagctgttggattcgatataattcatgataatacgctcaaccatagacagaccttcgtccaccttagcgagtccatcagggtctccaacaagctgcttcgcctcatattcgctaatggtcagcttcatccacgactgcatcgggaataacgcaagcattaacttagaggccagattgttaagaccccgcgcacctacagcctgccacggagtcgtgtagtcggtagattcgttatcggactccttcgggaacaaggacggaatggtgtattgcgcacagttttccgcacgagtctcataggctctacggtcgttcgttaggcggtcataggtagctttagcaccgtcttcgcccaagcctgtacgttttgaatcagccattcagtcctccttagatgttgatgccaccgccggagctacgggctacactcagagacttcttaccgccagcgcgtgctttcttacgtgcgctttcggtttgcgcctcatcctcaccctcagccttatcctgttcgggtacatctacaatctgtgctggaggcggcgcagtcactactggtactggagcctcttgttggataatctcctgcttaccagcacccagcgcaccgccaacgactttaccgacttccttacctgccttctcgactggtctactaacttccttcacaactttcttaacggctttcttgattttcttgaagaatcccataatgtgtcccctatgttattactcagttacccaaacgccttggagcgaatggaggatttactcttgttcttggctgcgctgtcatccagctttaccttgagactgctcttaccgctgctctgtgtggttggaacctcagaggaagacacgctggtgtcctcatcgtcatcgcctccccataccacagatttcggtggctcagtcaaaggtgctggttcggcagcgcgaatctggttagtgtccatcttagggactttcaccttcggtttccagcacatataattactcctgtctcagttgctctttacgcacctcaatctcatcaagtgttcgagaggcaaggtacagaccatgcatcacaccagcaatgaaagactcagagtaacccgcagcgcggagcgcacggtactccccggactccatcacataggtctgattgaagcgcacctgtagatactctttagctgcacgaggcatactaggaatatcatcgggatgagttaaaacatgattaattggttgtaacataatttcacctcttaaggttaagtcttaaagtaataatcataaaggctccctcttccctttagtgagggttaatacagagagccttgagtttatcacttaatctcggagtctcgcttcacgtctcggactatgagagtgaacatccagagacctcgcgccagcatacctaccagcacagcgatggttatgtactttgcggcgtccataagtaaatctccttgtcaatgtaattgtattcctcgaagcgaagaatgcgggccatctggccttgcttgatgatttcctgctcggtcatcccagctttggcaccaatggatttaatgcagtcccacagcgtctcagtcgcatcaggagcacgcttcacccacttggttactgtctgccccttgttcttgccggacttcaacacggactccacaggctccacaatgaacgggtcattcaggaaggcttctgccgtatcgccccagccgggaatcccggagtagccatcggtcatatcgcccttgatagtctggaagagatgccaccaatcagcggtctctttggtctgcgtcaagatgttaccagtggtacaccacaggaagtcaacgtccgggatagtcttgaagtccttgtcacaggagaccaacacagccttcttgaagccgaagacctcgtgaccagacccaatgatgcccataacgtcatcaccttcaagcatgtcctctttgatgtgaatgaactcatcgcgctcccacagagcttgaaggaagtcacggtatcccacaggcttacgggtcgccttacggttctccttataggtctcatcaaccagtaccttacgccagttcacatcgtcggtaaacgccagaacaaccatagcgtcactccaagccttcttacgggttcggtacgattcgattgcagaatcgagaatgctccgtgccttggcgtggtcacactcaagagtccaaatgtcgtccccccaatccgtctcaacttcggcagcagccattgactgatataccaaccagtcaccatccatgaccagcactcccttctccacaggcttaccttcacgcatctccgcgaagtctttcaatgtgattaggctcattcgtcatcctccccgtaaaccatctcgactgcatcagagtatccgtcccaattatccacaccacacgccttaagcgcgttcaggaactctaggtctttctccagcttatcaatgtatgcgctaacatcgttccacgcgtcacgggtcatcgttacggtgtcactctttggcataatcatacgcaacctcccattcgtttcaggaagcgcacaccagcggctgtgacctcccatgctccaccattgcgaccacccacagtcaaacagctaatgtgtccacgagaagcggcctcagctacgagagccgcattgtttcgcacatagttcgactgaaaggacttagggcaacctttgatagctgccagaactttcaggtattcactcatcggataacctccactttcgctggggcaaccttgaggatgaactcatcgactgaacgagcacactctttgccaagttcttccttgacgaactcacgaagaccctgtttcagcatctgctcaaaggcaccctccggcccatgagtcagagcggctaccagaatgttgtcgaagtaaggcccacgcttcgggtttttcgccatctctttcagcgtctgcacgaactccgcttcctgctcatcactcagggttgcggtcacgttgaaagttactttgagttgtttgttcatacccataatgtttctcctactgttagtggcagacagcccaattcggccccatcttaccttcggtatctaaacgacaacggaaagcccaatgctctccgacccaacgcatagcctcctgcgcggtgtcaataacaatctgagcgatgtgctctgtacggcaggccacctgaatctcatcgtgaacccaagccatgtacgcaaagtcaccatcccagccatgcttcaagcctttctcaatgagcatctcttcggtcttgataatccacagcttacaaatcagagcaccagcagactgcaacaatgtgttgagcgctgcgtgtggagacctgacgtgaaccttgcgaccatccagacctttaatccaacggcgcttccactgtactttctgctcaccaccaatccaagcggaagacttaacgagagactgttggatagcttctcgcaatgctgcaatcgccggggtgttctctaagaatttcttcttgagttccttcccgcgctccttcccagccccaacaatctgaccaatcttctcatctcctgctccataaaggaacccgtaaatgaaggtcttggcgttgtctcgcgttgggagttccgcagcgttctgattcttggtgtgaatgtcaccgttgagaatctcattcgcatactctccgttatcgaaacgagccatgaagtgcgccagacagcgcaactctaagccactggcgtctatccccgcttgcacccacggcttgccagtaatcccatccaaatgatgttcagcaccaaaagcgctacgacactgctccccgtaaggagaacgaacgccgggtacttgtgcaaggtttgggaaactatgagtagcacgaccagtaactgcaccgttagggttaacggctccatgaatcttaccatcatcttgaacataacgtaaccacgctttgtcaccttctgccgcctgaccgattcgcttctgaatcatcaggtactctttaatcaagtcaatgcacgcctgcttctcagggtcatccactcgtacatgctccaagacctcatcgtccaccacaggcgcacccttctcggtgaacttctcaggaacccatccggcctcctgtagtttcttctgaatgtggtcacggctacttggcttgaacgtaacgaactcgaccggagtatatggagcaccctccatgtaatccctcgtgtccaagtcgcaaggctcaagaccttcgcgctgtgccttattacgaggcttcttgtacacgccaccctgtttcggatagaccacgcgagggtaactcggaagtggtttgcctgtccgtgggtgcttgaagagttccttaccacctttcggttgataccatgagccaaacgtttcggttaactttcgcagaagttcggcgcgtttcgctgccagttctacataaagttcctcaatggccttggtgttgaacgggaagccgttacgctcctgcttcgctaaaagccacgctgcacgatgttcaatatccacagactcaccagcttcacgccagaataaatccgcatcgtacttcgtgaagtccatacccgcagggaagtagtggaggtcactaagtaatttctcgaagagcttgacagtgaccacaacgtcttgaacgttatacgccatcatcggctcgttgaatgaaacccactcggcaccatcaacatattcttcgccctgctcttccagcatagccttgaagtcgtccttgtattcacctttcatctcgcccaagcgataaccccatgcctccagagcgtgagacccgaagcgacgaccgggtagtttcccggaacgaagaagccccatgtctgtgtctttaaggttcgcatgaagtaaacgcgagagtaccaatgtgtcaatacaattctcacggggtaacttgaagtcacgattgagttgcagctttgcgagtttctctaaagccggaacgtcatacttgtgaccgttatggaaaacaataagcccacctcgcttcacctcggcttccagcgcatccagatacgccccgaagtcgcccggacgataactatgatactcaccatcacggtagtcatagataacgccacagtgaaacttggtgactttctctaagaggttgttggcctcaatgtcacttacgagcataatgccctcctttcatttcaggatgaatgataatcataaaggccacccttgggcgaccttgagtttatcacttctcgataatctcttgcataccagcgccgaactctaccagacgctcacggttatcaccgaccaccttgtcagcagccatagtcagggcacccatcaggcgaccgacctgcttgtcatccaaggtcatgcgttgagtgtgtgctttcggagacttgtggtctttccagcggtagaccatcgtgaccttctcaccacgcacattaatgtgtactcggcgggagaactggtcagcggtgtctggcagacggatggtgtttgcgtgggtgattgacttgctcatagtgtgcgctccttactcaaagaatttgctcatggattgtgctttggctgcaatcgctgccgacttgtggatgccattaacagccgcatcggatttctcacgggactgtttcgccaactcaatggctcgctgtgaatcagctttggccttcttgtccagcttcttggcttcgatgaagtacagtttaactaccagcttacctaaagcgttaatgaatttaaacatgatgtgtctcctatggtttaatggttgttcccgttagtgagggttaattagtggtacatgattccatcgcaatcggaatgcccacacgggcatcctttagaagtctgactgtccgtcatgttcagtccagccagtatctccttctccttcttcgccagtgtagctagacggttcaagccacccggtttctctgttgtattccatgtatccagcaattccagtgtcgccagtgaaacgacacttaagcaggcgaaccaacaccaagttaggcatatcaccttgctggttacgctccaaggcgatgatagtatcagaaagctggcgcagggcaccagaaccgcgtaggtcagtaatagaaacagcgcgtccttcttcatgtgcttttcccttatccgggttcttcaagtgacaaatcactacgagcacaacaccagttgacttagcgaaccctttgagcttcgtcatgaggcggtcaatcatcttacgctcatccgattcctcagaggcagacacgacgattgatatgtggtcgagcactataacatcacaccctaagcctgttcgcatgtaggccagcttcgctaacagcctgtcagcttcggcctccgcaaaggagtcataaaggtggaacgtatcgtctccaaatagttcatcataccattcatcgaaacgtccgtcctctgcgatagccttcttgacttcatcagactgacgcagacgaaccttattgttcaagcccatcatgtcctgaatggtatcctcaacggattcctccagcatcgctaggcccacacgtttacccattcgcttgccccaagccagagcctgttgacgaacgaaggttgacttacccataccggaaccggaagtgaccataacgacttcaccgccacgagcacccaaggttctatcgttcaggccttgacagccatcgaataataaacctacagcgtcctcggaggtcatagcttccttaacgcggtctttgagtgacaacgcagagacaacgccatctggcacccaagggttcgcgttccagacctgctccaagattgctttgtcttcacccatgatgtgacactcgttggcgtccttacacggcaacacggcaacacgaaccttaccagccgggagaacctgtgcggcctcttcgactgccttacggcctgcgtcatccatgtcgaacatcaagataatctgctcgaactggtcaaagtattcatagttagcggcgcatgtcttcttagcagcagaggcaccgtgacccaatgatacgaccgggtacttacagtcttggagttccatcacagtgagcgcatcaatttcgccctcagtgaccacaattttcttaccgccagaccagaggtgcttcaagaacaacgcatcgctcttgtggcttccggtggtcttaaagttcttgtccttatcgcgcaccttctgtgacacgatggagccgttctggtctctgtagtcggcaacctgatacattcggttgtccactttcgccagccagtagccagccttttggcacgtctccttagagatgccacgggcagtcaggtcagagtatcgaccgttgctgtcaccgaaattccatacgtcatagctcataggcttgctgcctcctgtacgtcttctcgttgataactttgcttcacgctcttcgtttgcgggtactcgatgttcacacacgaagcaccattcatgcccgtcagagtacacagagttaccatcagaagacccacagttttcacatggagcatgaaacagaaagatactatcgtcttctcgttccattgtacattccttaatcagttgcgagaacaaagggaaaccgttaagtctccctttagtgagtgttaattattcctcggtgtgttcctccgccttgattgggtctttgcactgacactgacgtgacggtacacgactcttcaacggcttatcacagcgaatacaaatcatcctcatggtatcaccctcggtcagatgtaaccagttcgttcttctcccaccagcgcttcaagtcgaaggacgggcaggctttgggtgcaacgtcatggtgagcacgaaggattgaaccctcatacttcgccagcagcgtgaccagcagactacgcagcgcttgcatttgcgcaggtgtaaagttggcgtcgaacttacctttatcatcaatcccacccacgaggcatacgcctacggagttgtggttgtaacctttcacgtgggaacctacagccagttcatcgcggcccgcttccacagtgccatcacgcttaatgatgaagtgatatcctacgtctaaccagccctgctctttgtgccactgacgaatctcacgaacgccaatgttctggcttggcttggttgctgagcaatgcacaaagattgcctccgtggttgctcgtggtttgaattgaactttagccatttttctttactcctttcttagtcttaaatttatcgaacggaacctccttcttgggttctttgagccactccaccggaattagcttgtcagcaaacagaatgccatgcttctcgcaccactcaccgtagcttgttgggctacccttgtagagctttgagcggctgcttgagaagaccaagcgaatgtccagttcagggtattgctcacgaatcaaaaggtgtttcttgcggtcatcggaatcccacagccctttggtctcaatgaagataccgttaggtagcaggaagtctggagtgtataagtggtcactcgcagggatgacgtaagggattctccaaagttcataatcgaacttaatgcccttactctcaagctgctttgagactttatcttctaggccggagcggaaagccccgaccttgcgtacacctcgcgcagcgtatgcgccagccattagaagtcctcgtcatcatccggggtttcttcgtgctcgtcttcctgccactcctgctcatcgcgggactgacgggattcactcgcagtgtaaccaccatcttcgacttcatcggcccactcatcttcactgccaccaccgaaggtagccagttcgaccagcatcacggattccagttgcagcttgacgcttgcgcccacagcggtgttccacttgtaaggaaccagagagtatttcactttcagcttagagccaccaccgataatcggaacgtcctgaatcttcttgcccttgctatcgaccacgaccagattgatgtgtttggtctctttggtcttcttgtcttggaaagacgcatagcatttgaacttgaaggtagtcgtaccgtcaccgttatcgaagaacggcatgtcgccctcgtaaggtttcagtggtttcttaccacgctgtacctgcggcgggttagcctcgaactcttccacggcagcagcataagcctcttcgtgagtcttcacgatttcatcgaccatcgcctgacagcgcgggtctttattggaaagagtcaggtctaccttatagataccacgagggttgccgaagccgcgctcttcgttgccataatccggcttactcaggtaagcataaggctcagcagtgccaagaccagaggtgtagattttcttcttgaaaccagccatagtatttctcctttggttgatagtttgggttgttccctttagtgagggtaattaggctttcacttctggacggattcgagtaactacgaaccctgcgtcctcgtaatgttcagcctgtagcgttgcctcttcgagagaccgggcgaataccggaatctcaaaggactcggtgttaccttccattgtcagaaggtatttctgttctgagtacatgcagcgatttgcacaggagtggttctccatccctacgtccttcgcgtactggcacccgttgttacattggctcatttattggcctccttaaagcgccgctcccacagcgcgtatagttgttggtatgcgttggcagcagcctcatcaccagcctcgatagcttggttccacttagcggcacaccaatcgcagcattcacgaagcgtcataacacagcccccggtgtttgtcaaagagttcctgatagaatgcagctttcttgaggtctttctccatagttgccagttcggatttcttgccagcacgcaggcgatacttaaggatgttccctaagcagtacccacggaacgcctcaacggtcatcgaccgggcgataacctcaatggcttccacgttgtcgaacagcatatagtggttcggatgggtcacgtcagacttgacttccttcggtgcttccacgttcggagtcttaacgccagctttcggtagcggaatcaggttgtgcggaagaacctcagcgtgctgagtaccgaagcgaaccttaacgcggcctgtgtgcgagtaaccagtgaccactccgctcatacccaagatgcgcttgagaccaccgccggagtatcgcacaacagagttaaccgggaagcgagcctctaagtctggtttgttccaatgatgttgtagcattacagtacctccttaatccacttgaagaacagacgaacgcgaggccagtaagtgaccacggcttccagatgcggacgctctttgttcatcgccttgacgaactcaccgcgagtaatcagcaggtgaacacaaggtgacagcgtagcgactgagccaatcagaggcagcttagcgttgcgctcagaggccagcacagttgagcggtctttacggcgaaccgaaaagataccattggatttgttgaagtgtaaacgcatggtgttatctccttaacaatcaggccaaatgttgtcgtcggcagcaattaatcccagcgttgcgacgatagcgaataggataagccacatgacgtgtgtctcctgttagtgagggttaataggcggcaacgcccggaacgcagaaaggcccacccgttaaggtgagccagtgcgcggttacattttctcttgagggttgtcctcagtgcctcggaacttctcgaagctagggtgacgcagggagccgtcaggggtttcttccatgtagttgacctgacaggcccacccattgtagaagtcttcaccgtgggctttaacgttggctgtgaactcgtccatcagtgcgcgagagatgttgttggcgtctactaaacgaccagtctcaagaagcacactaaagcctatcactttaccctcgttggctaacccttcggttccccaattgacaccctgaatgataccatcagcttcacactcaggcttgagcttccaccagccagacttcttgcctcgcttgtagatgccttgcgggtctttcacgatgagaccctcgtgaccttcggcacgcttctcttcgtacagttcagtcagcgaatccatatcgtagacctcgtaggtctcagcgataagccactcgatttccgggaagtattcaaccagaagagagcgcatggcttccacatgatatggcatcaggaggttatgcacatcgtagtcctcgccagactcagcaatgtgaattggcatgaccgcatacaggcgcacactcaggcgcttagggtctaactcaaaggcggtgcgaacccgtttagctactcccaccttacgtggcttgagcatgtctggtgtgaccattacgttatggaactcggcgttatccttcttgagccacttggtacgcagcaggccagacccggtgttgaagtctacacctttgaccatcagttcgccatccagcatgaagccatccgggaagatgcagcggtcatcgttcagtagttgctgccagcgcttatcgaatccgttcaggtgttctagcgccgggataaacttggacacacgggacagccatgcagcctcagccacgttgtcaaccacgatgttaccgcgcacaccatcgtacttaatgtccgcaatcaggtagccggaggtctccagcgctttcttaacggcagactctacgaatgacacagctttgaatgggttggtattgaagatgttcatacggttgttcctcattggttgaaagttaatcagttcgaatcacaaaggccactcgttaaagtgaccttgaggattctcctgttagtgagggttattacttccagtgtttcaaatcgctgtgaaccctacggagccatgcagtctgcgcgttgatttgtacatcactgtcgctgtgctcgaaggttctggatgccaccggatgcccggagcgtgtgaacacacggagaacctcacccgatgacctgcacatcttcgctgggttttcatatctgaatgactccaccttcacggtcacgtcatggtcttcctgtagacgtgctaccgcgtctttgtaatcgttcaggttgccgctatagatacgtcccatcattagttccactcccgtttctgtgagttaccgcgctgttgtttgtggcgtttcttcatgcggtcacggcgctcttgccactgttcgccatgctcgttgaccactgaatcgcgcttggtaaatttctcaaagttggtacgcatagtatcttacctcatgttgatgtgtattgaaagttaatcacaaaggccacccgcttggacgaccttgaggctaactctcctgttagtgagtgttaactgtatgtccgttcgatacgaccacacgttgaacctttcgggtagtagaaggatttcatttcgttgtcctcagtggtctggaagatgaccatcccggaggacgttgagtaacattccaacttcgtgaccaccttaccgcacggccctaagcctagcttaaattcagtcttgcggaggtcatcgctaccgggcatccaagcgtagaacttaacggaagtcaagcggtttgacttaaagatgttcttaaagaaagtcttaatgttaatcataaatttaatctcttagtacctaaagtgtcttaaagtgggagaccttaagtagtctcccgttagtgagggttaatgctaagtgcttgttatgcaaaggcaaagtcagacttgagaatgtcttgcaggttcaggtttcctttcttcggaagtggaggcatcttgtccagttgggtctcgtgcaactggtctgcaaactggtcatagaagtctgccagcacatcgttgttctcgtaggtgatgaccatcgtttcacgcacagccttgaacagcttgccagcgtctgccgggatagtcccgaagctatcgtgaatcagcgcaaaggactcaatgccgtacttctcgtgagcataaacgactgtcatgcggaggtggctaccgtcctgtgagtgaacaaagttaggagcgatgccagactcctgcttgtgtgcgtcaatgcctgaatccttgagggtattaatcgtcggttgcagacggaattgccctaagaaaatcatatcgagacgcttctggagtggcttgcggtattcctgccataccgggaagccgtccggcgtagtccagtgaaccgcgcaacggtggcgcagaatctccttggtcttcttgtccttgacctcagcagccagcagcttagcggcagacttgagccagttcatcgcctcaaccgctgcgactacggtcacactcaccgcgtcccaaatcagcttagccatatagccagccgcttggttaggttgggtgaacatcaagcccttaccgctgtcaatcgcaggctgaatggtgtcgtccagtacctgttgacgaaagccgaactccttggaaccgtaagccagcgtcatgaccgaacgtttagttacgctacgggttacaccgtatgccagccactgttgcgccagcgttgaggttcccagcttgagcttctctgagatttccccggtgtccttgtcggtcacggtaatcatctcgttaggtgtgccgtttattgcatcctgtttgagaatctcgtttactttctgcgcaactatgccgtaaatgtcctgcacggtttcgcttggcagcaggttaacagcacgaccgcctacctcatcgcgtagcatcgcggagaagtgctggataccagagcaagacccgtcgaacgccagcggcagggagcaattgtagctcagaccgtggtgcgcaacgcctgcatactcgaagcaaaacgcgaggaaacagaaaggtgaatcctgctcggcccaccaagtgttattgattgggtctttagcgcaagccagaatgtcgtctacgtgcttctcaatgaacgcgatgcgctcagggaaaggaaccttatcgacacccgcacagttcgcaccgtggattttcagccagtagaaaccttcctcaccgattggcttgcctttagcgagggtcaacagacctttcgtcatgtcgttgccttgtgggttgaacatcggcacagcgtacacacgaccgcgccagtccatgttgtaagggaaccatattgctttcttgcttgcgaacttgttggcctgctccaacatgaactctaagctgatacggcgagacactcgtgccttgtccaagcggtagataccagcggcggctttcttccactccttgagtgctgcctcgttggtgtcaatgtcgtccggcttaggcggtaactcttggcgctccagcgatggaatgtctgcgaccgggcaattcttccagttaacaatctcattgacaaccgcaagaactttcttgttgattttccatgcggtgttttgcgcgatgttcacagccttgtagacttctggcatgtaaacgtcttcgtaacgcatcaagcccttcttagagtgagtgcgaacgagtgccaaaggtctgcgaccgttagcccaatagccgcccccggtgattgctacccaaggtttcggcggtacgacacatggctggaacatcggagagatacccgccagagcgcctgcacgcttcgctaatacgtccacgtactcttgggccagttgtagtgcctcatggtcagagcctgcgttacctgcgttgtggcgctgtagttccaccagacccgtggattcaatcagcatttcaatcaggcgaatccctacgtgcatcgtggtttctttatcccagctagaccacgcctcaccaccaagcagaccgcgaccaatcatatcggcctcgaccacctgcataaaggctttcttgtagacttgcccgtggcgcttgttaagctgttcctcaacgtgcttcttgaagtgcttcgcttcgaggtcacggatgcgaccgaaacgtgcctcgtcctcaatggctttccccagcataccagcagcggcctgaatggttgtcatgttcgtgctggtcagtgacgcaaggatgaccttgagtgtgataaacgcggacgcctccggcttgagtaactggagtggcgcataggctacaggcttgcggcctttcttcgatgcgtactcttcgagccactcgacgatacgtgtggttaacttagggagaagcgtagctagtaacggcttagcggctgcgttgtctgcaatctcaccagctttcgcttgacgctcaagcatcttgaggaagcggcgctcgcctagctcataagactcatgttctaaagccagttgttcacgagccaatgcgctgccgtagtggtcagccagtgtgttgaacgggatagcagccagttcgatttcggagaagtcattcttttcgatgttttcgatgatgttcattgcttacctcattgtgaataaatcgtacctattcaggccaccgattgatgacctgtaagataagactctatcagccttgtagacgcttgtcaaggtatgcgtctatgtgtaacggtttgccccactgaatgcgcacctcgtcgtgcatcatcattgccgcagcagcgtggcgctccagttctgcaaagtttaggttattgtggtgcatccaagcgttgcgccagtgcttatcgccccacaccatacgcgccctaggctcatccctgcgattctgattggcgtccatgcgcatcttagcgagtaccttagcgtcacgtttagcacgcttagaggcctttctgcgccatttggcacgggctttacgtgctacctgaaagtctcctttagggtcacggcgtgccttgcgtgccttacagcggtcaatcgcttcctgcgctctcagcgcctcaatctcagcgatgagttcatccgggtcacagtggaactcacccggctttaacttgtcgtctgcgctgaacgataccgggtctgtgataatcaagcggcccatttggtctttcatcatgttaccgctgtgacagtcgaacgatgcgatgcctaagaagaacttgcggatatccttgcaggtctcaatgaacccgtcacttattgggtactcttcggcggtgtcgaagcaatcctcctcaatgatttcccgtgcagcccgaaagtggtgacgaatcttatcgctttcaccgtagcaccaatcgttaagcggtgtcagatagtccaagaccaccgtgtagcagcccgtatgacgctgaatgtcgtacaccgtagggatgccctcacgaccctgattcatgcggcagaaggcagcataggcagcgcctgagtcctctttcttaaagcctaccttgataaccttgcccggtaacaatgcgtgctcatatgctgcgctaaagtgaccgttgcccagcttgatgaaaccaacatcacgcatacgctccgccagtgtctgccagtagtccatagactccaagccccaattgcctttggcctgcgtcagttcgccgtcttgagtctcatcgttcacgatagcagccgcaagagccaccagcattggctggcgttcgttcaggcgctcaatcggtaggttgcggatagcttcgagtgcggcttgtgcttcggtgaaagtcatcgttcagtgtcctgttatctgtaagaagagtaaagagtaaattcagcccatttgacagcgcttgcagcctgtcgtgcggtcatcttgcggtgtctcgttaagatgcgtttgaccttgcgtttcgatgcaccatacgccatagcatacaatgcaatctttacgtgctttgagttagtgcgtagcaatgtagaatactcctaccttgttggccttaaagcgtccgttacgttcacgaaccgtaaaccgtgggatgaatccccacttaaagtagctcagtgttgctttatggactaccagaccgtgcttaaagtctcgcataaagtacatagcgatgcacagatagaccagtgcgataaagagaatcatcatgcgtgtttcaccagttcgatagcctcgtggcctcgcccttctgcgtccaagtgttccatgagtttaaccatcttgcgatgatagcgagcggccttgcgtgactcagagtaccagccagcgaccgcaaagagtgcgacagcgataaagataaccattgctaatcctcctgtaatgtcaatcattccagccagcgcatgttgcttggtgtatcacacaggcttgataatcctcttgtgctaaaatcgggtttacccaatgtgtgacctgtttgccgtagcgcacaacgtaggtgcatcccattgacccgtggtaatactcacgcagcgttacagtgcattggcccttgattttagatgttgccagaagtttactcatacagtcacctcccatacagccgtaccattaggtaaacgcttgccgaagccttgttggtctctgaagcgtgcacgggcgtccctttcgttgtacccgtagcaggtcattgagtagcaccagccgggaataaggatggagtatcgtttcatggtgttagtcctatagcgtgctaagtgataatcataaaggccacacatacagtgcgaccttgagtctatcacttattgtacttgccagcggcgtccgaactcatcaatcgtgaagcagccttgcagcggtgcgcctttgggcacttcttggaagctacccggcagacgttcagccttatacccgtcgatgcctttagcgtacaccagaccagccgtgtgagtctgtgatttgtataccagtacgcaatcttgctcccactcattgcaagctaagcgtgcaacattgagtgcctgcgccttgtccttgcagcgtacacgaaccgttttttcctcagtcggtgcgcttgcgattgcctcacgatagcacccggtcaaatcggttgactcaacggagccataaagacccggtgcggcacgtaaagtgcttaccatgtggcggtggcgactcatgttcacctcatcatcaaggtttgaacggaaagctgacaccagtacatagaagacgttagcaggctctttagtgaaaatcatttggtgttacctcatgttagttcgtgttaagtgaatatcataaaggccacgctttcagtgcgaccttgagttattcgcttatacatcggtacactcaagagctattatccagattgttaaagagcgtgtcggtctggtttcgttagaccctagcggctttcagtgtcccgcctcactgttccgtcatttcgtggtacatcgtaccgtgcttacttcatgttgtcaaccattttgtttcgctttatgtgccgtggtgcgcttaagtcacctagaagacaccttgtgtccggttgacgctgtgtatcttactgcgtttacttcatgttgtcaatgcctgtttttcgtatgacttatcaggctgtctacttatccggttgactccggtatctcagggagtggctttaaggccgttgtcccgttgacgagatgaataatagccttaagggttacttaaagtcaaccattaattttaatcttttattaaa

SEQ ID NO: 150 - DNA, 39348 bp, Unknown
  source: /note="Description of Unknown: KP2-5 Bacteriophage Sequence"
atcacctaaagagcgacgctatcttaaagacaaccataccgatagacccactgttaacctgtagtgatgccttgtagttgtctatggtgtctatcgtcaattcaattaccctcactaaagggaataagggatacttaaagagggaattagggatttaataaaaagattaaattaatggttgactttaagtaacccttaaggctattattcatctcgtcaacgggacaacggccttaaagccactccctgagataccggagtcaaccggataagtagacagcctgataagtcatacgaaaaacaggcattgacaacatgaagtaaacgcagtaagatgcacaacataacgtcaaccgccaatcggtgtcttctaggtgacttaagcgcaccacggcacataaagcgaaacaaaatggttgacaacatgaagtaaacacggtacgatgtaccacattgaaacgacagtgaggcgggacactgaaagccgctagggtctaacgaaaccagaccgacacgctctttaacaatctggataatagctcttgagtgtaccgatgtataagcgaataactcaaggtcgcactaaaagcgtggcctttatgatattcacttaacacgaactaacatgaggtaacaccaaatgattttcactaaagagcctgctaacgtcttctatgtactggtgtcagctttccgttccaacctcgatgatggggtgaatatgagtcgccaccgccacatggttagcactttacgtgccgcaccgggtctttatggctccgttgagtcaaccgatttgaccgggtgctatcgtgaggcaatcgcaagcgcaccgactgaggaaaaaacggttcgtgtacgctgcaaggacaaggcgcaggcactcaatgttgcacgcttagcttgcaatgagtgggagcaagattgcgtactggtatacaaatcacagactcacactgctggtctggtgtacgctaaaggaatcgacgggtataaggctgaacgtctgccgggtagcttccaagaggttcctaaaggcgcaccgctgcaaggctgcttcacgattgacgagttcggtcgccgctggcaggtggcctaacatgaatcgttattacatcaacgtaccgggctggggtggttctctaacctgctacggatacaacgaacgggacgcacggaaacgttttagagaacaacacggcttcggaaggcttcctaatgggacgcgcctatggctggacgcccgtgattggtaagtgatagactcaaggtcgcactgtatgtgtggcctttatgattatcacttataggactaacatcatgagtaaacttctggcaacatctaaaatagaaggccaatgcaccgtaacactgcgtgagtattaccacgggtcaatgggaagcacctatgttgtgcgatacggtaaacaggtcacacattgggtaaacccgattttagcacaagaggattatcaagcctgtgtgatacaccaagcaacatgtgcgggctggaatgattgacattacaggaggattagcaatggttatatttatcactatcgcactctttgcggtcgcgggctggtactctgagtcacgcaaggccgctcgctatcatcgcaagatggttaaactcatggaacacttggacgcagaagggcgaggccgcgaggctatcgaactggtgaaacacgcatgatgattctctttatcgcactggtctatctgtgcatcgctatgtactttatgcgagacttcaagcgcggtctggtagtccataaggcaacgctgagttactttaagtggggattcatcccacggtttacggttcgtgaacgtaacggacgctttaaggccaacaaggtaggagtattctacattgctacgcactaactcaaagcacgtaaagattgcactgtatgcgatggcttatggtgcatcgaaacgcaaggtcaaacgcatcttaacgagacaccgcaagatgaccgcacgacaggctgcaagcgctgtcaaatgggctgaatttactctttactcttcttacagataacaggacactgaacgatgactttcaccgaagcacaagccgcactcgaagctatccgcaacctaccgattgagcgcctgaacgaacgccagcccatgctggtggctcttgcggctgctatcgtgaacgctgagactcaagacggcgaactgacgcaggccaagggcaattggggtctggagtcgatggactactggcagacactggcggagcgtatgcgtgatgttggtttcgtcaagctgggcaacggtcactttagcgcagcctatgaacacgcactgctaccgggtaaggtaatcaaggtaggctttaagaaagaggactcaggcgctgcctatgctgccttctgccgcatgaatcagggtcgtgagggcatccctacggtgtacgacattcagcgtcatacaggctgctacacggtggtcttggactatctggcaccgcttaacgattggtgctacggtgaaagcgataagattcgccaccactttcaggctgcacgggaaatcattgaggaggattgcttcgataccgccgaagagtacccgataagcgagggcttcattgagacctgcaaggatatccgcaagttcttcttaggcatcgcatcgttcgattgtcacagcgataacatgatgaaagaccagatgggacgcctgattatcgcagacccggtatcattcagcgcagacgacaagttaaagccgggtgagttccactgtgacccggatgaactaatcgccgagattgaggcgctgagagcgcaggaagcgattgaccgctgtaaggcacgcaaggcacgacgtgaccctaacggaacctttcaggcagcacgtaaagcgcgcatcaagtggcgcagaaaggcctctaagcgtgctaaacgtgacgctaaggtactcgctaagatgagcatggacgccaatcagaatcgcagggatgagcctagggcgcgtatggtgtggggcgataagcactggcgcaacgcttggatgcaccacaataacctaaactttgcagaactggagcgccgcgctgctgcggcaatgatgatgcacgatgaggtgcgcattcagtggggcaaaccgttacacatagacgcataccttgacaagcgtctacaaggttgatagagtcttatcttacaggtcatcaaacggtggcctgaataggtacgatttattcacaatgaggtaagcaatgaacatcatcgaaaacatcgaaaagaatgacttctccgaaatcgaactggctactatcccgttcaacacactggcagaccactacggtagcgcattggctcgtgaacaactggctttagagcatgagtcttatgagctaggcgagcgccgcttcctcaagatgcttgagcgtcaagcgaaagctggtgagattgcagacaacgcagccgctaagccattactcgctacgcttctccctaagttaaccgcacgcatcgttgagtggctcgaagagtacgcctcgaagaaaggccgcaagccagtagcctatgcgccactccagttactcaagccggaggcgtccgcgtttatcacactcaaggtcatccttgcgtcactgaccagcacgaacatgacaaccattcaggccgctgctggtatgctggggaaggccattgaggatgaggcacgtttcgggcgaatccgtgacctcgaagcgaagcacttcaagaagcacgttgaggaacaactcaacaagcgccacgggcaagtctacaagaaagcctttatgcaggtggttgaggcagacatgattggtcgcgggctgctgggaggcgaggcgtggtctagctgggacaaggaaaccacgatgcacgtagggattcgcctgattgaaatgctgattgaatccacgggtctggtggaattacagcgccacaacgcaggcaacgcaggctctgaccatgaggcactgcaactggcccaagagtacgtcgatgtgttagcgaagcgtgcaggagcactggctggcatctctccgatgttccaaccgtgtgtcgtaccgccgaaaccttgggtatcaatcacaggtggcggctattgggcgaacggtcgcagacctttggcgctcattcgcactcactctaagaagggactgatgcgctatgaggatgtttacatgccagaagtatacaaggcggtcaacatcgcacagaacaccgcatggaaaatcaacaagaaagtcctcgcggttgtcaacgagattgtgaactggaagaactgcccggtagcagacattccatctctggagcgccaagagttaccgcctaagccggacgacattgacaccaacgaggcagcactcaaggagtggaagaaagccgctgctggtgtctaccgcttggataaggcacgagtgtctcgccgtattagcttagagttcatgctggagcaggccaacaagtttacaaacaagaaagcaatctggttcccttacaacatggactggcgcggtcgtgtgtacgctgtgccgatgttcaacccgcagggcaacgacatgacgaaaggtctgctgaccctcgctaaaggaaagccaatcggtgaggaaggtttctactggctgaaaatccacggtgcgaactgtgcgggtgtcgataaggttcctttccctgagcgcatcgcgttcattgagaagcacgtagacgacattctggcttgcgctaaagacccaatcaataacacttggtgggccgagcaggattcaccgttctgtttcctcgcgttttgcttcgagtatgcaggcgttgcgcaccacggtctgagctacaattgctctctgccgctggcgttcgacgggtcttgctctggtatccagcacttctccgcgatgctccgcgatgaggtaggcggtcgtgcggttaacctgctgccaagcgaaaccgtgcaggacatttacggaatcgttgcacagaaagtaaacgagattctcaaacaggatgcaatcaacggcacacctaacgagatgattaccgtgaccgacaaggacaccggggaaatctcagagaagctcaagctgggaacctcaacgctggcgcaacagtggctggcatacggtgtgacccgtagcgtaactaaacgttcggtcatgacgctggcttacggttccaaggagttcggctttcgtcaacaggtactggacgacaccattcagcctgcgattgacagcggtaagggcttgatgttcacccaacctaaccaagcggctggctatatggctaagctgatttgggacgcggtgagcgtgaccgtagtcgcagcggttgaggcgatgaactggctcaagtctgccgccaagctgctggctgctgaggtcaaggacaagaagaccaaggagattctacgccaccgttgcgcggttcactggactacgccggacggcttcccggtctggcaggaataccgcaagccactccagaagcgtctcgatatgattttcttagggcaattccgtctgcaaccgacgattaataccctcaaggattcaggcattgacgcgcacaaacaggagtctggcatcgctcctaactttgttcactcacaggacggtagtcacctccgcatgacagtcgtttatgctcacgagaagtacggcattgagtcctttgcgctgattcacgatagcttcgggactatcccggcagacgctggcaagctgttcaaggctgtgcgtgaaacgatggtcattacttacgagaacaacgatgtgctggcagacttctatgaccagtttgcagaccagttgcacgagacccaactggacaagatgcctccacttccgaagaaaggaaacctgaacctgcaagacattctcaagtctgactttgcctttgcataacaagcacttagcattaaccctcactaacgggagactacttaaggtctcccactttaagacactttaggtactaagagattaaatttatgattaacattaagactttctttaagaacatctttaagttaaaccgcttgacttccgttaagttctacgcttggatgcccggtagtgatgacctccgcaagactgaatttaagctaggcttagggccgtgcggtaaggtggtcaagaagttggaatgttactcaacgtcctccgggatggtcatcttccagaccactgaggacaacgaaacgaaatccttctactacccgaaaggttcaacgtgtggtcgtatcgaacggacatacagttaaccctcactaacgggagagttagacttaaggtcatcaacaacggtggcctttgtgattaactttcaatacacatcaacatgaggtaagatactatgcgtaccaactttgagaaatttaccaagcgcgattcagtggtcaacgagcatggcgaacagtggcaagagcgccgtgaccgcatgaagaaacgccacaagcaacagcgcggtaactcacagaaacgggagtggaactaatgatgggacgtatctatagcggcaacctgaacgattacaaagatgcggtagcgcgtctacaggaagaccatgacgtgaccgtgaaggtggagccgttcagctatgaaaacccagcgaagatgtgcaggtcatccggtgaggttctccgtgtgttcacacgctccgggcatccggtggcatccagaaccttcgagcacagcgacagcgatgtacaaatcaacgcgcagactgcatggctccgcaaggttcacagcgatttgaaacactggaagtaataaccctcactaacaggagaaacgaaatgagagatatcgaacggttcaacgcaaagactgaaccttgcggcgactgtctacgttggactggtcgaatccagcctaacggttacggacagtttcgcctcgaaggtaaaacacaatacgcacatcgagcagcttacaagctgtttatcggtgaattggacaataaagatacagtcctccactcgtgcgataacaggtggtgtgtgaaccctgagcatttgaccaagggaacgcaggccgataacctgaaagatatggcgataaaaggtaggcaccacgccattaagattccgaacgatgccatcgcgggcatccgtaaagaccctcgctctgctactgtgatagcggctgagtggggcgtccatccaacaaccatccataagattaagtgaaacatcaacaggagattcgtatgaacattttcaagaccgcgccatataaagccgtatcatttgtagagtctgccgtgaagaaagcacttgacaatgctggttatttgatttgcgattgcaaatatgatggtgttcgcggtaacatcgtggttgacaacgtggctgaggctgcatggctgtcccgtgtaggtaagctgattccggcgctggaacatctgaacggtttcgataagcgctggcagcgactactgaacgatgaccgctgcattttccctgatggcttcatgctggatggtgaactgatggtcaaaggcgtagacttcaacacagggtctggcctgctgcgtaccaagtggctcaagaagaacaacttcatgtttgaccgtggtggtgttgagccgctgaaaggttccaaagtagcctttgagttagaccctaagcgcctgagtgtgcgcctgtatgctgtcatgccgattcacattgcggagtctggcgaggactacgatgtacagaacctgctgatgccgtaccatgtggaagccatgcgctctcttctggttgaatacttcccggaaatcgagtggcttatcgctgagacctacgaggtctacgatatggattcgctgactgaactgtacgaagagaagcgtgccgaaggtcacgagggtctcattgtgaaagacccgcagggcatctataagcgaggcaagaagtctggctggtggaagctcaagcctgagtgtgaagctgatggtatcattcagggtgtcaattggggaaccgaaggtttagccaacgagggtaaagtgataggctttagtgtgcttcttgagactggtcgtttagtagacgccaacaacatctctcgcgcactgatggacgagttcacagccaacgttaaagcccacggtgaagacttctacaacgggtgggcctgtcaggtcaactatatggaagagaccccggacggctccctgcgtcaccctagcttcgagaagttccgaggcactgaggacaacccaaaggagaaaatgtaatgcttatctttgatgagaacggttggagggtgtaccaacacccacacctgatgatattccacatatcaaagtggatggaaggagatgaccggagaagctacggtagaacttgggactactttactgtctatgagtgtcatagtattaaggaagtcgaggagtacctacgaaacaatatgtaaacacactggctcaccgaaaggtgggcctttcttcgttccgggggaattaaccctcactaacaggagacacacaccatgtggcttatcctattcgctatcgtcgcaacgctgggattaatggctgccgacgacaacatttggcctgattgttaaggagataacatcatgcgtttacacttcaacaaatccaacggtatcttttcggttcgccgtaaagaccgctcgaccgtattggcctctaagcgcaacgctaagctgcctctgattggctcagtcgctacgctgtcaccttgtgttcacctgctgattactcgcggtgagttcatcaaggcgatgaacaaagagcgtccgcatctggaagccgtggtcacttactggcctcgcgttcgtctgttcttcaagtggattaaggaggtgctgtaatgttacaacatcattggaacaaaccagacttagaggctcgcttcccggttaactctgtggtgcgatactccggcggtggcctcaagcgcatcttagggatgagtggagtggtaactggtcactcgcacacaggtcgcgttaaggttcgcttcggtactcagcacgctgaggttcttccgaacaacctgattccgctaccgaaagctggcgttaagactccgaacgttgaagctcagaagcctgagtctaagtctgacgtgacccatccgaaccactacatgctgttcgacaacgtggaagccattgaggttatcgcccggtcaatgaccgtcgaggcgttccgtgggtactgccttgggaacatccttaagtatcgcctgcgtgctggcaagaaatccgaactggcaactatggagaaagacctcaagaaagctgcattctatcaggaactctttgacaaacaccgggggctgtgttatgacgcttcgtgaatgctgcgattggtgtgccgctaagtggaaccaagctattgaggatggtgacaaggtggctgctgacgcttaccaacaactgtacgcgctgtgggagcggcgctttaaggaggccaataaatgagccagtgtaacaacgggtgccagtacgcgaaggatgtagggatggagaaccactcctgcgcaaatcgctgcatgtactcagaacagaaataccttctaacgattgaaggtaacaccgagtcctttgagattccggtattcgcccggtctctcgaagaggcaacgctacaggctgaacattacgaggacgcagggttcgtagttactcgaatccgtccagaagtgaaagcctaattaccctcactaaagggaacaaccaaaactatcaaccaaaggagaaatactatggctggtttcaagaagaaaatctacacctccggtcttggcactgctgagccttatgcttacctgagtaagccggattatggcaacgaagagcgtggcttcggcaaccctcgtggtatctataaggtagacctgactctttccaataaagacccgcgctgtcaggcgatggtcgatgaaatcgtgaagactcacgaagaggcttatgctgctgccgtggaagagttcgaggctaacccgccgcaggtacagcgtggtaagaaaccactgaaaccttacgagggcgacatgccgttcttcgataacggtgacggtacgactaccttcaagttcaaatgctatgcgtctttccaagacaagaagaccaaagagaccaaacacatcaatctggtcgtggtcgatagcaagggcaagaagattcaggacgttccgattatcggtggtggctctaagctgaaagtgaaatactctctggtgccttacaagtggaacaccgctgtgggcgcaagcgtcaagctgcaactggaatccgtgatgctggtcgaactggctaccttcggtggtggcagtgaagatgagtgggccgatgaagtcgaagatggtggttacactgcgagtgaatcccgtcagtcccgcgatgagcaggagtggcaggaagacgagcacgaagaaaccccggatgatgacgaggacttctaatggctggcgcatacgctgcgcgaggtgtacgcaaggtcggggctttccgctccggcctagaagataaagtctcaaagcagcttgagagtaagggcattaagttcgattatgaactttggagaatcccttacgtcatccctgcgagtgaccacttatacactccagacttcctgctacctaacggtatcttcattgagaccaaagggctgtgggattccgatgaccgcaagaaacaccttttgattcgtgagcaataccctgaactggacattcgcttggtcttctcaagcagccgctcaaagctctacaagggtagcccaacaagctacggtgagtggtgcgagaagcatggcattctgtttgctgacaagctaattccggtggagtggctcaaagaacccaagaaggaggttccgttcgataaatttaagactaagaaaggagtaaagaaaaatggctaaagttcaattcaaaccacgagcaaccacggaggcaatctttgtgcattgctcagcaaccaagccaagccagaacattggcgttcgtgagattcgtcagtggcacaaagagcagggctggttagacgtaggatatcacttcatcattaagcgtgatggcactgtggaagcgggccgcgatgaactggctgtaggttcccacgtgaaaggttacaaccacaactccgtaggcgtatgcctcgtgggtgggattgatgataaaggtaagttcgacgccaactttacacctgcgcaaatgcaagcgctgcgtagtctgctggtcacgctgctggcgaagtatgagggttcaatccttcgtgctcaccatgacgttgcacccaaagcctgcccgtccttcgacttgaagcgctggtgggagaagaacgaactggttacatctgaccgagggtgataccatgaggatgatttgtattcgctgtgataagccgttgaagagtcgtgtaccgtcacgtcagtgtcagtgcaaagacccaatcaaggcggaggaacacaccgaggaataattaacactcactaaagggagacttaacggtttccctttgttctcgcaactgattaaggaatgtacaatggaacgagaagacgatagtatctttctgtttcatgctccatgtgaaaactgtgggtcttctgatggtaactctgtgtactctgacgggcatgaatggtgcttcgtgtgtgaacatcgagtacccgcaaacgaagagcgtgaagcaaagttatcaacgagaagacgtacaggaggcagcaagcctatgagctatgacgtatggaatttcggtgacagcaacggtcgatactctgacctgactgcccgtggcatctctaaggagacgtgccaaaaggctggctactggctggcgaaagtggacaaccgaatgtatcaggttgccgactacagagaccagaacggctccatcgtgtcacagaaggtgcgcgataaggacaagaactttaagaccaccggaagccacaagagcgatgcgttgttcttgaagcacctctggtctggcggcaagaaaattgtggtcactgagggcgaaattgatgcgctcactgtgatggaactccaagactgtaagtacccggtcgtatcattgggtcacggtgcctctgctgctaagaagacatgcgccgctaactatgaatactttgaccagttcgagcagattatcttgatgttcgacatggatgacgcaggccgtaaggcagtcgaagaggccgcacaggttctcccggctggtaaggttcgtgttgccgtgttgccgtgtaaggacgccaacgagtgtcacatcatgggtgaagacaaagcaatcttggagcaggtctggaacgcaaacccttgggtgcctgatggcgttgtctctgcgttgtcactcaaagaccgcgtcaaggaagctatgacctccgaggacgctgtaggtttattatttgatggctgtcaaggtctgaacgatagaaccttgggtgctcgtggcggtgaagtcgttatggttacttccggttccggcatgggtaagtcaaccttcgttcgtcaacaggctctggcttggggcaagcgaatgggtaaacgtgtgggcctagcgatgctggaggaatccgttgaggataccattcaggacatgatgggcttgaacaataaggttcgtctgcgtcagtctgatgaagtcaagaaggctatcgcagaggacggacgtttcgatgaatggtatgatgaactatttggagacgatacgttccacctttatgactcctttgcggaggccgaagctgacaggctgttagcgaagctggcctacatgcgaacaggcttagggtgtgatgttatagtgctcgaccacatatcaatcgtcgtgtctgcctctgaggaatcggatgagcgtaagatgattgaccgcctcatgacgaagctcaaagggttcgctaagtcaactggtgttgtgctcgtagtgatttgtcacttgaagaacccggataagggaaaagcacatgaagaaggacgcgctgtttctattactgacctacgcggttctggtgccctgcgccagctttctgatactatcatcgccttggagcgtaaccagcaaggtgatatgcctaacttggtgttggttcgcctgcttaagtgtcgtttcactggcgacactggaattgctggatacatggaatacaacagagaaaccgggtggcttgaaccgtctagctacactggcgaagaaggagaaggagatactggctggactgaacatgacggacagtcagacttctaaaggatgcccgtgtgggcattccgattgcgatggaatcatgtaccactaattaaccctcactaacgggaacaaccattaaaccataggagacacatcatgtttaaattcattaacgctttaggtaagctggtagttaaactgtacttcatcgaagccaagaagctggacaagaaggccaaagctgattcacagcgagccattgagttggcgaaacagtcccgtgagaaatccgatgcggctgttaatggcatccacaagtcggcagcgattgcagccaaagcacaatccatgagcaaattctttgagtaaggagtgcacattatgagcaagtcaatcacccacgcaaacaccatccgtcttccagacaccgctgaccagttcgctcgtcgagtacacatcaatgtgcgcggtgagaaggtaacgatggtctaccgctggaaagaccacaagtctccgaaagcacacactcaacgcatgaccttggatgacaagcaggtcggtcgcctgatgggtgccctgactatggctgctgacaaggtggtcggtgataaccgtgagcgtctggtagagttcggcgctggtatgcaagagattatcgagaagtgataaactcaaggtcgcccaagggtggcctttatgattatcatttagcacgaaaccaaaggagggcattatgctcgtaagtgacattgaggccaacaacctcttagagaaagtcaccaagtttcactgtggcgttatctatgactaccgtgatggtgagtatcatagttatcgtccgggcgacttcggggcgtatctggatgcgctggaagccgaggtgaagcgaggtgggcttattgttttccataacggtcacaagtatgacgttccggctttagagaaactcgcaaagctgcaactcaatcgtgacttcaagttaccacgtgagaattgtattgacacattggtactctcgcgtttacttcatgcgaaccttaaagacacagacatggggcttcttcgttccgggaaactacccggtcgtcgcttcgggtctcacgctctggaggcatggggttatcgcttgggcgagatgaaaggtgaatacaaggacgacttcaaggctatgctggaagagcagggcgaagaatatgttgacggtgctgagtgggtttcattcaacgagccgatgatggcgtataacgttcaagacgttgtggtcactgtcaagctcttcgagaaattgctgagtgacctccactacttccctgcgggtatggacttcacgaagtacgatgcggatttattctggcgtgaagctggtgagtctgtggatattgaacatcgtgcagcgtggcttttagcgaagcaggagcgtaacggcttcccattcaacaccaaggcaattgaggaactttatgtagaactggcagcgaaacgcgcagaacttctgcgaaagttaacagaaacgtttggctcgtggtatcaaccgaaaggtggtaaggaactcttcaagcacccacggacaggaaaaccacttccgagttaccctcgcgtggtctatccgaaacagggtggcgtgtacaagaagcctcgtaataaggcacagcgcgaaggtcttgaaccttgcgacttggacacgagggattacatggagggtgctccgtatactccggtcgagttcgttacgttcaagccaagcagccgtgaccacattcagaagaaactacaggaggccggatgggttcctgagaagttcaccgagaagggtgcgcctgtggtggatgatgaggtcttggagcatgtacgagtggatgaccctgagaagcaggcgtgcattgacttgattaaagagtacctgatgatacagaagcgtatcggtcaggcggcagaaggtgacaaagcgtggttacggtatgttcaagatgatggtaagattcatggagccgttaaccctaacggtgcagttactggtcgtgctactcatagtttcccaaaccttgcacaagtacccggcgttcgttctccttacggggagcagtgtcgtagcgcttttggtgctgaacatcatttggatgggattactggcaagccgtgggttcaagcggggatagacgccagtggcttagagttgcgctgtctggcacacttcatggctcgcttcgataacggagagtatgcgaatgagattctcaacggtgacattcacaccaagaaccagaacgctgcggaactcccaacgcgagacaacgccaagaccttcatttacgggttcctttacggagcaggagatgagaagattggtcagattgttggggccgggaaggagcgcgggaaggaactcaagaagaaattcttagagaacaccccggcgattgcagcgctacgagaagctatccaacagtctctcgttaagtcttccgcttggattggcggtgagcagaaagtccagtggaaacgccgttggattaagggtctggatggtcgcaaggttcacgtcaggtctccacacgcagcgctcaacacattgttgcagtctgctggtgctctgatttgtaagctgtggattatcaagaccgaagagatgctcattgagaaaggcttgaagcatggctgggatggtgactttgcgcagatgggatggattcatgatgaagtccagattgcgtgccgaacagaagagatagccaaggtcgtcgtagaggtagctcaagaagctatgcgatgggttggcgaacattggaacttccgttgtcgcttagacacagaaggtaagattggcccgaactgggcggtttgtcactaaggagtatttatgggaggcgtggctacactaaggttccacaagatgccgaccgggtgtgtagtctgcgtttcacataagcgcaatcacgatggctacttccggtacagtatagggtcgtccagaaagggcgagaagaaatgctttatgtttcaccgctgggtttgggaacgacaccgtgggcctataccagaagggtacgagatagaccacttgtgtctgaaccgtgggtgctgcaacgtagaacacttgcagtgcatcccgaagcgtgagcacataatcaaaaccaacaaagagcgcaagctcgtaaaggagaaacattatggcaatgaccaaacactttaaagtaaccttcgacgttaccgctgtgattgacagtgaatccgagaagaatctgaacgagttgctggtagacctagctaagaaggccggggctggcgagaagctgaatccgttcaaacaagaactgcttattcaaggcctgacacacgggccggaaggtgctgctgcgttctgtatcaagcaaggtctccgtgagtttatccgcgatggtcacagtgagttaagctctaccgagcagaagctgatgagattctcgcctgcaactgtgcgcgaggtgttcaaatgagtgaatacctgaaagttctggcagctatcaaaggctgccctaagtcctttcagtcgaactatgtgcgaaacaatgcggctctcgtagctgaggccgcttctcgtggacacattagctgtttgactgttggtggtcgtaatggtggagcgtgggaggtcacatccgctggtgtgcgcttcctgaaaagaatgggaggttgcgtatgattatgcctaagagtgacactgtaacgatgactcgcgatgcgtggaacgatgttagcgcatatattgagttccttgaaggtcgcctagcgaaactgaacgcgctggaggcacacggagttgacaactggtgtggttatgatgatgcaaccgctgaactctttaaggaggacgaatgagcctaatcacactgaaagacttcgctgagatgcgcgaaggcaaaccgatggagaagggtgtgctggtcatggatggtgactggcttgtgtatcagtcgatggctgctgccgaagttgagacggattggggtgatgatatttggactctggagtgtgaccacgctaaggctcgtagcattcttgattctgcaatcgagtcataccgaacccgtaagaaggcttggagtgacgctatggttgttctggcgtataccgacgatgtgaactggcgtaaggtactggttgatgagacctataaggagaaccgcaaggcgacccgtaaacctgtgggctaccgtgacttcttagcgaagctgtgggagcgcgatgagttcattcacatcaaagaggacatgcttgaaggtgatgacgttatgggcatcattgggtctggtcacgaggtcttcggcttcaagaaggctgtgttggtctcctgtgacaaggacttcaagactatcccggacgttgacttcctgtggtgtaccactggcaacatcttgacgcagacaaaagagaccgctgattggtggcatctcttccagactatcaaaggtgatatgaccgatggctactccgggattcccggctggggcgatacggcagaaggtttcctgaatgacccgttcattgttgagcctgtagagtccgtgttgaagtccggtaagaacaaggggcagacagtaaccaagtgggtgaagcgtgctcctgatgcgactgagacgctgtgggactgcattaaatccattggtgccaaagctgggatgaccgagcaggaaatcatcaagcaaggccagatggctcgcattcttcgcttcgaggaatacaattacattgacaaggagatttacctatggacgccgcaaagtacataaccatcgctgtgctggtaggtatgctggcgcgaggtctctggatgttcactctcatagtccgagacgtgaagcgagactccgagattaagtgataaactcaaggctctctgtattaaccctcactaaagggaagagggagcctttatgattattactttaagacttaaccttaagaggtgaaattatgttacaaccaattaatcatgttttaactcatcccgatgatattcctagtatgcctcgtgcagctaaagagtatctacaggtgcgcttcaatcagacctatgtgatggagtccggggagtaccgtgcgctacgcgctgctgggtactctgagtctttcattgcgggtgtgatgcatggtctgtaccttgcctctcgaacacttgatgagattgaggtgcgtaaagagcaactgagacaggagtaattatatgtgctggaaaccgaaggtgaaagtccctaagatggacactaaccagattcgcgctgccgaaccagcacctttgactgagccaccgaaatctgtggtatggggaggcgatgacgatgaggacaccagcgtgtcttcctctgaggtgccaacctcaccgagcagcggtaagagcagtcttaaggtaaagctggatgacaacgcagccaagaacaagagtaaatcctccattcgctccaaggcgtttgggtaactgagtcataacatagggagaaacatcatgggattcttcaagaaaatcaagaaggccgttaagaaagtcgtgaaggaagttaccagaccagtcgagaaggcaggtaaggaagtcggtaaagtcgttggcggtgcgctgggtacaggtaagcaggagattatccaacaagaggctccagcaccagtagtgactgcgccacctccagcacagattgtagatgtacctgaacaggataaggctgagggtgaggatgaggctcaaaccgaaagcgcacgtaagaaagcacgcgctggcggtaagaaggcacttagcgtagcccgtagctccggcggtggcattaacatctaaggaggactgaatggctgattcaaaacgtacaggcttgggcgaagacggtgctaaagctacctatgaccgcctaacgaacgaccgtagagcctatgagactcgtgcggaaaactgtgcgcaatacaccattccgtccttgttcccgaaggagtccgataacgaatctaccgactacacgactccgtggcaggctgtaggtgcgcggggtcttaacaatctggcctctaagttaatgcttgcgttattcccgatgcagtcgtggatgaagctgaccattagcgaatatgaggcgaagcagcttgttggagaccctgatggactcgctaaggtggacgaaggtctgtctatggttgagcgtattatcatgaattatatcgaatccaacagctaccgtgtgacgctctttgagtgcctcaagcagttgatagtggcaggtaatgcactgctttacttaccggaacccgaaggtagctacaatccgatgaagctgtaccgattgtcttcttatgttgtccaaagagacgcatacggcaatgtgttacagattgtcactcgtgaccagatagcctttggtgctctcccggaagacgttcggtctgcggtagagaaagctggtggtgagaagaagatggacgaaatggtcgatgtatacacccatgtgtatctcgatgaagagtccggcgattacctcaagtacgaggaagtagaggaagttgagattgatggctccgatgccacatatccgactgacgctatgccctacattccggttcgcatggttcgcattgatggcgagtcttacggtcgctcctactgtgaagaatacttaggtgacttaaggtctcttgagaatctccaagaggctatcgttaagatgagcatgattagcgctaaggtcatcggtctggtgaacccggctggcattacgcagccacgcagattaaccaaagctcagactggtgacttcgttcccggtcgtcgagaagacattgacttcctccaactggagaagcaagctgactttaccgtagcgaaagctgtgagtgaccagatagaagcacgcttatcgtatgcctttatgttgaactctgcggtacagcgcacaggtgaacgtgtgaccgccgaagagattcgatacgttgcgtcagaactggaagatacgcttggtggcgtctattcgattctgtctcaagaactgcaattgcctctggttcgtgtgctcttgaagcaactccaagcaacctcgcagattcctgagctaccgaaagaagccgttgagcctactatcagtacaggtctggaagcaatcgggcgtggtcaagacctcgataaactggagcgctgtatctccgcttgggctgctctggctcctatgcagggagacccggacattaaccttgctgtcattaagctgcgcattgctaacgccattggtattgatacttctggtatcctactgacggacgagcagaagcaagcactgatgatgcaggatgctgcccaaacaggtatcgagaacgctgccgccactggtggggctggtgtgggtgctctggcgacctcaagtccagaagctatgcagggtgccgcagcacaggctggcctagacgccacctaataaccctcactaaagggagacctcatctttgaaatgagcgatgactaaaggttggagtcctttggtttccctttatctttaacaacttaggagatttaacaatggctgaatctaatgcagacgtttatgcgtccttcggtgtgaacaacgcggtaatgaccggaagcacacctactgaacacgaacagaatatgctgagtctcgatgttgctgcccgtgatggcgatgatgcaatcgtacttagcgaggaaccgacttctcataacgatgacccatatgcatccggtgtagacccgttcgctgatggtgaagacgatgagggccgcattcaggttcgtatcagtgaagatggtaatgaagccgagttcgacactggtagcgataacgctgaggtggagaccgaaggtgaggccgctgagtttgaaccgctgggtgacactccagaagaactgagccaagtgactgaacaattaggtcagcacgaagaaggctttcaggcgatggtcgagcaggccgttgagcgtggactgagcgcagagtctgtgactcgcatctacgaagagtacgaagccgatggtatctctgagaaatcctacgcggaactcgaagctgctggatatagtcgtgcctttgtggactcctacatctccggtcaggaagcccttgtagaccagtacgtcaatcaggtagttgcctttgctggtggtaaggagcgctttagcgcaatccatacgcaccttgaagcaaccaacccggctgcggctgagtcccttgaggctgccatgatgaaccgagacttggcgactgtcaaagcaattatcaatctggctggtgagagttacacgaagaaattcggtaagcctgccaaccgtagtgttgccaagcgtgctactccggttaaacctgtagctcgtcagaaagagggctttacgaatcaggctgagatgattaaagctatgagtgacccacgttaccgtagtgatgctgcctaccgtcaaatggtagaacagaaggttatcgactccagtttctaattaaccctcactaaagggagagaccatagatgcctacaatggttgaatcacctgagcacagaactttgtggtcactcccgtaggtgaaacattgagaaccaactcgattcaagtagtaaccaaacttttctttaaattaacataaggagattcaacatggctaacattcaaggcggacagcaaattggtactaatcagggtaagggtcagtccgcagcggacaaattggcgctgttcctgaaagtgttcggcggtgaagtcctgacggctttcgctcgcacctccgtgaccatgcctcgtcacatgctgcgctctattgcttctggtaagtccgcacagttccctgtgattggtcgcaccaaagctgcttacctgaaaccgggtgagaacctcgatgacaaacgtaaggatatcaaacacaccgagaaggtaatccacattgatggcctgctgactgcggacgttctgatttacgacattgaggacgcgatgaaccactacgacgttcgcgccgagtacaccgcacagttgggtgaatctctggcgatggcggctgacggtgctgtactggctgaactggctggtctggttaacctgcctgacgcctccaatgagaacatcgagggtctcggtaagcctaccgtactgactctggttaagccgaccacaggcgacctgactgacccggttgagctgggtaaagcgattatcgctcagttgactatcgcgcgtgcgtctctgaccaagaactacgttccggctgctgaccgtaccttctacaccactcctgataactactctgcgattctggctgccctgatgccgaacgctgcaaactatcaggcactgattgaccctgagcgcggtactatccgtaacgtgatgggcttcgaagtggttgaggttccgcacctgaccgctggtggcgctggtgatacccgtgaggatgccccggctgaccagaagcacgctttcccggcgacttccagcactaccgttaaggttgctctggataacgttgttggcctgttccagcaccgctctgcggttggtacggtcaagctgaaagacttggctctggagcgcgctcgtcgtgcgaactatcaggctgaccagattatcgctaaatatgcgatgggtcacggcggtctgcgtccagaagctgctggcgctatcgttctcccaaaggtgtcggagtaattcccgaccccactggagttactcttagtcagaagactatgagcttagacgttggggcttctaaagccctgacttctacggtaactccggctgatgcagtacagacagtgacctttacgtcttccaatgcgaagattgccacggtcgatgcctctggtactgtaactgctgtgggcgctggctccgctgacatcactgcgactactgtgaatggcctgacggctgtctgcaaggtcactgtgaaagcagtagagcctcccgtagaaggctaaggtctttaccggggatttactttccttcattactttatgaaccccttgggtgccctctgagggtatctgaggggttttttgctttaaaccctcactaacaggaggtaacatcatgcgctcttatgagatgaacattgagaccgcagaagagctatcagccgtcaacgacattctggcttccatcggtgagccaccagtatcgacacttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactacctgtccgtaatggcaaccagcggtcagacccaatatatcaaccgtggtggctatctctatgaccgctctgcgaagactgaccgattcccatctggtgttcaggtcaacctgattcgtctgagagagttcgatgagatgccagagtgcttccgaaactacatcgttaccaaggcttcccgtcagtttaacaaccgcttcttcggtgcgccggaggtagacggagtgttgcaggaagaagaacaggaagcgtggcgtgcgtgcttcgagtacgaactagactacggcaactacaacatgctggacggtgatgcattcacctctggtctacttaaccgctaataacaaggaggctctatggctctcattagtcaatcaatcaagaacctcaagggtggtatcagccaacagccagatattctccggttcgctgaacaaggtagcgtacagattaacggttggtcttctgagtcagagggtctccagaagcgcccaccgatgattcaccttaagacccttggcgctgctgggtatgtgggtgcgcaaccttacgtgcatcttatcaaccgtgatgagttcgagcagtatttcgttgtgttcactggtgaagacattaaggtgttcgacctcgatggtaaggagtatcaagtccgtggagaccgctcatatgttcgtacagctaacccacgagaagaccttcggatggtaactgtggctgattatacctttgtgaccaaccgcaaggtggttgtgcagagtaacgaccaatcggtcaaccttccgggctttaaagaccaaggcgatgcgctaattaatgttcgtggtggacaatatgggcgtagactatcaatcgagttcaacggggctgagcgtgctgctgtgcagctaccagatggttcacaacccgcacacgtcaatgaggttgacggtcaggctatcgctgagaagctggcggtgcagttgaggaacaaccttgggaatccaaacaataagcaagacccgaataagtggcgcttcaacgttggccccggattcatccacatccttgcgccaaataacgataacgtttggggactacagactaaggatggttatgcagaccagctaatcaaccctgtaacccattacactcagtcgttccagaagttgcctattaacgctccagatgggtacattgtgaagattgtaggtgacacctcaaagactgccgaccagtattacgttaggttcgacctcaaccgtaaggtatgggtagaaacaatcggctggaacacaaggactcacctacattaccacactatgccttgggcgctggtacgtgcttctgacgggaactttgacttcaaggtacttgagtggggtgctcgtactgtgggcgatgatacaaccaacccatacccatcgtttaccggacagacaatcaacgatattttcttcttccgtaaccgtttaggcttccttagcggggagaacatcatcttgtctcgcacctcgaaatacttcaacttcttcccggcctccgtgtctaactactctgacgatgacccaatcgacgttgccgttagtcacaaccgggtgtcaaccttgaagtatgccgttccgttctccgaagagttgctcctgtggtctgaccaagcgcagttcgttctgacggcctctggtatcctttcgagtcgctccgtagagttgaaccttacgactcagttcgacgtacaagacagggcacgcccacatggtgtaggacgtaatgtatactttgcatcacctcgcgcttccttcacatccattaaccgatactatgcggtacaggatgtaagctctgtgaagaacgcagaggacatgacggctcacgttccgaactacataccgaatggagtattcagtatatcgggtacaaccgctgagaacttcgcggctatccttacgagcggagcaccgaaccgggtgtatatctacaagttcctctatattgatgaagaaatcaggcagcagtcgtggtctcattgggactttggggacaacgttacggtgtttgcagcacaggtgataaactcaacaatgactgtattgatgagcaacgaacatgctgtgtggatgggacgcttgcacttcacgaagaactccatagacattccgggagagccttacagattatacatcgacgctaagaggaaatacaccatccctgccgggacgtataatgatgatacctaccagacgtccataagcctcgcagcgatttatgggatgaacttcactaagggtaaagtgtctgtggtcttccccgatggaaagattatagaggtagacccgccaatcaacggttggggcagtgacccggtgttacgacttgatgggaaccaagagggccaagtggtttacattgggttcaacatcccattcacgtatacgttctcgaagttcctcattaagaagactgctgaggacggctcgacggctaccgaggatattggtcgcttacagcttcggcgtgcgtgggtaaactatgaggactctggagcgttcaccatccgcgtgaacaacctgtcccgtgagttcatctacacaatggctggtgctcgcttgggttctgacaatctgcgtgttggtaggtcgaacattggcacagggcagtaccgcttcccggtggtaggtaatgcgcagacgaacatagtaactatcgagtcagatgcgtcaacaccactgaacatcattgggtgcggctgggaggggaactaccttcgtcgttcttctggcatttaacttaaagtctccctgcggtgaattaaccctcactaaagggagacactaatagatacgaggggttaaagcattatgtatattacaaagtgtttacaagtccacgctgacaactttcagccgtccatagaggacattctggaagctgaggcattgggtgtcgaacctaaagtaattcctgatgagaacactgtggcaatgctcagcgatggcgctgtgttggcaatcggtggcaatcagggagaccgagtgtggttccttacctctaagtacgtcccactgtttaccttgaaggagcgcttagagtttcgtaagttaatagttgaatatcgtgatatgatgctgaaccagtacgagtccatttggaatttcgtttgggtaggcaataagtcacacattcgtttcctaaagacaatcggagcggtattccacaacgagtacacactcgatggtcagttccaactattcacaatctcaaggaggcaacgtgaagaaatgtaagaaatgcggagagttgaaagctgtctccgagttctataaggacaagaagagtaaggacggcctacggagtcattgtaagccctgtcactacacgtattacaagaaggactactcaaaggcgcgagagatgaaccttaagcgtctgtacggaatcactctggaagaatacgaagcgatgctccttaagcaagacggagcgtgtgctatctgcggtcttaccgagagagttgagggacgggcgttagcggttgaccattgccacgccactggcgctgttcgtggtctcctttgctctgcctgtaacatcgctcttgggaaattcgaggacgacaccgagcgtcttcggaaggcaatcacttacctaagaggagaataattatgtgctggatggcagcgattcctatcgccatgatgggtgcccaagctctgagtagccagaacagcgctgataaggcgcgagtggcacagaccgaagctggacgccgacaggcaatggagatggtcaaagagatgaatatccagaatgcaaacgcctcgctggaacaacgggacgcccttgaagctgcatcctctgagttgacttcgcgtaacatgcagaaggtacaggctatgggaacaatccgtgcagctatcggcgagagtatgctggaaggtgagtccatgaagcgcatcaagcgtatcgaagaaggtaactacatccgggaggcaaatagtgtcaccgagaattaccgccgagactacgcgagtatctttgcgcaacagttgggacgcactcagtcaacagcaagtcaagtcgatgcaatgtacaagagcgaggccaagggtaagtctggtctgatgcgtgtactagaccctttgtccattatgggtcaggaagctgcaagtcaatatgcggctggtggatttgacaagaaaggtggaaaccaagcagcacctatcagtgccgccaaaggaaccaagaccgggaggtaataatggctagtaaactaaatagtgttttaggcaacatggcgactcccggtatggaacgactccggggcgtcaaaggtatggactaccgggcagcaaccattcaggctgagcaaccaagagcgagtcttctggactccctaggtcgattcgctaaggctggtgccgatatgtacatggcgaaagaggaacgtgataagcaacgagccgatgagcgctccaacgagattatccgtaagctgacccctgagcagcgccgacaggctatccagaatggtacattactgtatcaggatgacccatacgcaatgcaagccttgaagttcaagaccgggcgtaacgctgcgttcctcgttgacgatgaggttcaacaggccatcaaagagggtcgcttccgtactcgtgaggagatggagcagtatcgtcactcacgcctacaggagcactcgaaggcgttcgctgagcagttcggcatcaatgagatggacgaggaataccagaagggtttcaacgcgaatatcaccgagcgtaacattgctctgtatggcgcacatgataccttcctgagtgaccaagcgcagaagggtgcaatcctgaactcgaaggttgaactcaatggtgtcctgtctgaccctgacctactgtctcgtcctgagtccggtgagttcttccagaactacatcgacaactccttggtgacagggatgactgacaatcaggctcaacaggttatctcttcgtccctgaatgacgtgctacagcgtccgggtggtgccgccttcttgcagaacattgagaaccgcaaggtgactcttaatggtgctacgactacctatcgtgaactgatgggtgatgagcagtggcaggcaatgatgattaaggcacagcacactcaattccagaacaacgcgaagttaaccgagaagttccgactggatattaactcagcgcttaaccaagcggacactggtaaaggatgggagactcttcaaggcatcaaggccgaactcgataagattcagccgggtgaagagatgactcctgagcgtgagtggttgatttccgcacaggaacagatgcgcacacgcttcaagcaggaacaggctgagacagcaaagctgatggacaagcaacagaagaccctgaataaatctttggtcatcgacaagcagttccagaagcgcctcaacggtgaatacgtctcgaccaactataaggacatgccgaccaacgagaacactggtgagtttacacatagcgatatggtaaactatgcgaaccagaagttagcggaaatcgaagcgatggacttaacgccagaacagaaagacaaactgaaattggactacctacgggcagactccaaggagggtgctttccgtgcagcgtttggtgagatgattactgatgctggaaacgaatggcaggctgcggtgattaacggtaagatgcctgagagcacaccagcgatggataaccttcgtcgcatccgcaacactgaccctgacctgattgcctctctgtatcctgacaaggccgagttgttcctgacgatggacatgttggataaccaaggcatcgacacgcaggttcttatcgacgctgataaggcccgcgcacagaagaccaaggagatgcagtttgaggatgaccgagcgtgggctgctatgatgaacgattcaacgaatcctcaaatcaagtacatgccttcgagtgtccaagggtatgcccggaagatttatgattccgtgaagtaccggacagggaaccctgacatggcaaccgaacaggtcgcaaagttcctctccgattcgacgaccacgttctccagtagcgatgttgagggtgatacctacggcgtcctaccgaagaacatcctgactgtttcggatgaccctaagtcgtgggagcaagggaagaacattctggacgaagccattaagggaatcacagcggcgaacccttggattaccaacaagcaactgtcggtgtaccagcaaggtgattcaatctacctgatggacacaaccggacaggttcgcattcggtatgaccaagagttactcaaacgcgaataccagcgtaccgcacagatgcaagctgaggcagcgcgagagaaagctctcaaagaggccaataagcgtgctccaatcagtcgcgcaacgcaggcgcgtgaagaagcgcgtaaacgtgtccaagagaaacggaagaagactccgaagtacatctatggacgtaaagaagactaacagtgataaggaggctccatgagctacgataagaacaaacctagcgagttcgatgggttatttcaaaaagcggcagacaatcatggggtctcctatgacctgcttcgtaaattagcattcaacgaatccagctttaatccaaaggccaaatccccaactggcccgaagggtctcatgcagttcaccaaaggtacagccactgcgcttggcctcaaggttactgacgatgatgacgatgaccgttacaaccctgagttggctgtggatgcagccgctcgtcacctgagtgacctcattcggaagtacgatggggatgagcttaaggcagccctagcatacaaccaaggcgaggggcgcaacggtgctccacagatacaggcctacgacaaaggtgattgggcttcaatctctgaggaaggtcgtaactatatgcgtaacctgatggacgtagctaacagtcctcgcaagggggacttggaggcgttcggcggtatcaccccaaaggctaagggcattccatcgggggatgcatttgctggaatcgggaagaagcagacggtaggcactgacctgccggagtcaactggattcaaagtggagggtaaagagcagaaagcacctaacgtgccttatgccaaggacttttgggaaaagactggaacaacgctggacgagtttaattcacgttcgaccttcttcggaatcggagatgccacgagtgcagaacttcacaactccgtattgggtgtggcttttcgtgccgctcgtagtgatgacggttttgatttattcaaggacaccattactccgactcgctggaacagccatacgtggactccagaagagctagagcgtatccgtaaggaagtgaagaacccatcgtacatcaacgtagtcactggaggctctcctgagaatctggacgccctcattaagatggcgaatgacaactatgagatggacgcacggtctgccgatgctggtgttggtgccaaacttactgctggtatcgtcggtgctggtgtagacccgctgagttacgtgccgctagtaggcgtagccgggaagggtctcaaggtggttaacaaggctttcattgtgggtactcaaagtgctggcctcgcggttgcctctgagggtatccgtacatcaatcgctggtggagaagcccactatgctgatgctgctttaggcggtctgatgttcggtgctgggatgagtgcaataagcgatgctatcgcggctggtattcgccgttcccgtgggactgaggttgttaatgacttcgctcctatggcacaccgcttggaagcccgcgaaaccgctctgaactctggtggtgaagacctgacccgtatgcctagcgagaaccgtgtgttcgaccgtgagcacgctggagttgagtattcccctctggagaccgagccgggtgccgttgtgttgcctcaaggtcaaatcctgagcgacaccaacccactcaaccctcagactcttagcgagttcgaggcggtcaaccctgagcgtgccgctcgtggtatctctttgggcggtttcactgagattggcttgaagactctccgctctgagaacccgactgttcgctccattgcgagtgaccttgtgcgttctccgacagggatggaatcaggctctaatggtaagttcggtgcgactgcttctgacattaaggagcggctccacgcgaacaatcagcgcacctacaatcagctttatgatgctgtgcgtactgcaatgaaagaccctgagttctccacaggtggggccacaatgagccgtaaggaaatccgacaggaaatctacaagcgtgcagccttggcgattgagcgacctgagcttcaagcaaacctgacaaagggtgagcggaacgtgatgaacatcctcaagcagcactttgacctcaaacgtgaaatcatggagaacccgtcaatcttcggcaacaccaaggcggtcagtatcttccccggctcacgccacaagggaacctacgtgccaaacgtgtacgaccgcgctataaagattgagatggttaaacgttacggtaatgatggcttgcagcgagcaatcgcggagtcatggttgacgtcttatcgtgctcgtccagaagtcaaggcgagggtcgatgagtacctgatggaacttaacggtctcaaatccgtgcaggaagttacgcctgagatggtgcagaagcacgcgatggataaggcgtatggtatttcacacaccgaccagttctctgcctcctctgtcattgaggataacattgagggtctggtgggtatcgagaataacaacttcttggaagcccgtaacatgttcgacagtgacatggcggtgactctccctgatggtaacacgttctctgtgaatgacctccgtacctatgacatggctgaaattctacctgcatacgaccgacgagtggatggtgacgtggcaatcatgggtggttccggtaagacgactaaagacctgaaagatgaaatcatggcgctggataagcagtcagagggtaacggcacactgaaaggtgaagtggaagccctcaaggacaccgtgaagattctaactggtcgcgctcgaaggaacccggaaggcgcttggggaacagccctacgctccgtcaatgaccttacgttcttcgctaagaacgcctacatgggcgcacagaacattactgaaatagctggtatgctggctaaaggtaacgtctctgcgataactcacggaatacccatgattaacgattgggtcaaccgtggtaaaccgcttcgtgcctctgagattaaggagatacacgggatggtgttcggtaaggaactagaccaactaatccgtccgggacgtgaagaccacgtgcgccgactccgggagtctacggacaccagcgctgcggttgccaatgtggtcggtacgattcgtttcggcactcaagagttggctgcacgctctccttggacaatgctcctaaacggaacatcaaactacattcttgatgctgcccgtcagggtgtgcttggggatgtggctggagcggcccttactgggaaagcctctaagttcggtaaggcaaactaccttaagtctgcctctatcagccctgagcagtggaatggaatcaagcagttgttcagagaccatgcgactcgtggagaagacggtaagttcaccattcgtgacaaacaggctttcgctaacgacccacgttcaatggacttgtggcgactggctgacaaggtggcggatgagactatactgcgccctcacaaggtttcctcacaggactccaaagcgttcggtgcaggggtgaagatggtgatgcagtttaagaacttcgtcatcaagtcccttaactcccggttcgtccgtagcttctacgaggcaacgaagaacaaccgtgcgttagaccaagcgttgactcatatcatctctttgggcctagctggtggttactacgttgggcaggcgcaccttaaggctgcaagtctacaggagcacaaacgtaaggagtaccttaagaacgcacttgaccctaagatgattgctcatgcatcaatctctcgtagttcacacttaggctcgccattgagtatctacgacatgttcgctgggatggttggtagcgatacctataagtacacccgctctactgtactccctaaagagtccgagaagcgtgaccctaacaaggcagtgacaggtagacaggtggcttcaactatcgcaggtgcagttggtgagcaggttccgggtttaggttttgtgggttctgtgggcgcaacagcaattaacgccgcttccctgctgtcttctccaaacaaggctaccgctctggagttccgtacaggactcttcaacacctctcgtgagttgattcctaatgacccgctatcgcagcaactcattatgaaaatctacgaggccaacggtatccgcataaaggagacgccgaagaaacaataaaccctcactaaagggagagaggtcacattctggcctcttctctctcttaatgctaatttacaaaggaggtcacatggctacaactattaagaccgtgatgacttacccgctggatggctccactacggacttcaatattccgtttgagtatctggcgcgtaagttcgtcagagtgacccttatcggtgttgaccgaaaggaactcatcttgaatcaagactatcgttttgcaactaagaccacaatctccacaacgagagcattggggccagcggacggttataacatgattgaaatccgtcgattcacctccgctaccgataggctggttgactttacggatggctcaatcctccgtgcgtatgacctgaacatctcgcaggtgcagaccctccacgttgctgaggaagcgcgtgaccttaccgctgatacgattggcgttaacaacgatggtgacttggatgctcgtggtcgtcgtatcgtgaacgttgcggacgctaaagaccccggtgatgcaataactttaggtcaagtctctcgatggaatgagtcggcactgaactctgcgaatgctgctgctgcatctcaacaggccgctgctgcatctcaacaggccgcaaagtcctcagagaacaactcgaaggtatctgaggacaacgcaaagacctccgagaacaacgcgcatcaatgggcgcagcgtgcagaggactctccggttcagggtagcgagttctctgcgtatcactactcacggaaggcctccaagagtgccgccgccgcaagtacgtctgaggggaatgcaaagacctctgagaccaacgctaagtcctctgagaccaacgctaagtcctctgagactaacgctgcatcgagtgctgctaaggcttctgaggaggctgctaagctgactaacatgaatgactttgctgctgctattgattcagtcaacggtaacaatgttgtcatgaagggtgacttcaccattaaaggaaacggtaaagtatcaatactgaaccacagtgggctataccaagataagaccgtgaatggcgtgaactatgccaacaggatttatatggatgatgcggggggcatgcactttgagaactaccgtgtgtctggtacttcatccaccttacgtgctggttttgttattacagataccaacaggtttgactttacagggccaacgcgagttaagggtgatatcagcgcatatgtggatgcgccacctaatccaggtattggccaatacctcaattctgtgtcagttcgctcacagcttcggggccgtggtgctaagaatgatccacttggtgcgtactgtgctatgtattttcaggagcacgttggtacagaccacgctataatccttaacctcaatggttatagcaaggatactaactggcagctattctccaatggtaaaatatctacaccacttggtgatgtgatgacctcaggttctgatgttagaatcaaggatgatatcactaaacctcttgatggtgctggtgagcgtattgacgcaattggcatagtggaatacacagagattgccaccggggaacgtaaacgtgggtggctggcccaacagcttgacacgattgacccgctgtacacatacctcacgaccaccgcagaaggtagtcttttgaataccaacgacagggcgttgcttgctgacgtaatcactgagattcaggcactgcgtcaacgcgttaaagaactcgaaggacaatcaacaaagccagagggcggcacaacataaggagaacaagaatgttatcttttgacttcaataacggggtcgttaaggctgcgccgattgttggcacaggggtcgctgatggtgcggcccgactcttttggggactatcgttaaacgagtggttctacgttgcagctatcgcctacacagtggttcagattggtgccaaggtagtcgataaaatgattgactggaaacgtgcaaataaggagtaacctatgagcgacaagactttaatcaagctgctggagatgctggacacggagatggcacagcgtatgcttgctgacctccagagcgaggaacgccgaacgccgcagctttacaacgcaatcggcaaactgttagaccgccataagttccaaatcagtaagctgaccccggatgagaacatcctcggtggactggcggctggtctggaagactacaacaaagtggtcggccctaatggtctgactgacgatgagactatcacgctacagtaagtgacatactcaaggttctccacgcggggagcctttatggatgttatttggcgcatctatgtaaaatctgaaaattgatgggaggtgttatgctaaaacttttacgcagcgcactcccttgggtactcgccgggacactctttatgggtggctggcacttagggtcaacccatgagagagcaaactggaaggaggtaatccaaaatgagtacattgcgaaaacaaaagcaaccgcagcaactcaggcagaggtcagtcgggtatcccgtgagtaccaagaagagattgcagccattgaaggcagcactgataggatgcttaatgacctgcgtagtaataataagcggctgtcagtccgcatcaaaacccttaccggactaccagaagataacggtagatgcgagtttaatggtcgagccgaactacacgagtcagatgctaagcgtattatcggaataacccaagctgctgatgctcacgtaagagcgctccagcgtactattaaggagatgcagaatgagcgacacccaagcaaaccgtaatgcgctaatcattgcgcagcttaagggtgacttcgtggccttcctgttcgtattgtggaaggctttggctctcccgccgccgactaagtgtcagattgatatggcccggtgtctggctaacggagacaacaagaagtttatcctacaggctttccgtggtatcggtaagtcattcatcacctgtgcgttcgttgtgtggacgttatggcgtgaccctcggttgaagatactgattgtctctgcatcaaaagaacgtgcggacgctaactccatcttcatcaagaacatcattgacctgctgcccttcttggctgagctaaagcctcgccccggtcagcgtgactctgtgattagtttcgatgttggccctgccaagcctgaccactctccgtctgtgaagtcggtgggtatcactggtcagttgactggtagtcgtgctgatatcatcatagcggatgacgttgagattccgtctaactccgcaactcaaggtgcccgtgagaagctgtggactctggtgcaggaatttgctgcgcttctgaaaccactgccgacttctcgcgttatctaccttggtacgcctcaaaccgaaatgaccttgtacaaggaactcgaagataaccgtgggtacaccacaatcatctggcctgcgctctatccgcgtagccgtgaggaagacttgtactatggcgaccgtctggccccgatgctccgcgaagagttcaacgatgggttcaagatgctccaaggtcaaccaactgaccccgtgcgcttcgatatggaagacctgcgtgagcgtgagttggaatacggtaaggctggcttcactttgcagttcatgctcaacccgaacctgagtgatgccgagaagtaccccttacgcctccgtgacgctatcgtgtgcggtctggacttcgagaaagccccaatgcattaccagtggcttccgaaccgtcagaatcgcaatgaagagctacctaacgtgggccttaagggtgatgatattcatagctatcattcgtgcagccagaacactggacagtaccagcaacgcatcctcgtgattgaccctagtggtcgaggtaaggatgagacaggttacgcagtgttgttcaccctgaatggctacatctatctgatggaagctggcgggttccgcgatggttattccgataagacccttgagtccctcgctaagaaagcgaagcagtggaaggttcagacagtggtcttcgagagtaacttcggggatggtatgtttggtaaggtattcagccctgtgctcctgaaacaccatgcagcgcaacttgaagagattcgtgctcgtggtatgaaggaactacgcatttgtgatacgctggaacctgtgctctctacgcaccgccttgttattcgtgacgaggtgattcgtgaggactaccagactgcccgtgacgctgatggcaagcatgacgttcgctattcgctgttctaccagttgacccgtatggcccgtgagaagggcgctgtggcacatgatgaccgacttgatgcgttagcattgggtgtggagttcttacgctctacgatggaactggacgccgtgaaggtggaggctgaggtgcttgaggcgttcttagaggaacacatggagcacccaatccattcggctggtcacgtagtcacctctatggttgacggtatggaactctattgggaggatgacgatgtgaatagcaataggttcattgactggtagttatgcatattgagtgcataaggaatcatttagaccacggatggtcactttaagaaattccttaataatcaatgagtttgaattaaccctcactaaagggagagaggggacttaaagctactatataggttagtcattcaggttatgcaatgaccctttatgcactttaagtctacctctgtgattggtgatattatcattgtataatcaccctaccttagagcaactgaaaggaggtggctcaatgttacgcttgctgattgccctgctgcgtcatagagtcacttggcgatttcttctggtacttactgctacccttgggtacgcaggtcttactgaccacctcggtcaactggaagtggccttttgctctatactctcttgtggggattaaattattgttgatgaacgacaagcggctctgagggattcgtaggtatagtttcactacaccaactcatccctgtagagtcaaccctaaaggttatacctaaagatgccctgtagttcgtaatggtcttacagggtcttctggtgtctcctagctatcccttcgggatgcgcctatggtctcacctatggtgtggccttacctaaagtgggttcataaagagaccctttaagaatttaccacaaaaatctgaatgggtatctcatagttcaagaacccaaagtacccccccatagccctcttaaagccacctaaaaccagccctacccctagggtttaaccttcggttaaccttgggtatctcctcaagtggcctataggatagcctaaagtgttgcctaaagtcaatacctaaagtggtggatggcttaaggaggacttaaagagtgtcctagtgtaccagttcgatagtacatctctatgtgtccctatctgttagcctcctaaagtaaaccctaaagcc

SEQ ID NO: 151 - DNA, 178453 bp, Unknown
  source: /note="Description of Unknown: M16-3-2c Bacteriophage Sequence"
tgtgttcgtagaacggaatcgggtcaaactgcccgtaaacggttttacgaagggcgaacatttcgaggttagccgctacatactgccagtcaggttcttttgcggagattcgatccgctgcatacttgatcgctacagcctggatctgtttggtagtcataccatcacgaagcaggtcaacgacactttcaaggaatgcgttaacatcaatatttcttccaatactcgcccaattaaggactttgaacagtttttctttttcgaacgtttgacttacgccagaagacttcactactgttttaatatcactcattatcttaccttgttaagaaaggggctttcgccccctttgtttatactgccatagctgcttttagcgagccgtggtgattatagtctttcaaatggatggagtcaaagaattcttgatccaaatcaagtaagctatttaccttcggcatataaagggtcggaagtggaagcggtgcgcgttccggcttcaacaactctttcgcttgttctactgcgtttttgtagatatggacatcaccgccagtccaaaccagatcacccacttcatacccgcaaatatccgcgataatatgcgtcaggagagcgtaggaggcgatattgaacggcaaccctaagaagacatcaactgaacgctgataccactgtagagacagtttaccgttgattacgacgaactggaagaaacagtgacacggacgcaaagccatatcatccagatccatcgggttccaggcagaaacgatgatcccgcgatcgtctggtgtggttttcagttgttcgatgactttcttaatctggtcaacaccataataagaaccttccgcaccaaatgagcgccattgatgcccgtagatcggtcccagataaccatgcgtataacccagcgctttagcctgattttcgtagttatcgtcccagatcgtccgcttatcgctatcttcaccccacgtcattttacgcagtgtttccacgttggtagaaccttcgaggaaccattgtaattcatgcttacacggtttgaagaatagctgtttgctggtagtagctgggaaaccttctgcgaggttccaacgtgcttgcatcccgaagatgcgcagtgtaccaacaccagtacgatcggttgattcagtaccgtgtgttagaacggtgttgacgatatcaagatattgtttcattttatgcctttttcgtatgtcgatcgacgataatttttctgacgcgttcgtttgattcgatctgctgaattttgaaatcagtcagttcatatttcagaaccgcttcacagaattcaggaaccgtgaatgaaacatcacgtttaaaagctggtgcattatatacatgatgtccgtaaatgtgcgtcacaaccacttcatcaaccattgtattattgattgcttgcagaagcaaccacttaccaccaatgagacacacatcacgatctggatgcgtttctttcattacgtcgattgcagcagacaacccgccaccgtggatgacataatcagcggtattcccgttctttgttaccagacgttgaccggatgcagacagaacgcaatgaactcgccctggcaatttaccaggcagagaagtaaaagtgttcgcacccatgatcaggacgctatttgcggtttcttctttgaagttctgcaaatcctctttgcagtggccccacggtaaaccctgttcataaccaaacgcatagtccacttcgtacatatcatgaccaacggcgaaaactgcttttactttgctcatagcgcgatccacattttgttgtcttcaatagtcacgatgtagcccatagcttcaaccatgacgcgcaatttgtctttacaggcttcattgtacccgcgaatcttttcaaattcaacagaaaagatactcaaaccgttaacatgagcgttgatgattttggattccagatcgaacaccatcacatctaacggactccattcaacagaatgaagtttttcgcgggttaacagggttgtgtgttttggtagtttcattggggtacagtttgccatagccattgttccattttacgtaaatcttcctctaacggagtgaaaccaaatgattcttcgatcacaccgtcttcccatacatcaatttccagaatttccgttaccggagggtttgacatcacatgatcacgacatgcagccatagcggtcataatggaatttgttactgtcagggtgttgccctgaaccgatacctgaataatcatactcacctcataaaaaaagggaactgcttttcaacagttcccattatagcataaccagttagtgtttcaagcgccaaagagcgattgcttcatcaactgcttttttaatttcttccggcgtgtctttgcgtccggctttaaccagggcagagagcatagaacggatggttgcattcatctgtgacttctcacgatccatctgtgcctgatgcgccttatcaaccgctggggattctttcttcgctgcctgtggtttcgtaggctgtgcgcctaactcgtccttagcttgcgtttcagtgcgtttctgttcggcttctttcttcacatgaggtgcggagaatttaccagccttgaagttatcacgcataccttccaggatcttacgggctgtgtaccagtcagcaacaccacgaagttgtttcagggtatcaaccaacaaaccgatacttgcgcctttgctatcctcgtcaatgtcgatatctttcaaccattcaacatgtttctgaccggagtgcatgaaatcaaagctgctgaaactccagaaacctttacggttgctgatctcgcgtttgaagtggaaagtcaaacccgcgccgttatcaaactcaccgtagttactgcggaatgttgcccccgcttgtttcagtgcgttgaaatagtcatctttattgatgcggttaacggtgcgttttggtttctcttccggcgctggcgctgctgcttgctgtgcggtacgtttaacaaaagatgctgaacgatgccccgctgcaaactctgcgttcatccggtcgattaccgctgcgatgccgcttgcgtctggtttcactttctgcatttctttgaaagtgtcgatgatcatatccagacatgcaccgtcttcatcttccagcatagtacctttcagacgttcagcaggtttgaatttgttcacagttgggtcaacaacatactggaacacatacgcgcctttacgcatgaatacgtgacggtagaagtgaactttatagtgtccaacatcaacaataacatcgttaccgctaaccttcgcacccaggatacgggcaaaggatgtcatgtagtccgcgcgtttgaacttgagatccttcttagtcgggctaaagatggattccagtttcttagtagggaacaggctttccggcgtgattttgtctgggttcttgccccattggtaatcacggcttgccattttgtgtttcttcgtaccaaccagaaccagagtattaactgatacgctacccagtgcggacgcgtccggcgctgctaaaccttgaccgttcggcggttgacaagagaaagagaagtcaaagaacgcatcaccagaagtgaaacgataggttgcgtgaaccgtatgaccgcgaacttcgctgattgtctgggtataggttgttggttgtccggtgaatttcgtgaaatattccgcaaattcttgcgcgttgaatttagtgctgaaatagtttttcgccagcacgaaatacgctgcaaatttttcttcccacgctttcttgtttgctgcatgttctgcgcgaacatcactgaaagttttaccagcgctgtttgttttggttacaacgtcatacgcctggttgattttctgcatgagttcagtgctaccaccacggtcggggtgattgcgcagagaagcacgtttaaagagctttgacagttcagctttagattcgtcgccagtagcgcccaaaatcttcaatgcttcgctgtgtgacatttgttcgttaatcattttccgttcctcaaaataaaaacccgtgcaactcagtacacgggcgactttaaggtatttatgttttactgtcaatagattttttcgaggaaccacacagaagatttattattcttgatgcgggtcaattcaatggggttatctttgaatgcttcctcaacatctgccattgtaactacatgtttttcttccaatagttcattatggagataaaacctctccacttcgggagaggtctttaaatcaaattcacgttctaacatgagatcgccatatctttgattgttggttttgtgaaccgtccaaccttagacatgatgatgtggcggtcgaagtcctgcggatcaagatcctggtgactgattacaataacgttaccatctacagaatccaacagggatttaatcgcgaatgaaccctctttatcaagtggcccatcaaacacttcatcaagtaccagcagagacagatccacgcctgatactttacttgtcacgtcacgccatgtgaacagaatagacaagttgatgcgagcgcgttcgccttgactgaatgacgcataactgaaatcatcgcgccccagtgatttgatcgattcgttgaactcgtcatctaaagtgaactgataatcagcacccaatagatccagataatatgctatctgtttgttgaagtacggaatataacgcttaacgatactcgctttaacgccggaatctttcaacatatccgtaacaatatcacgaatatatttttccttgacgtagccttgtcgtttttcgttcagttctgcttcctgctgttgcaactgcttcacgggttcttcatcaatgactacttccgcgcttgcctgttccatgatcgcctgtgcgcgtttagcgttagcaacttcgttttgcagagtacctttcagggcttcatatttggtttttagggcattaagtgcgcgttgctgttgtagcaagtcattcatgatcccttgtaactcgtcctgtttggttttgatcagggttaaacgttgtgtacccgctttgatgttctctgcgatctccgccatacgctcaggagtgggtttaatcgcttgcttacatgccggacactcaccgcctttctgatacatcacctccagctttttaaactgttctacagtcattgaaagccgcgaataaccgtcacggagtttgttgatatcttccgtccggtcttctccagtgatcaccgattccgcaatctccgcttgcaactgcataagctgtgctttgatgttctttgcggtttctacgtggctatcgtagatctctttgtatcgggcgttgttctggtttgctttcgctcgctgttcgtcaatgaagcgctggtgtgttgcgatctgctgctggatgtgattaccctgcattgagagtgtatccaactgctgattaacaccgcgaatgtatgacttgttcagcttatccatttcactgataacagacagggaaagcaaatcctcaaccagtttccggcgttctggggttttcagttccatgaatggagtgtaacccgctgtacccagaacgataacctgtttgaagcccacaaggttgatgttcagcatagattcaagctgtgcctgataatcacccgctgcggagtcttccggcaatttctcgccgttcttccagatctcgaataccttcggcttttgtccgcgcaccactttgtacgagtctttcccgtattcgatttccagttcaaccaggcatttctttttgttgacgctgttcaccaactgcccgacttttagatcgcggaatgacttaccgaacagggcataggttaacgcctcgatcagtgtcgatttaccgccaccgtttttccccgtgatcagggttttctttgctgtatcaaattccagttcgatcggggtattcccgaccgacagaatattttgatacttaatttttttgaagtttagtttcatttaaaatccgttcacataattcagtgatcagttgaataactgatgaatcaatactatatgatagcgtatcatcgtccagtgtatcaagcatgaagattgaccatgttcttgatgaatgccatacacccttcatgatggtcaaacaaactgcgctggtttcccctgcttcgtcagaagtggcaatgatgtgtttcattcccaacatacgcaacaggtgagaatatcgggggttcgccccgaaatattcatcataacggctatgcacttgacacctccgcgtagagttcgctgatccgcttattcacttcctctttttcatcgtcggtgatctgcatgtttgcgatatactcagtgataagcccacgaacggttttgatttcaaagtcggtatcgacatctgaatctgtttgaactttgtctatgatgttgatttcataggcaatttcttcgattttggtttggaactttgcaagcccctgatcgatttcactaacaatcaaacgcaccgcgcagttgcggaactgttcaagatcaacatctttctgtgctggatacatgatccggcgatggtggcacacagggttagcgatgaaagtcaattcaggcttgcccgtgaacacatagaatccgcgtgtttcgtcttcgtcgttcgcgctcatagtcagaggcgtaccgatataaaacacgttgtcaccctcgttagcgtggtgatagtgtccagagtaaacacgatcgtacttcttcaagaaatcaggttccagcccatgatcggctttgctgttcttgtagaaataataaccagacagttcgaagtgtcccaaacaaaagttagctttcgattgtttgatgtagtcaaaaatacgctggctattttcctgacaaatccacgggatcaggtcaattgaatttccgccacctaaatcaaccgtggtcggttcgtcaatgacattaaagcattcgtattgacttagtatctcgcgtggcgcgttggggcgtattttgtccttaaattggcaatcgtggttgccgacaagaacatccagagtgatccccgcctcaatcagaagaggaaccagcttttcacgaacaaaattcattgtcgtttgtgtggttgcttttcgaacgtcgaagaagtcgccagcatggaagccgcgcgtgatcccgtgttctttgcaatactctacgatctgtttgaataccgcatacaggttttcttcgttccaggggttatcctggcgaagtccggcatgggtatccccaattaaaacatagttcatataaacctcaaaacccccgaaggggtttatttgccgtatttttcagaagccatgatgaacaggtctttcaactgctggttcgaagtgatccacatcgtttcaatcagttcatcgttgtatggttgcttgagcatatcacgcatctttttgatcgcgtatacgtactgctctttgttaccttcgaagagtgcgttctctgcgtgtttatgcagtcgcttccattccgctttgttcttccgcatgaacttttgcgctttgcgtagggcttcttgttcaatgcgtgtacccttgacggattccagttcttcttcacgaagatccagcgctgatttttggtgtacttcgtcgattacttcatgctgcacgttcatagtaagtgatctccatgatcattgtttcggcgtttattacatagtccagacgaccttctgttatctggaagtctggatctcgtacatctgtagggtcgatgataatcggaatccctaagctctgcaactctaatttcacaaggtaaggaagcagatcaatttcgtcgttagcatctgctaaaattttgttcaggtcaattttaattttcatagaaacatttccaatgttggcgattcgtccacaacctcgattttatctttgggttttttcgcggactcttcatactgattaagtttgtcatggatatcctgaatgaaagtttcatcggctatcgttgtcatatcagtatcatcgctgtcatagacatgttccaggaagtatttgtatttcttcgcgttctctttcttctcgtagagaatacgagttacaaacgcttgccagcaagccttgttgatgtaaccgtagacgtttgtatatttggtttcgtcaaagttatgaaggccggaaatcgttgccgaaattccatcatcgatcatatccattttccagtcttcggaataacggttgaagttgtatcgacgtgccaaaccgtgagcaatattcataatcgcaataccgagttcatccggcatcttacgatcaccagtttcacggatttgctgtttccacttacacataactggatacagcttatcattatctgcataaatctttgtagtcattatattctccaaattgaatacattcattatagccgattgaatcaggtgtttcaaacctacttccaatctatattatttaataaaatcagcgcgaagcgcttccgtgagcgaagcgaaacggatagttagatctggttaaaaagtatacggaaatgtactgttttctctatatataaaatataaaaatattaaaacgtacattcagtacatagacactcactacgttcgtgtccttcgcttcgctcagatttttgaaatgatctattgactttgaaaaagtgatcactataatcagtttcattcaacaacaacgaggtattgaaatgtcttcatttgcaagtatgttcaacctgaacagcttaatgagcaatgacgatgatcctgttgatgtgatgtgtatagatatttcaaacctttcggtagcaacgttgatgaacaacttcaagccgaaagaccagaatgacatcaaccaacaaattgttcgtcacatagtgcttgacaccattcgtcacaatgtggttaaattcaaaggtgagtaccctgaaattgttctagcctttgatgataacaagtattggcgcagaagtaaagcatggtactacaaaaagaaacgaaaaatggaacaagaatcatcggattgggactgggatcgcctgaatagtttccttcatccgacatacgatgaaatccgtgctaatctaccgtacaaaggtatccgcgttgacttcgcagaagccgatgatgtgatcggtgtagtgacgcgtaaagcggtatccgaaggtaaacgtgttctgatcgtttctgctgatggtgactttgcagcccttcaaaaatatcagggtgtgcgccagtggtcgccaacacaaaagaaatgggttacaccgaaatatggttcaccgcgtaacgatttgcgtatgaagatcattaaaggcgataaaaaagatagtatcgcttgcattaagatcagaaatgactatattgttacgaaggttgaaggagaacgcgcaccgtcaatttacgctgcggaactcgaagcctggctggaagcggacgatccgaccgtgggtatgcccgaagagtgggcgatccgctacagagaaaacgaagaacttcgcgactttgattttattccgaaagatgttgcaacggcaatcgaagaagcgtacaatgctccaaaaatcgggaacaaagcaaaaatggagaaatacttcatggaatgcaaacttacccgtatgtatgaaaaactaagtgacttttgaggtaacaaaatgagtgtagaattactgcaagaaaatccagacatcgctaaagcggttaaagaactgatcaaagaagcgtcgaacgtgaaaactcagatcgaacacttccagggttctttcaaagatatcaaatccaaagcgaaaacggattatggtatcgacggcaaaaccttcggcaagctgttcaaactgtatcacgaacaggcacgtaccgcgttcgaagaacagaacaacgaacttatcgaactgtacgatgtgatcgataaggcgtaatatgagcgaaatcggaaacaaaaccgaagtcggcttgtatatcgaaaatctggttgcctctgagggggcaacctacatggaagctacgttacaatggatggacgaaaacagcattgattatgctatgctgtccaaaacagtaccgaaagcgatcattgacaagattagcgacgaagccattaaaaacaatctgctgcgtccttctgtggctaaagaccacgcgacgacgcaaaccctggatgatttcatgtgaaatttaaaaccccgtttgacagttcagacgctaattcccgtttgaaaccgatcgcggtatacaaactgtacctggtgatgaaaaatcactttgctgggaagtatgacgcgatcaagtacaaatgggaaataaagatcactgaaaaagcgttcgaaaagagaagagataagtattttttcaaaaagttagccgaaaggtttacattcaaagaaatatatcttatacttctctccaacatggtagctaaccccgacttctgggtcggggatgtagacgaagatacgatcgtgttttatcgtcaatacataggcaagttgaggcgaattgataatattttcgtggacgatgtaaaaaacctgtatgaattttcccgcatgaaaggtattcccctctctacggtgtttcagtatagcgtcaaatcatcaacctcgtatatcagcaaactcgtactttctggagtgatttcttatgagtcattcttgatcctcgactcgtttttagacatcataaataaacacgatgaaatcgcaacggatttcgtctggaatgaatttagtaaaaaactaaacgcatacagaaaattagttgaaatcagtaacgaagaaatcgtaaaataccgaaacttaatgaaacaaactttaattaacttaaacgagaaataacatatgtcattctttaaacgtcaagatccaaccaaactgcaagaacaagtcgccgctctgaaaggttcctccggcttccagaaagatgaaaaagagtggaaactcggtgtcgatgcacagaaaaacggttctgcggtgatccgcttcctgcctaaccgatctgatgatgaactggcgttcgtgcgtatcgtcaaccattcattcaaaaagaataaccagtggttcatcgaaaactgcccatctacccacggcgattacgatgcttgccctgtgtgtcagtatatctctgaaaacgatctgttcgaaaaagcgaaagtgaaaggcagcgaagccgaaaaaacactgggtatgatcggacgtaaacaatcgttctgggcgaacattctggtggttaaagatccaatgcacccagaaaacgaaggtaaggtgtttaagttccgcttcggtaaaaagatcatggataaaatcactgcggctatcgcggggaacccagatctggatgaaccaggtgttgctgtgacctgtccgtttggtggcgctaacttcaccctgaccgcgaagaaagtaggcgactggcctaactacgacgacagcaaatttggtgttcctggcccaatcaaaggcatcgaagacgaagcgcgtcagaaagaaatcttcgaaggtatgagcgatctgcgtccaatcactgctccagaccagttcaaaccaactgcggaactgaccgcgaagttcaccaaagtattcggtggtgctgcaatgggtgctggcgcaagcgctggtgcggatctggattcagaactgaactcatttgacaacgaactgaaaaacttcgataatggcaaccagtccaaaggtgctaaagaatctggtggcgtaagtcaactgaacgtaggcggaagcgtaccggaagatgacaacacccctccgtttgacctggaaggtggttccggtgatgacgacctggataaactgctggatctgtaatgcttacgggggcgaaagcccccaatttgaaagtttgaggtagatatgaatttagaacaaaacgtatatgtagcgcatctgaacaacgttcgcaaatcctgggtaggtaaagtgccggaaaacatcaaagagattttccgtgcgatgcctcaagctgaacgctttgagcattacaaacggatcgacgaagcagtaagcgcagtacataccggactgattcacgacgctcgcgaagcgggtacgaaaatcaacgagtccaaaagcaaagaattccttgacaatgcggcggatcgcgttgtagaatccctgattaacggcacttttgcctaattgaaaactataggttgaatatgaaattctctaaacaaacgatcgatatcctgaaaaacttctcccagatcaacccgtctgtaatgctgaaaaagggttcgttcattatgacgaaatccatcaacagcgtagtttacgcagaagcaacgatttctgacgtaattgacgaagatgtaggtatctacgatctgaactcattcctgaacatgctgaacgttgtaggcactgatgccgaagtaactcacgatctgtccactggcgaaatcgtcattcgtggtgagaaaatgaaaatcgttgagcgttcaagcgatccaaccacaatcgtacagcctaagaagcgtctggaaatgccagttgcggatctgattttccagattagcgcgaacgatttcgaaaaactgatcaaagcgtcacgcatgatgaaactgaccgacctgtctgttgagccaatcaacggcaagctggtaatcaccgcgaaaagtaaagaaagccagtcaaccttctctgtagaagtgggcgattacgaaggtgataacatgttcaatttcgatatgaagattgacaacatgcagttcatcaacagcgattacaaagttgaaatctcttctcgcggcgctgcgaaattctcgtccgaaaacggcgttgcgtatgtagtggtacttgaagcaaccagccagttcaagtaagataaacaaagtagtacacaaggggcgttaagcccctttttgataatcaattgaaggtaatattatggaacttagtgaaaacgtacagttaatcgaaaccaaatacggcaaaatctcccagtctcccgaagaattcgcatgggatcagcgctatcgcccgacgacgatcgatgaatgcattctccctgctgctgataaagcgacgatgcgcggcttcatcaagtctggacgcatcgacaacatgactctggtttctgattccccaggtacgggtaaaacaacgctggcgctggttctggctaacgaagttgatgcggaagtgatgtttgtcaacggttccgattgtggtgtgaacttcatccgtaacgaactggatcgttacgcgtcctccatgacgcagaagaaaggcggtaaaatcatcctgattgacgaattcgatcgccctggtatggcagaagcacagaagcacatgcgtagctttatcgaagcgtacagcaagaacgttactgttatcatcaccgcgaacaacatcaacgggattcaccctgcgctgatctcccgctgtccggtagtcaagttcggttccccgtcgaaggaagaacgcgttgaactgatgaagcaaatgatcaaacgttgtttcggtatcctcgaaatcgagaaaatcgaatatgaccagcaggtgatcgccggattcgttaagaagcactacccagacgcgcgatccatcgttaaagctcttgggttctattctaagcgtggcaaaattgatgctggtattctgtctgagattgttggttcggacatcacaccagtgattgaggggcttaaagcgaagaacttcaaagcactgcgagccgaagcaatcaagtacgcgcctgagtatgaaactttcctggctaaacttctggatgcggtatacccgatcgtcaccaacgaatctaaggttgcactcattcaggcagtaggcgaaaacaacgcacagtacgggctggcagtgaacaaagagattcacctgcaatacctgttcatgggcttaatgcttaccctcgcgtgggaggcttaaaatgtcactggctgcttttctcgatgaagatgaactgaacgaacatgaagcggcctggcgttctaaagactgggacaagatcgaagaacttgtgaaagagtacaccaaagacaaggaaaacaccttgtttatggtgctcgaagaactgaacaacgggaagacaccattacggatctctgcccttgattcatacgataagtttttcatcgacaatgcaatgagccagcatatcgaaacgctgatacctgcatacacgatgaatatgatcggttccggtttaccagaccaggcgcactttgattattacctgcatacggtgcgcaaaggtaagcggttcggggcgtgggctaaactcaccgaagataacgaaatgaaagttatccttcatgttctccaaaaacgatacggtgtaaatacacgtatagcaatggaatattacgaagaactcaaacagcttgaaaaactggacgagtggaagcggaaaaatatgaaagttgctttatctgtgttggctgatgttgtgaaaaataaaaccgaccagaaaaaggttgaacaactaataaagaaatggtgatgtatgaacatgctcgaaattaaactgtccagcgatgacagtttcctgaaaattcgcgaaacgctgacccgtatcgggatcgcaaataacaaaaagaaaatgctgtggcagtcttgtcacatcctacagaaacaagggcgttattttatcgtacacttcaaagaactgttgaagctggacggtcgccaggttgacatgaccgaagatgacgaactgcgccgcaataacattgcgcgacttctggaagagtggggtatggtttccatccttacgccggatctgaaattctccgaagagaacaacttccgcgtattgactcacgcacaaaaagctgaatggactttgaaatacaagtaccggatcggacattaatcaaaagcccttgcagaaatgcaggggctttgttatattggttacataccacttgtgaggactaaattatgaaaattcgtattgaagaaatcatcaaagctatcgaatcaggcgatcatctgatcaaccgtctgcatagcgaagacatcaaactgtctcttacttgcaatctctctgacctgcgcacctacgcatatgcgcgggatcatttccctaaattctatacccgtatcatggaagaatataccgcactggttgaaaacctaaatcgaccagacacccaacgctatcacaaattagcgcaacgctcgcttgatctgaccaagctggctggggtatcattcctgtcacgattaaacacggagaaagaaaaccgtaatgaatgaattttatctatccgttgagcaaatgggcgatcacatctacgagcgcttcattgactctgagggacgcgaacaggttcgcaaaacaaaatatgcgcctacaatgtttcaacacgctatggcgggtgtagactcgccatatcgcgacatttacggcaagacctgcatcaaaaagaacttcgaaagcatcaaagaagcaaaaaactggatgcagcgaatgaaagatgtaggcatggaagcgctaggcatggatgatttcaggctggcgtatatatccgatgcctacagaaaggaaatcgaatacgaccgcgacaagatccgcattgcttcacttgatatcgaagttaccgcgcctgaattccctgatccccgcgaagcaaaatatgctatcgacgcaatcacacactatgacagcgttgaagataaattctttgtgtacgatctggtcgagggcgggttagatgaatgggtagcgtcgaaagttgataccgaaaacgagatcagcgaagaagacttgaagaaaattgtttaccgttcattccagaccgaaaagtcgctgttgtcggcttatatcaaagactggaaagagcggacgcctgttattgttacgggctggaactcaaacaagttcgatattgcgtatatcatcacccgttacctgaacatcttcgggcaaaacgttgttcgtcatttcagcccgttcgggaaagtgactgcgaagacaacaaccgaccattacgggaacgaacaactgggctatgagatttacggcgttgctcaaatggatggaatggatctctataagaaattcagtttcaccccgcaaccgtcttactctctgggtgcgatcgctgagttcgaaacaggtaaaagcaaagttgattatgaaggttcgctgtctgaacttcgtcaagcggatcaccagaaatacatcacgtataacatcgttgacgttatccgcgtgttggatatcgacggtaaacgcaactttatcgaactggttctgtctgtagcatactacgcgaaaatcaacttccctggggttatgtcgccgcttaaaacgtgggacgcaatcatttacaactctctgcgtgaagagaagaaagtaatcccagaaaacaaacgccatactaaaacgccgtatgatggtgcatacgttaaagatccggttgtcgctccataccgttacattgtatcgttcgacttgaccagcctgtatccatctatcatccgacaggtgaatataagccctgagacaatcgctaacagctttgcagtgcgtccgatgcatgaatacatcaataagactgcgccgcgtcctagcgacgaatttagctgctctcctaacgggtggatgttccgacgcgatgttaaaggcgtgattccggtcgagatcaagaaagtatttgatcagcgtaaggcgtggaaaaaacgaatgatggcgggtgagcgaaatctcgaactgattaagcacgaactcgaacacctgacagacgcgcacaaccaaatgatcaaccctgatttcgagttctacgaagatttcagcgatgaatcaaaagctgtactgaaaacgctgtctaagcaaatgcttaaagccgtgaagaaagtgtgtgagaagaaaatcgcacaggcgaacaccgcacagcttaaccgtaaaatcagtatcaactccctttatggtgcgttgggtaacgaacatttccgttacttcgatattcgaaacgccagcgcgatcaccatgttcgggcagttggctattcagtggattgagcgtaaggttaacgaataccttaacgaactgtgcaacactacggattacgcatacgtgcgttactgtgacaccgactccatttatgtttgtatggacaacgtgatcgcgaaagtcggcggtgaaagtaagttcagggataacaaccattgggttgacttcctggataagttcagtaaagaacgcatggaacctatcattgataagggctaccgcgaactgtgcgagtacatgaacaacgtcgaacacctgatgtttatggatcgcgaaatcatttctggaccacctctgggatcgaaaggtctgggtagtttctggacggctaagaaacgatatgcggctaacgtatgggactccgaaggaacccgctacgagaagcctaaattaaagatcatgggaatggaaacccagcgaagcagtacaccgacagcggttaaaaagttcttgaaagaagcgatccgtcgcatcctgcaagaaggtgaagaatccttacacgaacacttcaaagtatttgaagaagagtataaggcgcttgactaccgagaaatagctggtgtatcatctgctaacaatatctcaaaatataatgatggtgctggcttcccaatcaaagggacaccaaaccacatcaaaggcgttctgttctttaaccgccatacgaagggtattcaaggaatcaccccgatcatggaaggtgaaaaggtgatggttctgccgttgcgagataaaaacccgtggcaagctgattgcatcgcatggcaatccggtacgcgtttaccaactgagatcgaagaagatattttgaagtgggtagactatggcggattatttgaaaaacatgtggttagcccgttgcaaaacatcacggaagcatgtaaaattgattacgaaaaacgcgcatccctgaacactctgttcggtgatgactggtaagacctgacggggcagaaatgccccatttatataaatttgtgaggaatatattatgcgtgtatataaaccggaaaaataaatgtctaataaagcactcctgaaaaaactgatcaaaaactcgaatagtcaatctgcgtcaattctgtctgaaagcgatgttttcaataacatcaccaaaactcgaacccgtgtaccgatcctgaacctggcgctgtccggcgctttcgatggtggtctgacttccggcttaactctgtttgctggcccgtcaaaacactttaaatcgaatctggggctggtgacggttgcggcgtacctcaaagcgaatgaggatgctgtgtgtctgttctacgattcggagaaaggcgtaactaagtcttacctgaaatcaatgggcgttgaccccgatcgtgtggtgtatactcgtatcacgacagttgagcaacttcgaaatgacgttgtgagccagcttaacgcgctggaacgtggcgacaaagtgatcattttcgtggactctgtaggcaacaccgcgagtaaaaaagaactggctgatgccctgtctgacaacgacaaacaggacatgacccgtgctaaagcacttaaaggtatgttccgtatggttacgccttacctggcggatctggatattccgatggtgtgtatctgtcacacatacgacacacaagaaatgtacagtaagaaagtcatttccggtggtactggtctgatgtattccgcagataccgcgatcatcctgggcaaacaacaggtgaaagaaggtacggaagttgtcggttatgacttcatcatgaacatcgagaaatctcgcttcgtgaaagagaaatccaaattcccgcttcatgttacctatgagggcggtatcagtatgttctctggtcttctggatctggctatggaaatgaacttcgttcagaccgtaacgaaaggctggcgcaaccgtgctttcctgaataccgagactggcgaactcgaagttgaagataagaaatggcgtgaaacggaaaccaactctattgagttctggaaacctctgttcactcaccagccattccttgatgcgattcaggaaaaataccgtattcctgacaaagagatcactgacggggcagcactcgaagatctttattctgacgatgaagtagaaccgtcaaataaatttgatttggatgacgatatccctgatgatgtggatatgtcagaagagtaataaacaactgggggctttgcccccttttaataggtgaatcatggacattgaacaaaaaacaaagaacattcttgatgaagcaatgcaggacgttattcaagaactgttgatcaacgatgaaaacgatgttgcacacttagtgtacatccataaagtgtattgggataacggcttgaaagtcgaattcagtacgccggacgaagataaagaaaaactgattccgctggttcacgatgcaatctacgcgcagatcaagcctaatctcccaaagcctgaaaagaccttatgggcggcgttgaaagtaaagctgtataatttctttcagatgttcgctaatctggtttaagaggtaacaatgatcgtcgaaacaatattttcaaatctggtttttaatggtacgtattttgttcaggcgtggccccatttacgccgtgaatatttcgaagggaacgcgcaagttctctttgatttgatggataagcacgtacaggaattcaacagcattccttcacaaactgctttagaagtagctctggacaaaaagagcctgagtgatgtagtctacgaagacaccaaaaagatgatccgcagcatgaaaaatgcgccggaagatctggactggttgatgaaagaaacggaaacctattgtcgtgacaaggcaatgtatcgcgctctgtcccgtgcaattgagatccaggcgaatgctgaaaaacctgctggagaacgcaacaacaaaatccctgacgttggggcaatccctgacatcatggcggaagcgttagcgattagcttcgatagttcggtcggtcatgattacttcgaagactatgaaaaacgctggatgctttaccagtccaaagcgatgaagattgctttcaatatcccgatcctgaacgccattaccaaaggcggcgcagaacgtggaacattgaacatcttaatggctggtgttaacgttggtaaatctttggggctttgttctctcgctgctgattacctgcaatcaggtaaaaacgtcctgtatatcagtatggaaatggctgaacacgtttgttctaaacgtattgacgctaacctgcttgatgtgtcacttgacgatatcgacaacgggaacattacctatgcggactataagaaccgtatggaacgcctcaaacagtcgaaggtcggacgtttaatcgttaagcaatacccaacagcaggggcgaacgctaaccacttcaaagcgctgattaaagagcttaaattgaagaagggtttcgtacctgatgtgattattgttgactacctggggatctgtgcttctacccgtgtacgcggggcggaaaacacatacatcctggttaaagcgattgccgaagaacttcgcggtttggctgttgaaacaaataccgtaatgtggactggtgcgcagactacccgcgccgcgtgggatgcttctgatatcagcatgggcgacgttgccgaatctgctggtcttccggctactgctgactttatgttagctgtgattgagaccgacgagttagctgatcagggcttgcagttgttcaagcagatcaaatcccgttacggcgataagaaccactttaaccacttcaaactcgaagtgcgtaagggtaatcaacgctggatggataccgacaacagcgatatagggttcaaatctgattataaaggtcgtcagatgccgaaaacgcttgaagaagcacaaggtgctatggtaaaacaagctgaaactaaccgaagcagtaagttagccgaagtagcaaacagcacagacattcaattttaacggggcttcggccccctccaaaggtatagtgaaatgaaaaagattctcgttattgtgttcctgatcctcctgtctctgaaactggcagcaatcggggttatggcaaatgcttcctggtggcttgtgtttgcacctctgatcgtgatcggtgtgattaagctggctttctgggtgctgtttgttgtggcaatggcaaatgtattccctaaactgactctctggattgcaaaaaacgcaaaataatcctgattaggggttgacgggagttatgattgtgataatatgactcccgtagacaacgaaacggattaaaggagataccaaatgaacttactgaacaacccatacgacgaagtgatgaacccagaactggatttcagcgcgggttatttcgatgcagtagtgaacagcgtagtaaacagaggtttgctggttgaaatgctgaaaagtgggaaagcagatgttgaaggtagcgttgatttcctctggggcttcctcccaatcgacccagaattcaaactctgctgtaacgaagttcaggccaaaaacgttcttcggtatctaatcaacaaagcataaaattaagccccgaaaggggcttttttgtatctgtaggtattgcaatccttctcgaaaggtgataccttattctaaacaaacaaaggaggacatcatgaaacttgcaatcgcttttatcttactggttctaaacgcacttatgggctttccgttcccgtggttagtgcttctggctatcccgtttgcatggaacctgttcagaatcggtttagcgggttgtgttggtgtcctgatgcttatcatcggcgctatcggtggcaaagacgcttttatcggtgttctgaaagccatgaaagagggcgttaaagaaggtttagtgaaatgagtgatttattagatatgatacttccagacgaagaaccggagttcgatagtccgtatcgttccgaatggatcgtatcggttgatgataaaggctatgtcgatatcatgcgctggcctaatattcatcctggctatctggacgaaggtatcaatgcggaaatgctgggtatgcctgaacaggttgaagatcctgctggggtgtataagtggatttgcagcccgtgggaaacccgcgactgggaaagcaatattgttgatgactggggctttgatgtggtagaatctacccctctgttcttattaccggaaaaggtcaatggcaaagttaacgaaagcggaaacgaagcaacacaacaagataatggatctggtggagtctgataaggcgctaacctacgacgaaaagttattcattatcgaaaacttccatgaaggtgcatttacgaataactctgaactgggcgcgttctttaccccgatcggacttgctcgcgatttcactattgatgcttgtaccagtggaagcgttgttgacctgtgcgcgggtatcggtgggctatccttcgcgatgcttcacatgatgatgtacgccaaaccgcgtgaaatcgtctgtgttgagttaaaccatacatactataagttgggtaagcgtatcgtaccggaagcgacctggattaacgcagacgcgttaacgacggagtttgatactatgtttgatatggcgatcagcaatccgcctttcggcaagataaagacatccgattttaagggtaagtatacgggcgcggaatttgaatataaagtgattgaacgtgcttcacagattgcccgtgcgggtacgttcattctcccgcagatgtccgcgaatttccgttactctggacggcgttatttccaacaggacgaatcaacgacaacatcgaaatgcaaaaagtttcttgatgaaactggccttgaaatgcaaccaggttgtggcattgataccggatactatctggaagaatggaaaggcgtgaaaccgatgtgtgaagttgtctgtatggaattccctgaaccggaaccagaacccgcgcaaaaccttttcactttcacaatagagtaaagactatgagcgatcaattaatcaaaaacatggatttaacctacagtgtgcgaatgattcgcctactgaaaaagccctggactgaatggacggcttacaagctgggtatcatcgacggtcaaggggaagtattgaaaaacccgaagacgaaggaagaactggaagcatattccccgttccatcgctctgtaagacatatcaagcgccgtttaaacgcggttccttatatgtctgggttcatgaaccttacaagcgcgtatgactctctacggaaccgttggaatctgaccgagcaagaacacgaagagatcatgatgaacctcccagaacttcgcgaaagactcaacgaagaaatggttgcaggtgattcaggcggaagcgtggataacattgcttcgggtgtgactacaggcgcgatcacgaacaaagggccaaaggttctgggttctacgcgtccatataaacgcaaacgtaaaatcatgaagagtgaagaatgaaaccattaccgcctttgaattaccggatctgggttactgcgaacaattacacctggtttccgatccgtatcaagtacatgagcgacaccgcgatcgtgtacacgaacgaaagaaaaacttcatcgggtgtcgatattcctagaccttatccgttttataagatattctatgaatggaaaatcactttagacggcacagagaaagaagttagccgatagaggtaaacatgtatcttgatatagagttcgcaactcgtatcatgggatcattaccacaaagcgaaatcgttcgacggggtggagaattcagtatccattcccgttgtccgatttgtggcgactccatgaaggataagcacaaaaaacgtttctggatatttccgtcaaaacgaggcacacatatgatgtgtggttgttttaactgcaactacagcaagccgttttctgtgtttctgaaagactattacccggatgattatacggcgtatttgatggaatctttcaaggatcgtaaagatttaaaacagacgcacgaagaaccgccgaaggaagaaaagaaatatattcctgaattgcagttctgcgaacgtctggacacgttgccagaaaatcaccctatcgttaagtatgttgcaggtcgtcacatacctaaagacaaatatgatcgcctctggtttacgcgtcaatggcaacacctggttaactctgtgaatgcggacgcataccctttaccgaaggatgaaccacgtttggtgatccctatctttgatgaaaagggtaaaatcgagtcattccagggacgcgccttgcgtgacaatgccaacgcaaaatacatgacaatcaaagcatgtgaacactcaacgaaagtgtatggtcaagataccatcgatccgttgaaacctgtctacctgcttgaagggccgctggatagcctgtttgtagataatgctggtgcgattacgggcggacaaatggcgctgtccgatgttccgtataaaaatatgcgtgtctgggttcttgacaatgaagcgagacaccctgatactactcaccgccttttaaaattaattgaggctggcgaaaaggttgtgttgtgggacaaatgcccgtggccgtcaaaagatatcaacgaaatgataaaaacggacggcgcaactaaacttgaaatcatgcagtatttgaaagataatactgtttctggactcacggcgaaacttcggtttaagtcgtggaacaaatcaccgaaaaaatgagattgatatgactgataaaaacacttttacatcatgtgcgcacctggttaaccctgctgatctggaatttgttgataccgaatatcaaaaggttctggcacgtaacggcgatcctctgcaatcaatgctggatctgcaaaaccacgcacaacaaagcctgtctgataccctttcatgggttccgcgccctgataacctgaaaacgtgcggtgatatcttggactggctgaaactgcaagatgatgcgattgcagatgaaacccgcgaactttacaccgctctgggtggtatgtctcgcggtgcaaaagcggcttccggtgtatggaaaccgtggaaagcaaatcatcaagaactgcgtagccaggtattcgcagaaatgaaagaagaagacaaactggaaatcctgtttgaactgattgatcagtggcacttcttcatgtgtaagttcctcgcgctgggaatggatgcggaaaccatctacaagctgtatgctctgaaacaggcggaaaacctgcgtcgttgggcgaacaactactaatggaaatcgccgcgctacatgccgtatttgctttgtcttatatcgtctgcgcggtgataacgtatctcttcggttggtgcgttttccacgttaacggtgttgacagaaaagccgctttgatagtattatcattgctatggtttataggttttttctacgtcatctatgaggggcgaaaatgattgacaaatactatatcattgttacgaaagacaaagacggctttactattccatacgttgaaaacgggaaaacgccggaactgtttgcatcaccgcaacttgcaaaagataaattagattttatccgcaagtgctacgaaaccaaactgaactacacgccggatgaaccgcgtttcagtttcttccgcaaaaccgagcaactaccagcaaccgaagaacagaaaaaagagatgcgttggtttattgagaattcgaaaattcaaggggtattactcaaattatgagcgagttaacatttgatgatctgagtgacgatcagaagtccgcgcatgatcgcgttatccacaacatccagaacgccattcatacaactattacgggtggccctggtgttggtaaaacaacactggttaagtttgtctttaacactctgaaagggttggggattagcggtatttggttaactgccccaacacaccaggctaaaaacgtgttagcagcggctaccggaatggacgcaacaacgattcattctgcattgaagattagccctgtgactaacgaagaactgcgtgtgttcgaacagcagaaaggcaagaaagcgcctgatctgtctacctgtcgcgtgttcgttgttgaagaagtctcgatggttgatatggatctgttccgaatcatccggcgcagtattccaagcaacgctgttattctgggactgggtgataaagatcagatccgtccggtaaacgccgatggacgtgttgaactctccccgttctttgatgaagaaatctttgatgttatccgtatggataaaatcatgcgtcaggcagaagggaacccgattattcaggtttcacgcgctgtacgcgatggtaagatgctgaaaccgatgtctgtcggtgatctgggtgtgttccaacatgctaacgctgttgacttcctccgtcagtatttccgccgtgttaaaacgccggatgacttgatcgagaaccgcatgttcgcgtacactaacgacaacgtggacaagctgaacgcaacgatccgtaaacacctgtacaaaacaacagaaccgttcattctcgatgaagtgatcgtgatgcaggaaccgttagttcaggaaatgcggttgaacgggcaaatcttcaccgagattgtttataacaacaacgaaaaaatccgagttttagaaatcatcccgcgtcgggaagttatcaaggcggagaagtgcgacgagaagatcgaacttgaattctatcttctgaaaacggtatcgctcgaagaggaaaccgaagcacagattcaggttgttgttgatccggtgatgaaagaccgtctgggtaactatctggcttacgttgcgagcacttataagcgcatcaagcaacaaacagggtataaagccccgtggcattcgttctgggcgattaaaaacaagttccaggatgttaaacctcttccggtttgcacgtaccacaaatcgcaggggagcacgtatgaccatgcgtacatgtacacgcgcgatgcgtatgcgttcgcagattacgatctgtgtaagcagttaatctatgtgggcgtaacccgcgcacgttacaccgttgactatgtataaggggctacggcccctatgaggttattatgaaattgagtatcaaagttaccgacatccagcagattctgaacgcagtcgaaaagattcgcgaaaaagaccctcatgcaaattccatgtttgcaatgtacagcactatcgatcctgctgatgtgatccgtaagctgaaatacattgacagctacaataaaaatctgtattgccctaatgggccaagttattcatggggtaacgtcgcccttacagttgaacttacatatgaagaatatggtgttgttactatgattcttcgtgtcatgcgtaacttacgcgaaaacaaagacctgtggtacttaccatgaaaacagatatctctatgaaattccctcgtcttcatgcggatctgattgctgacctgattttaaagacaccccgcgagcaaatcccgttacacgttgattatgactatctgtgtgaattcgtggaagctgttgaaaatacaaagcgactcgaacagtcgatatataactgtggtttgcgtcaattcggtatgcagatgctgagtaacgaagaaatcagtgagtttgatatcactcccagagtagcccttgcgctggctggtttcatggaagaatataagaggattcgtaatgtcacatcttccagttgattacgtatgggactatgaaactgtaggcccgtcaccaaacggtaaactcgttgaactgtcttacgttccgtttatcgacgacccccacaacccgccaacattcgcggaactggtttcgcgggggagaaaatataagttcgatttgaaaaagcaaccggatcgcattgctgacaaatcaacgatcgattggtggaaacagcaaagcgaagaagcccgtcaaatcctgaaaccgtcgccggaagatctggaactgtatgcaggacacagacaattctttgaagacctgaaagcggacggtgtgagccgttggcaatcactcgattatgttcgtggccctgaattcgatcgcggtatcctggttgatatcgtgcgtaagatggttggtaagatcgacatcttcgaagatatgccgaccgtgttctggaatagtcgcgatgtgcgtacatgtatcgaaaaccgcctgttaacgcgtgatgcttcgacctgtcctcttcggaaagggttgcttgatggttttgtgatgcataattcaattcacgattgcgcgaaagatgttttgatgatagtctattcattgagatatgcgctggggctggaagaacccccaagtgaagaagaaaccgatccattgagtctgccgaggaaaagatgattaaattatcatttgtgggtaaaactgtacatgcaaaaacactgaacgaagcaaaagcgcagatgtttgacattctcatgaaccccgcgttcgttaaagtcgaatacgatgaatatgttgttcagcctggcgatagcatgtattcaatcgctgaaaaattatacggttgtggtgagcgctggcagtctatcgctaagttgaaccgtaaaaccgttagtaatgcaagctatatccttccggggatggttctgaaattgcctcagttagtcgaattatgataaaaagcccttgcattcgtgcaggggctttgttattttgtagggactgaaacaaaagaggatgaaacatgtttggtgatttgaaagaaggtttgaacattttaatcggatttgcgatcattggtgtgattgcgtgtgtatccggtgcggtgtggttgtcttatcaggcgatcgtgtggttaggtgaatggcttcacattctggcacagtaaggggatattatgcgtttatgtttagttggtgtaggtttcggtcgtgcgttaactcaagggttaatcgactcaatccgctggattcaaccacgcgttgaactgtacgcaatgccgaaccggatcgaatactctgatccaacaccgtacaaaatgaaaccgtatcaagcgccacgcgttaaccgtgtgctgcaccgtcaatctgtaaacaggggtaagtgatgaaagaacttacgatcgtcgcagcagttctgattttcgtcatagtttcaatgattatcgtcagactgtaccagcacggagaagcgtttgaatggttcctagatcatgacaaagcgtttcgaaagcatttcgctggtgagttcatctttactcatgtaagcgtagcaagcggcacagtaacgtttgattttgacgggaaagggaaatcataccatatcgaactttcccttattgaagctaaacgcgtgtatgatgcgacacaaaacggcggtatgcgaaagatgcttataccactggcaaaataattttaatagcctcttgcaatgcaagaggcttttttgtatattgcgcacataccaaaaggaggcaactatgacacgtattaacacaatcgatccttctcttctgctgaacgaacacctgatcgcagaactgcgcgaactccctcgcatccccaatgccgttttatccggtaaggcaaaaatcaacctgtcaaaaatccctgctgtgtatacgctgggaaccggacacgtaaccttcttttacaataagctgggataccttcgcgatcgtcatgttgcattacgtgctgaatacctcacgcgtaacggtaaagaatacatggacggtgcatacgaagatttcgatcttagtccgctgtcaaactccctgtttcatcgtcatttgtgcgcggactggcaaccaacgccggaatcagtgaaaatcaatgttgagcgtatccgtgaacgtttcgaactgcgcaaacgtgcttatcggttcggtactgagatcatcaacgacgaagcggcatgggatacgtattacgaaaaattaaaagaaaaatacgattttctttgatttgggtattgacccaaatttcgatatgcagtatattacacacatcgaaacgaaacagacaaaaggaacgcatcatgaaaaacttagaagccaaagtagttaaagtcctggttaagaacggtttcaacgaaaacgacgcggtagcaatggttgaaaagaatctgaatgatgcgttgaaagttagaccagaagcaaaacctgctaaactcgcagaggtgattgtatgcatcatgtaaaagtaagcatcaaggatatcacggtgggtgacaccgtgatccacgaagggaaaatgaagactgtcgggaaaaacgatatcaagcacgaccctttgtttggtgttctcctgttcggtgatagtttcaacttggggagaacttttattgaccgggttattttcccgaaatggtatcaagggaaacgggtttaacaaatagcactttttgctaaagacttcacgggatagctttgatatagttatcccatcgaaacgaaacagactttaggagattgccatgtatacttttgacgaactgaaagccgcagcacagcctttactggatgcgatgttcaaagcccgtaacggtggcgcattcgaaaacgaattctttgaaactgttttcgttctggaaaaaggccgtaagtatcatcgtattgtgcaggatactcgcaacaaacagactggtgaaatgttcgatcagcgttcagttgctggtttcctggacaatgacggcaatatcctgaaagccgcaggatggaaagcacctgctaagggtattcgcggtaatatcttcaacaacccagagaacgcgatcgaccgtagcggttacgttcgctatcttcgctaaaatcggggcttcggcccctttggaatattaaaatgaaactatcagcgaccgcaagttggtcaatcttcggactgatagccgcaggggttttattcttcgcatggcaatcaagagatccgaacaaagcggcgtatgaagccgcacaacgagtagtagaacaggatgcagaagcgcaacacgaagcaatgttaaaacaacgtcgtgatatgggctttgtggagactgtgagttacacaaacgcttttggtgatgtcaccacgcgctctgtaaacgtcttagggcgcacgaaagggacaatgctcaccatcagacgggaaggaaccggaaagctcgtagacgtgtgtttcagcgcgattacggacgattccaaacgtagtcttttcgccccatacttttctacgcctgtctttgcaaaatttgacggcggagaaacaaaagagtttagcgcaagcagaggaagcaccgaagattttctgtgtattacttccccgcaacgcttccttttcaatatggatcgtgctagtgttatgcaagttcagttaacattcctggatcattactccaaagtgccggaagtgcatgaatggaacctgtcaacatataatgaggttgtgaagaaatgagcagacgcccaaagaacagcaaaaccgaaatgtttgcaacgtttgatgtaaacggaaagaacattgagggtaaaccatgcacgaactcaaagtttatgcatatcgccggattgcctggtatgagtgttaagacttcgtatgattgtcattacaacgaagaaaccacctctgtttatttgggcgaagaactcatggctgaacgcgtcatgcagtgtgtgcatttccctggcgaacgtccagaagtgaactgttttattgttggttatcataaaggtattgtaaatgagcaagtataaagttggcgatatgtacgccccgaaatctattttaatggctgtgtgtcaaatggcatcagaagccgatccgattcgtcgtatgtatgacgcgttgcgtaagaatccgatggacttcaattcaccacgccggatcagtatggtgtatgaagaaacagggattctttatcttgaaggtattcccgttcctgtaaagttcaacgatatgaaagggcttttcaatccggtatgggttgcaccagaaccggaaactgaaatcaaccacgtcaataaaggtgaggaagtaccgcgcgaaaattccgctgtagttctggataagtttttcaagaccgctcatagcgtcaaaaaacgaaccgttagcgacgtggttcaccacctgtccgcagaggttggggagatctccgaatgtctcgttcagcctcaacgcggcggtgatatcgtcgaagaaagcgttgatgcgatcgtgtgtgccctggatgtgatttacctgaaactgagtacaacccacgggacgacagaaatcgcgcaagtgatcaacaaactgcttgataagaaattagataagtggtactctacttgtagttaatcaattacgaggatcggatcatgttggtttatcgcgttgaattaaaagcgtctatattatccaaatatgatggatggtgtaagcaattaggcccgtatacgggttgtgtcggtgatgaagacgatctctatgagtatctcgatattcatggaatcgagttcggtttaaacttcggtatctccgagactcgtcaccccgcaccatgcgaagaccttcgtttaatgcgtaacctcaaaaaacatggtaaaaattatcgtagctatattttcggcttctcttcattgcagaagttgtctaaatggttcgatagctgggagcggcaaattttggagaatcagggatatatttgtatggtgtacgaaactgatctcatgtttgcagggaacaaacaatgtgttttcagcaaagccgcaaccccgatccgttttattccattgtcagagatttattaatgccaacatatacctataaatgcaccaagtgcgaaaaagaatttccgaaaatgtccagcatcgcaagccgcgacgaaccgaaagattgtgattgcgggggcgaggcgaaacgaacggttgataagccgcagatggtgaaagacggattcccgtacaacaagtaaaccccgaaaggggttttctttttcatagaaccctatataatgcctgagaactaataacgaggtgaatatgagtttagatttcttaatggacgataacgagccgcagaaagcaccagaagccccagcaaagggcgctaaggttgatgaatcattctgcttgagcgatcgcgatcacattcgcaaacgtccgaacatgtacgtgggttcagtgaacaaagaagcccatgaacgttttatcatgggtaaattccgcaaagtagaatacgtggaagggttggtgaaaatcatcaacgaaatcctggataactccatcgacgaagcgatccgaactgatttcaaatttgcgaacaaaatcgaagtcaagattgatcacaatctggtcactatttcggataacgggcgcggtattccacaagatgacgtgagaacgccagaagggaagattgttcctaaacctgttgcagcctggacaatggctaaatccggttctaacttcgatgacgaaaaccgtgtaacaatggggatgaacggtgttggttctttcctgacaaactgttacagcgcaatctttatcggtgagacatccaacggtaaacgcaaagtcacgatcaactgtacggacggagcgcagaacatggattaccgcaccagcccgacgaaggagcaagggacaaccgttaagtttacccctgacttctctatcttcggtgtggacggtatcgacgaagagacaaaggaagtcatcaaagatcgccttatggcgcttgcagtggctttccctgccgttaaattcacatataacggtgatatcctcccgaacaaattcgcgatgtatggcgcgatgtacggcgataaaacgattacccagacaaacaacaaaatcagtttcatcctggcgagcacagaagacggtttcaaacagaaatccttcgttaacggtctggatacgaaaaacggcggtgttcatgttgataccatgatcgacggtatctattccgaactcgaaccgatgatcaagaaaacacacgctatcgagatcccgaaagcccgtgtaaaagaatgcttgactttggttgtgtttttgcataacttcaatgcacccgcttttgatagtcagacgaaagaaaaactgactaacaccgctggggagttcaacaaccacgccggactgaactataaaaagatcgcgaaacatattatggatacttctgaaataatcactccgatcattgagtccgctctgattcgcaaacaggccgcagaagccgcagccattaccaaagcgaagaagaaagctaaaaaggcgaaggttgcaaaacatgttccggcatcagggatcgacactgacggggtagaaaccactttgtttctgaccgagggcgattccgccgtggggcagtttatcgagtgcagaaacgaagagacacaaggcgcatttccgctacgtggtaaaccgttgaacacctggggaatgagtaacttagaagtgctcaaaaacaaagaattgtctgaactcatggcgatcctgaatctccatccaggcgactcttccgaaatgacttacgacaacatcgggatcatggtcgatgcggacgttgacgggggtgatattctcaccctactgattgcgttctttagccgctggcctgagttgttcgagaagaaaaagatccgttatatccgcacaccgattatcattgcgaaagtcggtaaagatgaaaaatggttctactcccttgaagatttcgcaccgttccgcgataaggcgaaagaggtacgatatatcaaagggctgggttctttacgtaaagaagattacgatcgggtgttgggcgaccagttaaaatacgatacaatcgtactgggcgacgaatacaaagacgttctggaactgtgtttcggtgatgaatccgatccgcgtaaagactgggtgaacggaaaacataaattttcggtgaaatgatggaaagaagtattaaagacgttgtgcaggtagaagggcttacgtttgccctttacacaatttattctcgtgcgatcccgcacctggtagacgggttcaaacccgttcaccgtttcttcgtgcattccgcagcgaaaggcggtacaggcttccagaaagtagcctctatcgctggcggtgttgcaatgtatggttatcaccacggggaaacatccgttgaagaggcattgtctcttatggcggcgcactggtgcaataacatcccgctttttgaccgcgatgggttctttggttcccgtctggttaaaaagccaggcgcaccgcgctacattaaatgtaagctgtctccgctgttcaaggcgatctacatggatgaagatttaacaatcccacatgaagaccctgaacacgtaccgccagcctattacctaccaatcattccgatggtactggttaacgggttcagtgggatcgcgaaagcatacgctaccaacattccaccacacgatccgatttcggttctgaatggatgcgttagttacctgaacgggaaagatttcacactggatctgaaatacccgcatttcaaaggtgacattgaaaacggtacgatgtacggcaagtatgaactccagggtaaaactaaactggtgatcacagagattccggtcaagtatgatcgcgtgaaatatatttctattctggataagctggaagagaaagggtatatcgtaagctataaggatctatcgaaagaagatttccgctacgaaatcaccctgaaacgtgagtacgcaaacgggcttacccgtgagaagatcctgaaagatttcggattgattgagaactcaaacccgaacatcaacgttatctttaacgggaaactgcattcatacgagcgtcctgaaacgttgctgaaagacttcgttgatatccgtattggtgtttaccaacagcgtattgataaacgcatccaggagactaaggaagcgttagataaggcgctggcgaaggttgacttcatcgaccagatgatcgcacaacctgacgcattgaaggggcttagtcgcagcgaagcggttaaacttgtatctacgtggacgggttgcgagaaccacgccgaaattctggttgcgatgaacatctatcatctaaccacggatgaacgtcaaaagctggaagacgaagcgaacgaactgcgtaagcaactgaaatactgggaagaaacgaccccgaaaactgaatatcttaatgatttgaaagaactttcgaagaaattgaaataatttacaaaagcctcttgcatcgcgggaggctttttgttatagtgttctcactgatttggggaggatataaaatgttcaaaactcgtagcgacatggaaataaccatttgggacaaaagcatcatggcgaagtatggcttatctcattggtctttcaaaatcaacggacgtttcaaaagaactttaggtcagtgttcatacactcgtaagttgattgagttacgtcgcgatcatgttaaggaagacacatacgagaacgttttagatactctcatgcacgaaattgctcatgctctggtaggacatggagcgggacacgggatcgtatggcagcgtaaagctatcgagttgggcgcacagcctacgccaaccaaaagccgtatccgtgagaaatcagtaattcaggaaagcgaaaaagacatatacgcgtttttcctgaaaactccgaacggtgaagtttatcagtgcaatatgaccgaaaagatgtacaatgagatccaggaaggtaaacgcaacattgcaaacatctacatttcaagaaacaaacgagcaaccaaagggcgcttagtagcgcgtaaattgacaccagaacaatatgcagaggcgattcaatgaaaccatatgatgcaccaaaaacgggaaaatatattacaatagctgtgctgtgtactattgcaatatgttttgtaactgctatcgtggtcggtatcatggatatgaaagaccgcgaacgtcagaagcaacaggtttacgaataccttgaccggatgtgtacacctgttgagtatgggcttgatcaaaagcctgtgaaatattcatgcgataacatcatctttaacaccaagtgagatataaacaatgaaattacgtcagttagcaccacaaaccattcacacaacgggcttcgataaaggcgaacgcacgaagtttaaaatggctaccagtgcgaaaacgttcaaaatcctgtcatcaaccatctacaaatacaagatccgtgcaatcattcgcgagatctcctgtaatgccattgatggtcatatggtagcgggtaacatgaacccgttcgatgttcagttgccaactgttctcgatccgcgtttcatcgtccgtgattacggcacggggttaagtgactggatggttaaagaggtgtttacaacctacttcgaatccaccaaaaccgacaccgacgaactgatcggggcgctgggactgggtagcaaatccccgttctgctacactgaaacattcactatcgaatccatccaggacggcattaaacgcgcgtacacggcttacatggataatggtgaacctttcgttgaccaaatctacgaaatcgaaacagacgaacctaacggcgttcaaatcaccgttcctgtgaaagttgaagatatcgcagaatgggaacgtgaagcggcgcgtgtttacgaaccgtttacgggtatccgtccgcgctttatcggtgttcaggttgatgtaaactggcaaccgaaagaagcagacgatcgcgggatcatccgttataagtccatcaactattcaggcgtatacgcgcgtatgggtaacatttgctatccaatcgacatggacatgttcgaaaactcgctgttctactgctaccgtaacagcaattacgcgtatattctggatttccctctgggatcgctggacttcatgccgtcgcgtgaagagttgagccttgataaagtcaccaaaaaagtaatcctggatcgactggaaaagatcaacaaacgctatgacgaagagttagttgcggagttcggcaagcagaaaacaacccgtgataaaatcatatggttcaacaatctgcctagcatgttacaggcttttgtaagccgcgataagcgtttccgtgtgggtaaagattcgctggctgaaatcctgacgcatcttaaaagctctgagactgcaaccggaaaatatatctggggtttctgggctaacccatatgacgggaaagattgcgtattcgaacgtgtgggttctggtcgccgttatgagacatacaaagcggaaactaccaaacgccaggacgttatgcgcatgattcaaccgtggcgacagaagaaactgttcatcgttgaaaacgataatgaagcgcgttcactccgcccatatctgatcggctactgcatgttgaatggttcggatcgtatcagtttcgtaaccaaagagattaatagtgaacctgttcaggacttgatcagaactgggtatttcgatgaatctgagatcgttacactgaaaaccagtgaaatgaccaaagaattcgaaacgtataccgaagatcgtaagcgctggaaagcaacgcgtgaatcatcttctggtgattcagaaccgcgtccaaaaacgcctacagcatatcattacttcctggatgatcagggcaacttacagaaaaacgatctgtacctgactaaagcacagtttgtgaaactggatgaaatgtacgctatgcgcctttatggtgttgatgaatatagccgactggacggagaagcacagaactattcgttgggtagcatcgccagcagtatgatgaccatgttaacggttacagggctgaacgaagtgatggttctgcgaaactctctgtggagtcgcattccagatagcaacatgaaatgccttgatgattatctggtaaaacgttttgcggacgcagcgaagaagataaaacctaactggttccctgcatggatttcatcaaaccacggaagcgagatccgaaccctgcgcgattctatgggcgtaacccttgatcgcatggttaaaaaccgctataatccagaattgtatctgttgctcgattatcttgatggtaagtttacctatgatgttatcgagggcaaaaacaaatcaaaaactgtggtgcgtaacctgttacttcgtgaaatgtcaacgaagtattacaaaatgcggaaagatatgaaagaacgcgttgatactgcttacgatttatttgcagaacgcaacccatcaattcattacatgttgttacattcatcttattctacattccgcagtatgtttaatgatgataaaattgtgatggatttggtcaaacttatacggtggaaataatgagaaacgttaagatccttgatgatgtacaaaagaaagcagtttatgagggctttctgaccagcgcaaacaaaaccgcactggctaaacaatttggtgtaagcgtccgaaccatcgggcgcgttattaccgaacagcattctaagtataatacggaagcgtcgaaaccacttccacaaacagatgtcaaatctaaaatgattggttctgaatcgttcattactctggtactggacggcaagatcatcacagcggattcgtcacaccctaacttcgaaaaagcacatgctttaatggttaagggcgacatcgagggagttgctacactgttggacacaacgcaagcgttgaagatttacagcaaaggcaacattaaaatcatcgggcataaagtcctgtacaaagatatcgtgtttgacagcggtatcacacaacgtatcgttcgcgaaatgtacaacgatcgcccttacgagcacctggtgaacttcttcgagaagttgatggaaaacccttcacgcgatgctgtgtatcagctttacgggttcatggtgcataacgatatcgaactggcagatgatggagatttctacgcgtggaaacgtgttcgtgaagacttccgcgatctggcttccggtaagttcgataattcccctggtgttgtggttgaaatgccacgtaaccaggtagacgagaataaaaaccgaacctgttcatgcggtttgcatgttgccgcaaaatcgtacctgcctcactatggcggaggacgtgggcgagtcattcaggttaaggttaatcctcgcgatgttgtagcaatcccgacagattacgataacgctaagatgcgtgtatgccgttatcaagtgatgcgtgatgtaactgtgggattcagtcactactaaccccaaaacagcgcctggagcgattcaggcgcggaggattcgattatgaaattcctacagagcattcctgactactggcagaacttgagcggggcagaaacagccatcaaaaccgctaaagaaatctggaacggaggcaacgttaccgctggacgtacagaagacggagaacagacatacttcaaaaaaccttacggtattatcgcaacagcccttgcatttaatctgggttatgttatgctggtactcgcaacggttcagaagtgggtagagataccgatgaaatggatcgggacgttgttgattcgcttagttcgcttagtgttcggcgcaacgatcttgattttgtcatgccctatcttcttgctggtactgacaatgaatatgaaaactggtgtaaacaccaaattaggaaataaactggtgaagaaaaatgaaaagaattctgacaaggcttgacatccacaaatatgctgttaagataggtgacatgaagcgcggtgacttcaccaagttcgaaggggttgacctgaaagaacacggcttctacctggtagttgatgataaaacgggtaaggtagtatttcgattctacgtagccccaaatcaacgccgtaagactggcgcaaaccgtactctgttacgcatcaaacgccgcgaacatgaaccatcagcgatggtggccttgctggatagtgcttctctgtacttcgttgcacacgataagattaaaaacctctttggtttctcgaatcttactggtacaatagcggaaagcgcgattcagatgcggttcggggatggtgagaactatactgaatacaaccgcgcactaaatgatctgtttgactttgaattccaaccatactaattgagataatgaatatgaaactgttttccaaaatccgttctgtagacgaaatcgtagcaacttttgacaaaaccctgaccgaactcgaagcgcgtattgcgcatgatcagaagcaggtcgaacaggtagcagcagaccgcaaagcagcggaagaagaacatcagcgtaagctggctgaactggctaccaaagaaagcgatcacaccgcaagcgcaacccgcgccggacgtatcgcggataagatccgcaaactgctggattaattcgaggggcgaaagccccttaaatatttctttttgaggggctttaaatgaacaatctggtagcaaaacatgatttcaaccgcgcttctactcaccgcgatcgcaagcgagcacttaaagaagcaaaacgtaagcagaaacataaaggtaagtgtgatgaaaaccgctttgattattcttgaggaaatcccagaaaacacggggctgtatctcgttgaagccgacgaagatatcattgaaatcctcaaaaccgctcacgggcattatgtgaacggatgcaacaacaccccagaacaggatcacgctgtcaatatcgttaacctcatgttagggccgcgtacagacgacaacctgaaatgggcgagcgaatccaacgttcctcatgagtatgtcgggatgtattatcagtgcaacgttgacgataaagcgccactgataccggaaaaacagattgatttagtagttcgaacaggtttcttcttatgagttcacaaattctgttcagcaaagaagatccattaggcacagattcatcggtgcaacgcttattctggcacatggattatgcaaaaaatcgttgtcgtaacccaaacaatacatggggaagcaacgaagacattgataaagcaaaaatttatcctcgcggaaaagcatactggaaaatttttgatatccatcttcataaagttatgaaagattcgaacgcatgataaaaaagcccttgacttcggttgagggcttttgctatattggccttgtcgaaacgaaaccactaaggagattcaccatgactaacctgactaaagttaccgcgacatacttcatttcttctggcgctaaaaacgctatgtacactctgcgtgtagagcgtcgtggaggtggattcacttctgataactatatctgcaacctgtctactgacccagataaagcggaagcgaaagcgcgtgaatacttcgatcgcatggtggatcgtctgaaccagaccgatactttccagatggtgttccagggcttcgcagatttcgatctgttcgaacgtcgcggcaaactgtctgtacaagataccgaaaatctggaactgctggaacaaggcatcatgccaatcggtaagcgtaaaggtgaagtgattgctgatatgccgatgtatacgattctgtggtgggctgatcagtgcaaagaaaacgacaacgatagcccagtatttcaggctatttgctcttactgcatgggtgtagcgctggagaaggattacatcgctaaacgtgaagaaatccgcgcagaatgggaagcagagcgacaggcgaagatcgcagcagcgcagcacatcggggaaatcggtaagcgtatggaaatgagcggggttgttgagaaagtgatttctctcggatatacccaagtttcttattacaccgaagtggaacgtttcatgaccaaaatcaacgtagatggtaacgtggttatctactacggaaacaaaattgttgaagagggtgatgtgattcgtttcaaagcgacacctaaacttcacaacgaatacaaagaagttaaacaaaccatcgttcagcgagtaaaggtattataatgacatacgaagaaatgcttaatgaagtgtgcgcgggtaaaaccgcgtaccgcccgattaacccagatatgatcgtgttccgcgaaggggatacgatcattcgccgttctcaccgtaaggttgagattaaccaggtattcattgccagtgttgaagaacagaaagcgaccgactgggatatagttgcagaagatgataaccacgacgaacttgacctgatcttagtcatagataatcacccgctgggtgttcgtccatacatctaccacaatcaatacagaggcgaagtgattctatcatgacacacgacgaagccatgaaagccgctacacgcggttttaaagtcgcccctgtgggtaaggctgggttctttgtatatcacagcgtagaggctggtttccggcgcattacgatagggaacattggatactggaacgatgaatatgtacctacaccatatgaacttatgcgcgtatgggacatatacgataaaagcccgatgacgaaagtaaaagatttcatcaatcgggctttgagtagtatgaaactgaaattatcatcgaatcctgcctaaaattcttgcggcctgattgcacacgatcattaacttcgtatcggtgacttcgggcttctgtatataccattccattagaatcgatccagaatagtagttttcgagattgaaataaggacaactaaaggtatatgctaccggaacaaggtcttttgttggaagatacgggcttgcaatatctgagatatagtacagcccgtttatatgtctattatactcttccgatgtcttgtctataggatagccacccagatttttcgggttaatctgttgcggtaacttcccttcatacgcaattatatcaacaaaataattgacattcttaggtctgaacccaaagattgccgaaaaatccgcacccgtagttaaatgcactatgtttaactgttcgatggatgcggattcaaacttttttgccttttcaatctccatcgtcggcacgtctataacgcttgaagatgttttccagactgaaaataagtcatcccacttataccatgttacgaacataatgaaaatagtgacgataagaaccaatttaatgaataactgtttccatgttttgaccgccatgatgaacgatattacccgttcaagcaccgccaatttatcttgtaatagcgccatatttaatcctcaagttcggggatgccgaccccgaacatatttaggaatttacttaacgttgagtgaccagaccggatcgtgtttggcctacacgggcgttcaaatagtcataccacgcgttatgttgggcagaagcaatctgatattggcgatatccatcctgtatacgaccgttattgtcaaagtcaaacacaccgccgtcatccatcgtaagtcttaggttaacagcaggaccgttttgaatggtaattacgctaatctcattgctgaattgtgcagaaacacaagtaccgaatgcgttgccgttaaaactaccaccaactgcgccgtgaccggaaggtttcgaatatggtgaataccaaccaaccccccactgaccacgataacgggcgttgttatagtaacgctcatacaccgtaaagttgatgttatatacggattgtcccgccattcgagacatataaaacggtgttccgattcgaaccgcgttacccgcagcagacatccaccgttgccctgtttctgtgaccgcagacgaaccgatccagccaggaactcctacaatagccataaaaatacctcatgaaagaggggcaattaagcccctaatttgttttcgattgcttccagacgttcacgcagttcgttgattgcgttaaccagaagcgcgttaattcccgaaggtgaaatggttaacataccagtgtcgatgtcttcgcgcactgcttccggcaataccttctcaacgtcctgagcgatcagaccggattcgcgatggtatacgatatcatcagcatcttttgattgcttatcgtagatataacctttaagctgttcaatcttgcttaatgaatctttcaattcaaccaaattagatttcagtcgaatatcggaacgaatatacacatcgttggcgtttacgttaccttcaacatacagaccacggttcatatacagatccgaagtacgcaactgtaaggtcgtattcagtcggtagttgtgtaccgatacgttatcatcagcaccaccaaacccgaagtatgcgccgttgttacctgccaaagtaatcagcaaataacacgattggttagtcgctgtgttattcagaagtaatgctggcccgttaacaccctgaacctgtaactgtttatagttagcagttgcaccagtagtccatcgcataatacgctggctatttgcataggcgttgagaataccgtcaccttcctgtttgaaacctgtatcgttatcacccagagaaataccagtcgtacccaatccgtttggcgtaccacaaccaataccgtttgtttcgaccgttccgttgaagtttaccgcgttgccaaagttaacagaaccgttaatgttcgcgccgtttcctatagaaacaataccagtagtcaagctgatagtaatcgggcgtaaactgttccatgttccataaggatcgccggagttggtgatcaaggtatagtagttaccaccatcatttcggtgtattaccccgtagtttccttgtaccgcgcggaactgtccaccagaaccagacgtagcgctttgaacttcgttacggaatcgagcataacccgcagtagaaatctgcaattcttcctgtccgtctgtagaacctgttgccagtctccacacaccaccctgaacagtttcatgccagattgtgtccgcgttaccgcctcggaactgacgcaaatagtttttcccgccctgtccaacagtaggcaagaaatattgcgctggcgtaccctggggaacatcattataatatgatggaacgtttacgttaaaacctaatttggtgttaatatacgttacaccagtaccacggaaataatggttatatcgtccgttgctgtctttatagcctaagtgggtaacaccatcaccaaccccgtttccatcaccgtttgtagttactcgaagtattgcagtgtttgctccttgagtagcataatcagtttcaacggaagcacggttattgaatatacccataccgttaaacgtagcctgtccaggaacggttagatggttagcgagaactaaagttccatcagatgcaaatctggttgcatatgcaccaccaccagtacgaacatataagttctttcctgtatcagcatagatcaaactaagctcattaccgccagcatcctggaagaacaggtttttgtttccgtcgcctttgatagccatttgcgcaccaaagatcgtgccactgacaacggtttgcatcccgatgttgaattgtgtccccgttaaactaacaagaccattatcacccaacatttgtaattcagcacggacagccccagcagcaccagttgtcgtgtttggtgcgccaaaagcacggatataataagcaccaccacccgcagggcgttgggtacaaatcagatcaacaaggtttgcccccaagtttggatctgacgttggtgacgtggtttttgaatgtataacaaatgtgcgtgtttctgcgctaggaaacccgtttgttactgggttattgtctgtgcgagttgcaacgagatacggttctgttgccctaaccattgcgatcctgaatggtaatttcaattcagttgcagaaccttgtaattccaaagttccttgcattgtatcaccagctttcttcacctgtgcatcgttcgttacgttgcctaatccgatttcggcctttgttggcttatcgttttcggtgtagattttaaagcctttatatgtgattgtgtttccagaagggagcaaaggcaagttcgcctgactccagatagtattaccgccaacggtagtacccgcttttaaatctgccattattagatcctcaaatgcttttatgatatttataaaaagaaaaagccccgaagggcttttaattagcgggatttaagttccctgacttcctcacggagttctttaatcgcgttaaccaacaaagcgatcgcagcggtcggagaaacagttaagatttcatttccttctgtatcttcgccagttttaacagcttccggtaatactgattgtaattgttgcgcaatcaaaccagcttcacgggaagtaggttcaccaccgatatgatccgctttatcgtagatcataccattcaacagttcaactttatctaatgcattttcaatcttattgaaattacttttcagtttttcatcagaacgaatataaacatcgttaaagctaccgttaccagatgcagtaaattcaccagaaccgttaaagtagaagtacgcaccggagtttgtaataatacgaactcgcgtctgtgaatcactatcgctaggacggtgaatatccatcgcagcaacatgagaggttccccacttcgtcactttccagatattataagcactggtatggatatttggcacatccagcagaataccagcagatcgagcagtccattgatcccaaccgccagcatcaacaacacctcgaatcaaaccgtggtcacttccgtttactggggtagaataatagatcataccattcttaaattcccatgtagcagccttgctattgtttgaacggattcgatagataccagaactatcagaccatgtaacagcacgttcagaaccgtctggttcttgataccacgtatgagtaccgccagagcttcggatatacaaagaaccgccgttcgtttgcatgataccaccagccaagaaattgtttcctgacgtgatgtttccttgaactactaaacttgttccatcaaggcgcatacattcctgtgcatcagtgttgccagtagcccaacgcaacgtaccgccctgaacagtttcatgccagatcgtgtcgctattaccaccacggaatttacgtaagtagttcttagatccacttgcggttgtgcttaatgcactcatacaataaacaccctggttcaatccgtcctgaacaatcataccgccaccaggtagtgtaaagttaccattctccccgaatataaaatcacctgagtttgaagtattcccgctcgctttgttcggtgtggcacagttaatgcgaagtccagcacgacgagtagggctatctacaccatctttatagatataagcgtcaacagcggtagaaccgtcgtttttggtgtattcgaaacgaatatgacgatttaccaaattttggaaggtcaaatccccaagtaacgctaaaccaccagtcattgtatcaccagctttgtttactgcccccacttctgccggagttggtggactgaccgtatcataaacacgccgccaaccattagcatcgccctggttccacgaccacgcgcccggagaacctgttccaagacgaaaccacatttcgttcccgaagtatgtttgaactaatgaaaccccactattcagtgtacgacgatagttaacaacctgtccgtaatacgtagtgttaccatatgggccatcggtgatgttaccgcctactgacagaacatcgttcttttcagttacaacagcagcaccgaaacttgttccagacataccgcgaggaatgcccgtcatatatcgttcatcatggttagcccagtttgtcggggttactgtattcgcagtaatcgcaccgctaaccgccattgatgcagcgttcgtcacacccagattcgtagtaccaattacgcggaaagatccttgctcaactgttatctgctgggtttgtgaatccaacgttaaacttgtattaggggaaccgtctttatttgcccgtagatatactttatttccgccgtcagtacgggcagcaataatcaacgaacccatgtttcgatttaaaccatctttcgcatacatgtttaaaacccatgcttccgatgatggggttgccgtaatatcgggacgatagaaaatcatttccgcagggtttgcgctacgttggatggtaagaacactattcgactgaatcaagttagcagttaatgaagcaccaacaaccaaattctgattgaatgtagtattcttcgcaacaacaccgccgttgatcgttgagagggcgtttatatcctccgctgtcgggcgatcgttctcagtgtatactctccaccctttaaacagcaatctatcgccagagggcagcagagggaggtttgacgcactccagatacccgcaccacccagcgttgtacctaatttcaaatcagccataaaaatttctcctgtaatgactgtatttatgaaaaaggggctttcgcccctttatctcacgattgacagtttaacgtctttagcggataccgtaccgatgtttgtgttgtttggataacgatataaaccgaaatcaaacgtaaccgcaccagcaggaacaaccccttctgctttatagaacgaatatatgtttggaaccgtaccggaatcaaccataccgacccctttaatatatttgttatcagcgtcccagaactgcattacgatatatgctgatttactgttagcaatcgcattcgcatcgcgtttcatttggcattgcatacggatcgtatcaccagcttttaatccgtaactgcttagtgacgctttcgttaccgccgcttgctgggtagcagtccattctttgaactggtattccgctgtgcttgtcgaagtatattcaaccggatcagaaacaatataatcaagttcagcaaagttatgcgaactgatcttcttgtcactgataaccccagtaggcgaaacaggcagagaaagcaattgttcaatcgggttttctgttcctgttgcagtcacttcggaaagtgtttgcattcgtataccgttcacaccgatcgcagcaccgttacgatctacttcttcgcgcggtactttagcaatttggacatttcgacactgagcaagcccgacttttacagttgacggataatgatacacctgtgaacccattcgagcatttaccgcatcagtaggaatagtgaaatatcctgttaacgaatgccatgtatcaggggctaatccggttgttctgagaatggttgatttgatccattgtccgctaccgttttctgtccacatatacaggtgaacttctcccccagcatcacgaagttcttttgaacaatacagatccccagtaaatttgaaggtgtcacccagataaacatcattaccgattgaccacaatccgtataaatggaagccgtacatatccccgctgttctggtatgtctggacatcatcaaccattctttcaggaataccagttaccccgatatcactaaattcatcaaacacaacttcaacaaaactcgttgtattgtctttcaaccccgtaccagaaccacccacaaagttttccatacagatctttttcatcgtagatgaatagatagctgaataagatgaacgttgggaattgctgtttgttgtcgtcggaatactaaagaatcgtgtttcaggccatgcaacagaaccaattttcctcattgttgctaaaaagttgtcatcacttttgatagcatcgaaagtataaaaacacacaattctgttcgctggaagtgaattcaggtagtctttaatcgcattcccgttcgtagcaggatcaccatacatatcgaatgctttgtaatccaataatgctaaagttgttccatcaatgacagccaggttaattccgcaagcaacttgtgttcgtctgtttataatatcagccccgttaatagatacctcaaccgagttgaccgcagaatcgttattcgttccacggacaacaaggcgatatttcacggcgtttgcttctgaaaacacattcgccgtgaaactatcagggccgaataacgccataaattcgttattcgccatttaaattattcctcccacacaaattcacaagtcttagttgttggatttgcgaagattttcacgttaccgattttgatatagtcacgcacaaccagagtatcgacggttgaacccgctaccgctaccgccccgatttctgccggagttggtttacgacctgcatgatagatcaggtttccgttgatcatcgctttgttgtaatcggtgatattgatattgaattcagtcaataccttatcgtcaatgccagttaagcgcatcttctggacgttaccagagaaatcacccgcctgaacatgtgccgtaccgctcacactggtaaagcgtccacccgtgccgtttacgctaactgacagcgcaccagtcatagtatcacccgctgtattgacataggtactgtcaagatgctgggtaaagtttctggtgttgattacggttgcagtagtcacgccgttatcattactgattgttacgccgttccaaccgttagttgcatcggttcgtaattgtaccgtaggacttgcatcacttgcaatagtcacatcacctgttgcgttcgtgttagccagtgctttaccattcaggcgcagagtagtaccggagtacgccattgtaccgttagatacatcaccaacagtcagaacgtcggtcgtgtcggttgtgccagttgccaagcgatacgtagttccctgaacagtttcatgccatgtagtatccgtcacaccaccacggaaagtacgaagcaagtttttagttccagcggttgctgtactcaaaacagtattagcataaaccgtgtttgctttcgcagactggttaatgttattgttcgtggttacggtgttgttaacagttaccgcagcgttagccgtcagagtcccgttagtggttacgttaccaacgaagttgcttgtaccgttgaacgtgttgttgcccgttacggtttgatctgcatcacgacgcatccagcttgcagctaccacaccacccagtttcaggctattctgtgctgttgcgttcaacggtaagaagttttgcagagcaaagttcagaccgcgaggcgatacagcgtagaaatcttccagataactatctacaggctgagtagaaccaaccacattatcaccgatgaacgtgttcgatttggtagtgataaacaccgcaccacggcgcaatgttgtagcaccccatgccggatcagtaccgttcaagaactgcatggtagccggagtaattgccaggttagtagcagtacccgcagcagcttcgctgttggttgcacaacgaatgataccttcggcggtatccgtcgctttcttcgcttgcagtttcttaggcgtgatgaccacgttatccagagtacctgcatcagtttcgccctgagtcgctacgcgcagagtaccacgctgtgtttcagtagcagacgcaatccccaggttaaccgttgtccagatagtaccggactgagttaaaccatcagtggttgcaaccgcaacatgactcgtaacgttgaagaactctttcagcttaaccggaacaactgccttattcgttgccgtacctgctgcaacttccgcagtggtagcgagggcaataataccatcaagcgattcagtagccttgcgatcgttcagcttcttaggcgtcaccgcacggagatcatcggttcctgtgttcgtttcgtcctgagttgcgatctcaatcaaaccgatacgcgattcagtagacgttttacgatggagcatttcaggagttactacgatcggcattgaagcagatccagcagcaccagttaccacttcgttttcggtcgccagaacaaccagaccttttgacttttcggtcgccgtcttctcgttcaatgatttcggagtcagtaagtcaacaccgttattgaagttgtagacgttagtaccagcatccccacgtaaagccccctccgctgtcgtagcgcccgttgtaacgagtttcccgatacctgctagggtttcggtcgcgcggcgcgtgtcgagcttcttaggcgtgattgcggtagtgtcatcagtaccagcgtttgtttctgtctgagttgcaatttccagaacaccacggcgatcttctgttgctgtacgttcgttaaactttttaggcgtaacaattacgtcatccaaaaaagtagccgtagtgttctggttaacttccgcagttgttgccaggcgagcgataccacggcgtgtttccgtagcagttttattcgccagtgtacgcggggttactgccagttcatcagaaggcaaatcttcccagtttttgtttacttctgcctgtgtagccagcgcgatcacacccagacgagaacggtttgttggatcaacacgttcaatgatcgggcgatattgtgcaactacccattctttcgtagctttcagatacgacaattctatatatggaagatagtcagtatcggcgttgaaagtcagagtgtcaacactgaaccagtcatcaggtggataatccttacgctgtgggaactgcatcatgtttttgttggtgcggatcttttcaccggaatcatctttaactttgattgtgcagttctgcgttttccccatcatatacatactgatatacacgcgatcaccttcggcaacatcttgcggaagagtcagcgttacgttacgcacagttggaggactaccagcgatcggggtgataaacacgtaatcgttcggcaacatgttcaggtcatcactgatacgacgcagacgaacgcgctgatcaccatcataaacgacccagcggctattagcctgatcgaacatgaagataccataaccggaacgctgtgaagtcacagaagttacgttgttgataccgtcatagctgatcgtgtgtccgctaccaggataaacttgcagagtcgcaacgttcaccgaagcaaggcgatccagatcgtaagttgtgattgagtcaccatcgtttgcgtatctaggcaattgcagagtaatcttgcctgtaccgctattacggaatgttaccatacccgcttgcagttggaaagaacccgcacctgttgcgttcacaaactgcgaatcgcggttatcgcgcatttcagcaacacgccataagttgccgttaaaaataaacgcaacggtcatatatgggtgagtcagtcgataagagcttgactgaatatcacgtaaacggatctgacgagtgtttgaacgcactaacaggttgttgacccctgcaagaccaccaccatctttaatagtgataatatcaccctcaacaggggcatctggcagaatataggtcagttcagagaaacgaccgtcagccattaagtacgtaccggattcaacagggagaccgtcattgctcgttacgttgttatatacccattttggatcgttacgggttgagatccattttgtttcatcgaaagcacccgctggtgatggaatatctgcgcgagcgtaccaaatacgacgcgcgtacatgatagccataaacgcagcataaccacgggtagaatcgtattgttggatcgtgttaaattcgttaaaaaagtcaacgttcacgccgtcgctcaacacagagcgtgatgctttaccaacgttgataactttttcgccagcagcatcaaggccacttgtggcgcggaatgatttagctaccattatcgttttcctttatcttattcaatactgatatttataaacaaaaaaggcgaccatcaagtcgcctttttctcacggtaattgttcagccaatctttaacaatcgcgtgatgaagaggattcgcataatctaatttgtttcttttcttgtatggcgtaaaagcgtttttctctttgtccgtcatttggaaaagggtttgaaatgatttgcgttgccttttcgtttgaactgcttctgtggtttcgataatggcatcgggaaaatatttttccttcatgtatttcgctaaccgcatatcaggcacaaataaattaatctttcttttgctgttgttgtgtcggatatcagaacgagcgcataactgaaaggctggttcgtaatatttactgacaacataagcatcaactaattcttcctcttcaagtccagaggacaccgcaaccgctcggagcatttgacgcagccagggtaacgggttgtaactgaataatgctaccacgttagtatagctcgaatagaagttcaacccgtgcgagttgtacgggatttcctgcccctcgctaaacttcgatctgtatgtgttggtgcaatagatgaactgttcgccccctaaaagcgcctccacgcgttttttaatctgggtgtatactgtcgtcccagattgagagagatcgcccgtataacgcgaataatccccctctgcgagcacatgtatatgtatgcgcccagtgtttttgtattgcttaaagtcaaccagcttttgaagcggtgaatctttgaactccacatcatgaaacgtttgcaggatcttccctgtaattgtgtctttgatgttggatgaagcaatggttacatttttgaacttccactggcttacgtcatgatcctctacgaagtaacagacatatcccgaatcgctacattgcatcttcaccggaatagcccctaacagagcacggtaaagcgggaacatcttcattgcgatatcatcacgtttacgaagaccatcataggctaatcgtgtaaccagttctcgtttttcttcgtcaagttttaaatcaacgatatcatcggcattgcaactaaacggcaagcaaatctcgcgtatgtgcttgatattgctattaaatcgcagactttcgaacgcaaccaaatcaggaacttcgtcaatatacagggaaaaatccttatacaaatcaaagtcatcaatgtttttcagtgctgcatgagtgatgaaaatcacatcgtaatcattgactacttcacgcagcgcatcgttattggttcttttggttcggtgatccgtgtccacaatcaccgcccgttttccttttacctggttgatgtaatagtcataagactgttttgataacatcatggaaatcgaagcgatgattgctttttcgcccgtttgattgatatggttcagaatcgcctttgttttaccgcttgacggaacacattcaatcgtattaaagatcatttattcttagcgtatttcttctggtatttcttgattgcttcgtcggtgatctgtttaggcatttgacgtgctttcttcggtttcagtggttcgacaccgaagatttcaacgccgtaatgtttcagcatcattgcaacgatttcctgacgaatgaagttgcggctaaccttttcagggaattgatctttaatctgcttatgaagacgatcttcgagcgcgtccaggtgagtaggagtgatgatcgcggtgttatcgcgttcaacgaatttctccatgtattccatcgtttcagcatgaacagcatttgcagcagggagtaaaatttcacggctcatttaatcaccaataagttgtttcagttgcagataaccgccgataagtttgttatcgacaaaaatacgcgggtattgaaacgctaaactacgttgccttacccgttttgctaactcttcgatacgtgggcgatcgtattcaaagcccagatcgtttttcgcttctttcagaacgggataaaatgtatattctatccctttttctgtcaacagcttttgtgcttgtatgcacccgtaacagttatgaagactttcgggaatgccgtagatttcgactttcattcttctttccgtatggtttgagatcctgcaaaatacgctttttctctttgcctaacagtttttcgatattctcaacagcggttaactgagtgtgcagatcgaacaggtttgcaatctggtcttcctgcattttcagttcagattccatgttgatttgatagatgctaccaccaccgaaaacatgttgcaaggcgaaacgaagcattgcatcggatttacgtactggcatcggtgcgatgctcaacgtttccaggttagccccgaatgatggatcgatacggagatcacgcagaggattttcctttacagggcgatacgtgaatttagggatatccatcagacacagatccgaacccgtaacaccagcggaaacctcttcgggcgttgcaatacgcataacgttttcagcctctacacctttacccagattaacctcttcgggttcttctggggtgaattcaccctcttccggcgttacttccttgaaccatttccatagtgatgcagggagttcatattcgtaaccaccgtccatgataaacgcgcggtcttcgaactcaccgatcgaggtgcgatcaatcgtcacgtaacctttttcacgaatgatgtttgcgatacctgttttccaggttttctctgcaaagatttcaggggatacggttaaaccgtaagtttttccagcgaataattccatgattacctcaaataaaaaaggggatgcccgtaagcacccccgaattatattacttacgtgccagtagtgcaagttttgcagcggcttcgcgaactgcgcgagctttctgtgtgacaacttcgatcgctttctggtgttctgccagtgcgtcttctactgcctgtgcagcttcgatgatctctttgtcgcgttgctgtttggcaatatcaacggtctgaaccgctggggtatctgcctgaactgcgccagtaccgagttcacggaagaacttacgctcacgatgcattacaaacgggaggctacgttcttgtgatatagttgcgtcaccgtcgccgtcaacagtaacaaacaccagaacgccgttgttgtttttgatgtgttgtacaatgcgtttgtttgcagtgtgcgagcgcaggaaaccagcttcatctaccagaacatacggacggtttacaacaaagttaccaggcatcgcttcaaccgttgctggctgtggtgcagcaggttttgcaactggttcggttgtcggagcaaggttaacgccgccgtcaagttcggaatccagatctggtttagctggtacaggagcaacggacggtttgcctactggttttggctttttagcgcgttttggcgctggggctttagccggagcaacttctgtgaagtatttcgcttcccatgcacgaagggtgttcatagcgacacctgccggagcatcgaaggtatagcgatcaccattgcggcttgtgatgtgtacaacaccgttcatcaattggtggatctgttttgactgaacactgttagcaatgtttttgccattgtcggtgaaaccttcgacatcaaccagcttgtaatctttaccagtttcgaagcgggtttcttttgttctcaccgtccacggatgtgaaccgcttcctttggtgatatttttcagtgggatcgaccacttccagcaatagtcacgggcttctttacgggttttgaaattcaggatcatgatattatctctcaattgggttaaatttatgctacgtggatatcttaacagaactaccaaccaggtcaagcgatatttttaatttcgatggaattctttttgaactcaatcattcgctgattatccgaaccgcgaaacggtttcttagtcggtcgatccttttcgtatcgtccatcgatcagaacatcaatgaatggtaacagcttagaacgttctgtatcgctctgtaaggcttcgagggcgtaacccgtccaaacccacacatctttatcaggaaacgtcgcacggacgcgctcaagcagttttaacaatactggatgattggtgcggtaaaacggatcgccgcctgtaagcgtcaacccgtccacatgaggatttgaaagaagtttaatcaactcgttttcagtctcttcggtgtatggtgtaccgttgcggggattccaagtgattttgttgtagcaaccttcgcatttatgattgcatccagtcacaaacaacactacacggattcctttaccgttaaccacatccatgttatagatgcggtcaaagttcatcagccttttgcctctgggaacaggttgttcagcgcttgggtgtctaatttcagttgaatcattttatagtgcctttcttctcaatgatcagttctttgatccgttccacgattacggcgtattcccagttggctaacttctgggtatcacaccactgttgaaaatccttcattgcttttacgtgaccttctttccagtaagtcaccgcgatttcgttgcaaagattttcagtagcagtatttttgattttcatgatttagcccctatagtttgttgtctacaggggcatattataacatcattcgtcttccgtcaactcttttttgaatccgacataataagcatcagatccattccatgttgaggcgttaacgctacccaacagaacacgacaaggcatattgttatgcgcagactctacaacctgggagactgaatccagcggattgctaccagacacccagcggagcagatgacgatcatcaccgttaatcggatcaacgaattcaaatctgataccgttttcaatcagttcgtgcagcagaaagttaatcgctttgcactgcgctttgttaatcagcataaatcacctaccagatctttatcaattttggtgtatgtgagcgccggatcatacttctccagcacgttctttttgcacgaatggatgaacttttccatcgcacgggctttcatcaatactttgaaatcttcaccaaagcattgtttgactgtgggaattgcacgagccgctttgtcacaatcaatgatcagcttgtattcgccttgtgttgtggcgactaccattgaaatcagaacacaaccatcaaatcctttttcattgattttatggaagttcagcttatccgtagtgcttgccaggttcgcataacgatccccgcgaatgttacccggagaactataccgagaaacgttgattgaaggaatacgaatatcttcaacgatatcacatgacgcaacagcttcaacgaaatcaagaattctggtcgctttgatgacgtgcgccttaaacgaaccgacttctaactcatattcatctttccagcctgaatagtagtcaacagcagggctaatcgctttcatgagcgcttcgggaatgtcaatgtgccataactgttctgcgtactgtttgcgccagtctggatacgttttacgtgctggtttgaatgcactaccgccgtcttcgaacatcatttctttcctctctttttcgtaaatgtcgtacacacttcttcgttcgtaagcgtcttttaggttgctgtttactatactatcatgcgtcagttcttcgcaatactttttatcccattcagaacacgcatgatcaaccatttcctgaaaaacgcgctgtggaacattcccatctacaagaatcctcaataagcgatcagtatcatcattcggtaaagtatgaaagtttttaggaagtttaacatagaagtttctcgcacgagaaatcaaccattcttcaccgcgatcacgttcaatagtgtaatcgtacataccaaaaaaggggctttcgccccttcctcttatttcgcgttcagggagtcgatgtaagcgctaacgtcagcggaggttacagaagcggcatttttgccacccagcaacacatcaatcttcgtcacgatggtatcgacgcttacggaggtgtggcctacagcggcgatcacgtcttccggtacagtcagacccagactttcggtttgcttgttcagttcgatgatctccaggttgattttgacatcagccagtttgcgatccagttcgacgacagaacatttcgatacaccctcagccatttttgcgtttgggtgtttctcgtcttcgcgcttcttcttgtcctcaaggaacttattgaagcggatctcttcgagtcggttttctctttctacccgtgcgcgtacacgggagggaaacagagtatcaaggattttcccgatcatatcgttggctttccgtttggtagtttcagatcgaaaggaacgttcacaggtcggacggtttctaattggagatattgttccatccccacacgcttaccacctactttgttataacgaatgttctttccgtcatagcctacagcctgtgaaatgtagtagtgtttagtttcgcgtaaacactccatccattcttgtgttccggttttgttgcgtacccgcgcctttaatggaaacatcattcaccccgaagaactttcagttcaccagacaaacgctgtagattggcggttgccgtatcataacgtttttcggtgtctttcagggtagtttcccgcgccttacgcaagaatttttccagatcacctggtttcgtcaccagcttaccatctacgtaaattcgtcccagcaggtgagaacaatccagcagttgttgcgcgtcggctttttcaacagcaggtttaatcgcgacaaactttttaaagaatccgcgatcctcgttatcaaacagataagaatcttcggaataccatgttgtgccattggcatcaacgatcccattaacacctttccgatcgcagtgcgttaccttgataggaaacacgacagatgatagttgattaggcgacagaggactaccacgcaaagctaaattgcggtacaccgtcccaaaactttcttcgtcacgaaattcaaaataatcttttgtccagtacatcatttttcaatacctcatagtttcggtatgtgcaatataacaaaagcccctcactttcgcaaggggctttttgattaattttgatgcttagttcggtgcatcatttctttgttcttaccttcgttgaaaccacggacagcaggagcacccaaataaccgcatgtacggcgcgtgacgctcattttagccggatcgtgattgccgcagtgcttacagtggaaaccttcttctgtaggcgtgaactcgtcatcagagccacatacaaagcacttatcgaccggaaggttagttccgaagtaatccagtttatccatcgcataatcccagactttttccagggcttgcagattgtttttcatatcaggaaattcaacgtaactgatatgaccagcagtagcgatgtaatgataatcggcttcatagtcgattttctcgaacggcgtcaccttgcgatcaacgtcaaggtggaaactgtttgtgtaccagcctttatccgtgatccccttgacgcttccgaacttctcaaagtccagcttacagaagcgatggcagagcgattccgctggggttgaatacagactgaatccaaaaccagttttcttcttccatgcttcggttgcagcgcggagatattcaatgatcaatcgacctaatttctgggagccgatacgatcgaatggatgctggcctgagccaaacatcaacagcgtttcgtgcagtccaatataacccagactgatagaactacgcccatttttgaacagttccagaatttcatcatcaggattcagacggacaccaaatgcaccttctgtgtacaggataggcgcaacgctggctttaacaccacgtagactatcaattcgagtcatcagggcttcaaagcacaaacccagacgatcatcaagaatacgccaaaaagcctcgtgtgcgtcgtctgcttcctgtgcttcaagagcaatacgcgggaggttgattgtcaccacacccaggttattacgtccatcaagaatttcattaccgttatcatcatgccacacgctaaggaaactgcgacaacccataggagatacaggaacgctagaaccagtaatagcacggttgttagctgaactaatgatatctgggtacatgcgtttagaagcacattccagggcaagttgtttgatgtcatagttgcgatcctctggatcaaggttgattcctttttccatgaacataaccagtttcgggaataccggagtgataccctctttacccaggccgcgaatacggtttttcagaatcgctttctggatcatgcgttcacatcgggattgaccagtaccgaacgtaattgtaacaaacggggtttgaccgttcgcagtatgcagggtgtttacttcgtattcatatgactgaaacgcgtcgaaaacatccttttcagttttatctattgcatactgaacatcacgagggatttgatactttttggcatctttaaagtgcttatcatatgtcatttgaacatatggagccagcactttatcaacgttagcaaaggttgtcccgccgtactggtgagaggcaatctgtgcggtgatctgtgccataagagcagtcgcaacaccgattgatttcgggggttcgatgtctgcgttacccatcttgaagccattagccagcatacctttcaaatccaccagacagcagtttgtgtatggcgtgaacgggctgtaatccagatcatgataatggatatcaccagaatcatgcgcttctacaatgtgttttggcagaatgtggttacgtgcgaagtgtttcgctacgataccagccagcagatcgcgctgtgtcgggaatacccttgcgtctttgttcgcgttctcgttggtgatctctttgttggacagattcaccatgccggagatatctttgaacagcttacttttctgttcacgggcaatatcgcgatcgtggcgatattcgatgtatgcacgggcgaccgctgggttcgttttcatcagggattcttcaacgagttcctggatacgggcgatcttcattgcgctaccatcgcggatctgattgtactgaaccagcatgattgcggcatcagcatccgtcatagtaccgccagctttttctacagcaatacggattttttctttatcgaaatcgacgtttttaccgtcgcgtttttctactttcatttcgttgccttcattaattgctttctatatttcgcggttaaggctttgcgttcgtctttgtcggcgtactcgaagcccatagaaaccatttcggcaatcatatcaggtttggtaagtcttgaaaaccattttaccttatctggtatgaatttgtcatgaatacggttttcggaatagtcttgtttcagatatgcaagcaagttctctaaccactggatgtaatcgacatcacgggacaccagaccggatctgttgaatttgtgcttcacaataccttctgtaccgttgcataggttacacagtaggccgcgcacacgtccggcgttttcgccgtctaacgcatggtcatggtcaaggtgatgtttctcgatctcgccctccaggggacgtttgcagatagcacaacagcccccttgttcggtaaagagagcttgcttgatagttgggtagtcttttttggtaattcgtttcgtcagcataataacaccattcagtaaggtgtcattatttattacagggtgcggacgtactcacgaagttggtcgaacccgcctacgtgtttcccgtcatggaaaatctgaggcatggtcatccggcgcgtaccaacaagcgcttcgagttcatcgatcaccgcttcgttcagtacaggtttaccgtcttccacggaatccgcaacagacacgaactcatacggatgttttttcgcgtccagcaagcgctttgagttcaggcacggagcgcagttatacacagaagggatatagccataaattttaaacatgttaacctacattaaatcgttcagtgttaaagggaatgtatttacgtcgcgtttctggtagttgcacacgtagacttcttgcgttttgttttgctcgtaagagtcggtatgctggcctaacagatactttttatccagattatgaacgcggtatttctgcatccattcaatcaggatatcattttgttttccggcgtggtgagtcacattggacagcccgaacatgattccttcgctgtgcagttcatccaggaaagcatataactcacgttcgcgatcttcgttccagaacttgttatacactgcatcggtgatcaggtaaggcggatcacaatacacgaaatcattttcacagatatcaatgtcacggaatgaaccactggaaaactcaatgcctttcacattctttttgaaatgttcaaagcgttttactgttgcatcgttgagcgtccggcatccgaaattagcgttgaagtcgcctttgtcgtttgtccggttaacgttgctgaatgaatgcaggatcaggacatagagccataacggatctttgttctggttgtattcatcacggaatttcagatactcttctttcttgtctttccccagtcccttcgatgcaatcaattctcgcacaggagacaggtcaggaagcgttttaagacgctcatacatatcaataagcgtcttatcgtaatcgttgcttagaacgggtttagggacgtttaacgacacactaaggccaccgcaaaaacaatcaatgaaacgcatgtatgaacttctttcggggaacaacttgaagagttcaggtaatagagactgcttgttgcctgtataggggataacacccaaataactcatagaaaagattccagattgttaacgtatggctgaacacgaagaatagaatcgtgataataattctccatcagttcgaagcctttgaaccgtctgttggttagtatcgacattttcatcactgtaccagaaccagagaatatatcaagaaccaagtccccttcaaccgtccacgttttaatgtgatcttctgccagttgttcaggaaatattgctgggtgtttgaatgcaatctcgtccttcgttgagtgattgcgccctacagcgtaataccagatattacccttaattttatccttgccaacaggtttacgtttcttaccggaacgtgctgaacggttcttttcgttggtttcggaaaagtagctgttttgtcgtgcggtttccttttcagggaacttacacggaatgcggatcgggttgaatgtttttggtgcgccttttgtccacacgaacatgtattcaaagtcctgttcgtatcggttatggttcttcggtagagcggttttgtgatagatcatcgtatcatgcaaccgaaaaccttgttcgatcgcgtacaaggcttgacggaaagatgtacccgtttcactaccgttgatagtcgcgtcacccacaacccacacaaccacaccaccgggagcggtaacgcggtacagttccgatatcaactctttccatacgtgttcaccccagacatcaccagagccgttataatggcgcaagttgtcatacggaggcgaagttatggtcaagtcaacagaaccagattcaagctgtttaatcagctttacggagtcgcctaaatggaggtcaaccccttctttgattgtggtaatcataattcaccaagtcctttctcaaataaggcgatcgtttcgtacttatacccacgattcaccacgaagcaatgattttcgcctaatttctcaagcattgcaatagcacggtgttcatcttttttatctttcaacagataagcaatccgaacaacctcttttagtgtcgcgttgtccacctgttccaacttgaacccgtagcccaccaacttacaaaaaagccccttgcgagcgacaaggggctgattgttgtagaagactactgatccgttatcgttggcgcggatattaaatccttgctcgctcacggataacccctactgtatcggaggtgtttaatacaccgttctcgtaatacgtaatcatcgcatcacgccacccgtcaggaatctcagtttccagagtgtcgattgttttgaattccacaccgttagtgatggtcatcagcaaacctttcttactctgtttccattcggaacctttcgggcatttgtaaacgcctttccacacaccattcacgcggatagcgcacagtttttcagcatacttttgagtgtcgcgggtaacttcttgcagcaaaccgccgcccataccgaacgcgatgttctcactcgcccacttgttcgcttccatccaacttaacacacggttgattgtttcaggcccgtggatctcgtcgccctggatgattcgaactgaattatgcagaactttgtaacctttgctgtttacggtgtatccgaagatttcgcccagtttacgcagggtgtacatgatgttatcaatcatatcaccggaatcaggacgaacaaccagagtaccacccgcagcaatgatttgctctttatattcagcaatgcgatctacagcgcctttgtagtcccaggaatcgtacacacaagcgtagaaactatccccgaacatttcgatgctgtttttatatgcttcgtcttcgttctctttaccgtaggaaatcgtagtcgaatgttcgcgagccggaattgaaacaccgattgcttcgacgttttcaacttcatcaaacagagtttgatagtccgcaaacagactgattgccataatcataccttcaacggtatcagtcccgatgaagttatagaggtgtgccagcccaccaatacccgcagattcagcagaggtcgcgccacgcgccccgaaatcatgcagacgtgtacccagtgtgatgttatatgcttcaccagtcaggtcagaagtcatatcaaggtaatgagccagaacctttttacactcacgcgatagcgttgctacagatgacggataccagataccgcgaatcgtcattgtctccagccacccagccaaccatgagaattcacgttcggcgtacacagtcgcaacggcatttttaaccggaacaaccgtaccttctgggatcgcacggaaagtaacagggacataacccagttctgcgatcttcttccacccttcgtagttgaaaatctctttcccaaagtgcttacggtaaagtacccgtgccaactcaacttgtttcatggtaattggttcggcaagaacccgcgcaacgaagttaacgccagcggttactacttcatcaaacttaccaccgcgagattcaatatagaacatcgccgcatcagtgccttgtggatactgcaaccagtgggacactttgtaggaatcagttgaggtgatcaggctattcagttcattaaaagttttcatttaaacgtactccacgttttgatttaaaagatacgatccaaacgttctggatggatcgtgttccagtatttactcttacagtctttcctggattttttaccattagagcagaacaccttatgatatgtcgtcttcttgtgcaactgtttgcacgtaggacaagtgatcatggttcctactttagcggcttttgcaacatcgtacaattgtttgatgtccttctgccgctcggacgtaatgacacgcccgtttacttctttgacaaccgtttcagttcgaatagaaccatcggaatatttaacttgctgtttctttccagatccaacagtaagccccattgctaaacggcttcgaagttcacgcttcgttctttcaaccccgcgcccaacacagaagaattctccatcttcatcatcgagatcaaggtcatcaaagtcagcccagtcttctagcgcgtccgcttctgaacactcattcattccaaacatagtcgatccttagttgctggtcagtaagaagacccggttgtcgctatagtcgatgtagcaatcccaccaacccgcacagttaacaccatctttttcaaggcttatgattttaacgctggttgcaacgtcatcatattcataaaccgcacccagttcgttcagcattgcttcaacgttagcccgtaagcctttaccgttgtgtgctacaccattcagtgccaagcagtagccagcgcaagtaggtactaatttgatttccatgatgttttccttttaggttagtgtcttgtctacgggagctatattaccacactcataactcccgtcaacaagtttttcgaattattttcaccaggtgatgtaataagtcagatcgctatatccgtcacgcttaggatcgctaaagttggtaatacgacgcgaacccgcgaaggtattgagtaacgcagcttgtcggttgcgctgtgtatcgaaagtaaacccttcttccgccagccattcacccagatccgcatatgctttttcggtacattcctgatccataaccttaccgataaaacgtttcatatcaaaggtatatgattgtttagtcggatatttcaggacatactcggaaatgtctttgcgggatgcttcgaccattttcgcgttgatttcgtcaacaagtttacgcgcacgttccgccagtgtcgggctacgtccacagcggggatcatcttgcgtttcgcgtttgacccactgtgtcccgcttcccgcctgtgcgttcacaccgattccattgatttctaccattatgtttcgccttttttaatgcctcttcaactgagaggcgttcgtaattacgtgattgttcgggagttatcaccagagaaaatccagagtaggaggtttagtgttaatccctaaagtatcgcagacttcatccagaacgttttgattccaaagattgaacgttggaaccttatacaatctggcaagccttgcagcgatcgcagtaccacctttaacacaaaaatctttctctaccgcccagaatagaacaaaatctgtaggtttgtccaggttttcggttaatacctgcattgaattgcgagcatatcggcgctgtacccattcgttttggttgtcgaagtgtccagctacctttctcgcttcgtcagcggctttgtacgtgtcgtattctgtatagtcgatgatatccttaccattcgaatacaacccgttaaaaccgttctcagggaggattatacgccgtctttctggtgagtagtcaaacatgaaatggctatccattccaggagcaccaccagagtaagcgaagatcccccgatcacttaaagcacgtccaatctttatggctatactcgcgatacgttcagggggttcacggctaccgatcagggtagccgtttttgcgttttcgagaacagatttaaaattcattgttcaggattgcgccccagttctcacgaaccagatttgacgcttcgttagtgaaggttttcttcgccagcgttggattttcgaactgttccaggaaaggtccgtagttacgttcgatttcttccagcgcatcctgtaccgtcagccccatcacgcgaccgaaatctttcgcggtgatattcgcgctgtcaatttttgacaggacgtttttcacacggttttcagtcaggaagcaggtgaattcgttcagcttcactttgtctgtttctgacagttcagaaggagcattgaagcggttcgcttgcttgttcttcttctcggtgaacttcgtcgttttgcatttgattgcaacacgttcaccgttcggcatgaaagcgggttgaacaggcttcatcacgaaaccttctgcgatgttctcaccttcatcatctttcaacatcatgaagtttttgaactcaggttcaacaccgttctttgcagggatcgcaccggagttcgccaggttaaccaccgaatcaaaggtgataggcaatgcgcggatctcgtcaaacgtaccgtatgccagcagtggagccattttcaggccaacagcaacagcgtaatttgcaacaacgttatcagggaggaattgaccattaacgcggatatcaaatacgtagaaatctttttcgccgtagtcaacatctttctgaacaccacgccccgcaaattcgccgtatacctgaacaaccaaagaaccagtatcagcatattccttatattcacaggtatttgctagaatttcccacagcttacgaacaggttcagagtattttgcaactactggttcacaaccgtaaaactgttcagcagggagaatttcaccgctacgttttgccggaatgactttgataccgtccgaagtgatcaggctaaaattagccccgtggatcttttcacgcgcaacccacacacaaccagtaaaaccattcatgatcacaccattgatgaatttaccttcataatggttagtcagagaagaatatttcacaaacataatttaacctttgattttcagttgtttttcaatttgatacgcagctttgcgtaacagtttcagttttacttctggaaggatcacagaacccttcataaacgcatcgagatttgatttctcgctattcgcggcgctggttactgcgatcgtgttttcaaccgtgtatcccagagaagcgttgattcgttccattgttcgggagtcagagcaaccgcctttgttgctaaatggtctgccggagtaagaacatactggttcactcattagcttcgcccagtcgcttaacgtcagagcaaattgaaggttgcggttacgcgcatcatcgtttttactgttgtataaacgagcgacacgcagatcgaattcaatttgctttgcacggcggcggtgttccaactcagcaggatcgagtgattccggttctactggctttggttttgcttcaaccttcaccaaatcctttttgatagtcgaagttatcacgcccgaccagcgattcatcattgaagaattcatgtaaacctcttatgctaaacccgcttcctggaatgccagcgccatagcgccgttgattgctttacgtttgttatctggacgcggatcgcgtttagctttggtcttaggcttacgctgttcttcacgatgtttattaatgtacacacggcgcagagcatgtttcacttttggattttctgcgcggaaagcacgaattcgctcaatttcctgaacaatcacgtaaatgtcgccgttatcgagcatgtgctcacgggcgatctgtgcatagcccagtttcagatcattgaatttgaaatgaatctgtactttttcctgctggctaacttcgctgatattacgctgaacgattttcatagttactttcctttagtagaatcaattttacgaataaactctaacacttcggcatttctgctgtcaacatttttaagaacaaaagttacaactacattaacaccggatgcttcgttccaaccatcagcacacgggatcatcagatcatccagagtgttgacaaggttttccatatccgcagggtgatcgacaaacaaagtttgcgtttcggtgatactggctttgaatcgtttcccgatctgtgcttcgagttcgtccagcataccagcagataacgcggcgatgtcgatgtttttcatcccaccatacacaacatgaaatagtttcatatgcaactaacctcattttcatatttttcgcgttcgaaacagtcgggttcgttccagatctggtcaaactcacgtttcgtcatgatatagccacgggcgattttgcgagttagatctgaaccgatcggagcataccacaaaatcaatttacacaccattccctgaaccagacaatcatacagccctttttccagggtgcgtacatctgttacgctatcgactaaatcgggggcacttcgttcaggatggtctttccactgactttcgatgatgtcgtttagttcacgatggaaatagatccacgattggaacgatgcatcaggcggatttgacttgcaaccagcaggataaaattcaagcattttgatcagcctcattcgcaatacagatcgccataaaggtaaacataacccccaacgcaaccatccagatcgcggttaaatctccatacaaagaagaataaccacccatcacttcaacgcgatatcccagcaagaaaacgagatacgctaacaccttatctttcataattcctcacagaaagcccatgcagcatgataaacgcttgcgcctttgtcatcgttcatgcataccacatctaccggacacacaacccgatacagtaccggatcaccacctattgaacgtgcagcccttccagcatagatacgagccagcccgatatcagcagtgaagaaaacacgatccagatttttctttctgcctttttcagacagagtatcagaatcacaaggaggcaacaacatgctttcgattccggcagcagtacatgatccgtgatagaactcaacgaactctttgcggcagttaatggtattcatggttatctccttgttttcagagattacagcttatcgctattctccagacaagtcaacaaattctttttcaacgtcttcttttgttctgaacaggtaatcagtaaggctacctgtcatcaattcgcgagttttagcaactgaacgaacacggcgttcacgttggctttcggcatcaccaattccgtgacctggttcccacccttccatatccaacataatgcgcgggtgcctcatcacacgaatatcgtttccatatgaatagctgttatattgcccgaatacaaatcttttgaatttttcgtgatgaacatcatcaacttcgacctgttctccgtagtaaacaatttcatcacagaacgcagcaagaacaagcccaccagagttttgaattttcaggattgcatggatcatgcggtgacgtgcttctgcaattatatcatgagagccaaatccaatctcttttgtcccgaagcgacagaaaatagaataggtgatgttcagcaggtatttcgcgacgatttgccattcattatagataggattgggattgacacggtatgctgatttatattcgcgacgcagttgaagaagtgtttctatgactttagcaacactccacccgttcggataagtcgaatcgttgcgtttagcaacagcaattgttgaatttgcgtataagtggttgaaagacattacgcggacgttatcgacgtaaccacgatcgcgatcactccatttgaagtaatcccattttggatcacaatctggacgcatagacggggtatgccagcgcttgaaccccaagagattacagaaatcgtcaatcagggtatcgcgacgggatttatattttgactggtcgccaagagcagcggcgttgatgaattcatgcagttcatttttcataattgttaccttatggttaaagttcttccggcctatccgtcgaacaattgcactataaacacactcataaaccgtgtcaataaatacttttaaataaacacctggagttctaagatgaaatcattcaaagactttacgagccttgatgaagcgctgatcaccttcggcggtaaggcttatcctaaatttggtcaggtagtcatcctggctggcggcgcgggttctggtaaagggttcaccctcgaaaagctgttaggtatcgaagggatcaccctggacgttgacgcactcaaaaaattggtcatgggtagtaccaaactggcagcagagatcaaagcgaaaactggtcacgatgtcaaaacaatgaacctgaaaaacccggacaacgtagcaacactgcatcatgtgatcgcagacgtgttcaacgtatccaacaaaaaccaggcgcgtgtgtacgctggtatcacagcagcaccggaagaccgtaaaccaaacctgatctttgacgtaaccctgaaaagcatgagcaagctggcaagtatcgcccgtgatgttgaagcgctgggttatcagaaagaaaacatccatatcgtttgggttatgaacgatgttcatattgctatgcagcagaaccttaaacgcgatcgtgtagtgcctaaagaaatcctcatggatacccacgaaggggcagcgctcactatggcgaagatcctgaatatgggcgactctctgaaacagtacatggacggcgatatctggatcagcttcaacaaagtaggcattgacagcgaaatcaagaaatctgacaaaggcggtatgtttgtcgttaagtctaactacatcaaagttaaggcaaaaggaaagccgcagaaatccattgatcagcttgataaagagttagtggcgaaagttgcagcatacgcaccgaaaactgatacatggggttgacaataggaacatatatgaatatgatgcacacacaaaccgaggaattgatatgaaaaagtttttgttcgatatggatggtgtactgttcaactgggaaggttcttttgttccgatgtacggtgacccggcgagaatgccggaagaagaattgaaaaaagcgaaacaggctatatcacaaactgacttctacgaaaatctggaaccattacaagagggcatcgacctgttctgtcatttgagaactttaggtcaggttgcgatcttaaccagcgtagggaaatacaattccgatgcggtagcagaacaaaaaagaaaagcgttgatgaaggtgttcggttatctgcctgaattccactacaccaaaagcagcggagagaaagcagcatatgcggacaaaggtatactgattgatgacagggcaaaagctgtgttgccattcagaaaagccggaggtaaagcgattctcttcgttggtagcaaagaagaagcattgaaagaaatcagaaaaattgcataaaagaaagggaaccattgcggttcccttttttgtttatggtgtgtaatccgcaaaggagcggttcacatcctgaatagtgatgttcatatcgtcgttcaggaaaacactacgatatttccctgcgctatcccatgcttgacgatgcttatcattgcgggagatcagagggcaacggtaagcgtgggctttcagttcgttcagatcccgacaagtccagaagtctaaacgtacaatacccatctgtgcgcatactttatccatgtacgcgattttttgactattcacccaggacgggctttttgcttcgttgacgagaataaaaccgacttcgcgatcgcgataggtcatgccccatttcatcatatcccaacccaacacctcgatcgccagtttttcatagaaatctgtacgaaccagggacgatacagcagcttcatattctgcatctgtcatgttttgtgggcgtttgccaaatttggcttcgattgcgtcgctgaattttgcgaatacatcattgaattcaaatagtagcatttttaccttcttagttgttattatggtgcaggtttaacgtttaccgtcagagttgcagtaacagatccagaggttgctgttacaacaacatcaccttcactaaccgcatgaagtttaccaccaacgatagaaccatgaccggaagagtcaacactcagagtcatttctgtaccagaaggatcgatggtaaacagatcagttgcagccagatccgcatcacctactttgaaatcagcaggagcggtttttggtgtaattgttacgacaggatcagcaggagtaaaatcactcagcttatacagataaccgttacgagattcgatgaaatcaacatcggtgtaatcaatatacgcttgtttcagtgtgtcgaattctttcgcgtatttttcttcggcataatcacgccagtcttcgcttgcagcattcgcagccacgatgatatcaaagatccaccacggcagataggtaaagctggtgttacgccacgggatcgggtgtaccgtagtccatttttctgtagccattttcaaaacctctttagtttttctctatttagagaagtaaaattttgccgtcacaagacggacatttatcatattggttcacgcgcccatagccgttgcattcaggacagaacgggtttgttacaccgaacacattacggatcgcgtaagtggattgttcttctgtcagccctacgaacccatcggtattgatgaaatgttcactctgttccggtagcatatcggtatcgtcatcaaggataaggtaattcttacatccgaaggtgtcgatccatgctttgatttcatcaccgcgtcctgcttgtcggtctgttagattcgtacaggttttcccaatgatgcgatacaatccccacgggtagaagatttcccgtagagtatgggttgtgttgccgatcctccatgtagaggaaatgacaatatcacagttagcatgatttacgatccggcgcaggtgtcgagcacattcaatgtccatatgctcaccaaatttcatgcaccgcatattatttagaacgccgtcgatatcaaggaagatgacgtttccgaactctttaccttctgataagtctttcaggcattcgtgatttaattcagtcatattttacctacaaaaaagggggcgtagccccctttgaattttaatagaaaccgcgagcttcgttatccaggcgacggtctgcaatcatgtgcgcttccatttggcgagaaacataatcaggatcgcattccatttttgcttcttcgtagttgtcccaggtatcagcaacccattttgaaccgttccaacgagcataaccaggttcagcagggacaggataatcagcttcgtaagcgtggcgcagtgcttcttcaacagtatagtaaggagcatttgaattgactactttcttcactttaccatcagcccaaacaaacagaactgggtagtaagcatttttcatcatttcgtttttcattttgctttccttcttcactgcgagagccattcccccgccttcgagtacaaatatactttaaacgagggtatgcgtcaacaagtttttagcaaaaagtgctaaaacttaaatgtttcgaatcggctatttctggtttcgcgaacacgaacttcgccatcgcgcacgatatagaacgcaagtgatttgattgtgtcgattgcgcttgcatgtggacagctatcaggatctttgtaccagtctggggtttgtttaatccagtcatagatccaccacggacaggtataatacccgttagaactcgcagagcgccccatcatgaagattgtcgggctaaacccttccaaccataccagttcgcctttggactcgtcagaagcgcttacaggagcttctacgacatcaggtactaattggatttgatcggctacttccggcgcgacctctttaacgtactccataaaatccgcagaagcatcaataaccacatcgggaacgttcggggcttcgatgacaggttcacccatagtcacctcacctttatatgcgacgatttccggttctggtgaatcgatcagcagttccggcttttcttcatcttccggtaaagcagcaaccagatccgccagcatgttatcgaaggatttttgtttgttcagcttaaccgcaaacacagtcatagcgtaatcggctaaagcgcctttctgttcttttgcgtcgagggtacggaacccatcaactttttcgtaatcaatgttcattggtatctccaagtgtttatccaatatttatgacataaatacgtatatactttgtacatagggtaatcatagtggatattgaagtcaaatttttaaacacaagccacgtacagattcaggcagaaccaaacattgtctatgaactgcgtgactatttcagcttccagcccccaggctatcagtatcaggccaaatacaaatatggtggatggaacggttacatttacttgatggactacaacgggaaactcccgtatgggttagcctatctggtatccaaattcgcagaatcacgcgggtattcaatctgggttgatccaaagatccacgaaactgaggatatcacgcaagaagattttgataagtgggttagcgaacatccggtttatgacggcgacaaacagatcgacccgtactggtatcaacgcgaatcagtgttccacggtatcaaaaaccgtcgcggtgttctgaacctgccaacatcagcaggtaaatctctgattcaggggcttatctctcgttggtgtctggaacattacagcgggaaagtgttgatcatcgttccgactaccgcacttgttgaccaaatgatcgaggacatcgcaaactatcgtttgttcccgaaatcggcaatgctgggtatccgttccggtacagcgaaaaacagtaatgcactgatttacgtttctacctggcaatcagcggttaaaatgcctgccgaatggttccaacagttcatgtgtttgatggttgatgaatgccacctctcaacaggcatgagcatcaaaaagattatcgacacgatggatcaatgtatcttcaaactgggcttatccggttccctgaaagaagggaaaacgaacatgatgcaatacatcggtgcgttcggcaaagtctttaaaccagttgatacgcgtcgtttgatggatgatggacaagtcaccaacctgaaaattaacacgatcttccttcgatacaaagaagaagaggtcaaaaaattgaagggtgcggactaccagacggaaatcaagtacgtaaccagccacacacggcgcaacgcgtggattctaaaattagcgctcaaattagcccgtgagaagaacgaaaacgcctttgtgatgttccggtacaaagagcacggaaaatggctgtacgagcagttgagcaaggtttacgataacgtggtgttggtcaatggtgatacagacattgacgatcgtaacgaaatgaagaaaattgcagaatcgacgaaaggtttaatcgtcatcggttcgatcggggtactgagtacgggtatctcaatcaagaacctacaccacatcatttttgcgcacccttgcaaatctgctgttgtggtgaaacagtctatcggtcgtgtacttcgtaagcacggatcgaaagcgctcgctactgtatgggatatcgttgataacctggctacgctgtcaaagtctaagacagccaaaaataaatacagtgcgacaaactacggtatgaaacatgctatggaacgtgtgcggatctacaatgaagaacgattcgactacgcgatcaaacaggtagaaatttaagaggccaaaatgaaaagttttactacattcgtaaacgaagcagcgattgatgatttcatgaataaggttgcttcgtgccggacactagaaggtttgaaagaacttgaaaagtattacaacacccgcgtgaaagaagtcgaggttgcagcatccgatgacatttcaatgcgtgacgcgatcaagggacggcgagaagaactgaaagccgaacttgaaaccggagaagaagagaagttttaaaaagaaagccccaaccgaaaggaaggggctttttaattttgaagcatagttgatttttaacgcggtgtcgtcaccgctattctaaactgcgtaagctgattaatcagccagccatgccccacaaggggtactgtgacacattcgccgcaacatgcaatcgtatatttgcggggtagtcaatcgtagttcgtgccgttgcacactgttagcataaaggttccaggttgagaaaaaaatcccaatcacgaatatatgttgcattccatataggccattaggtttatccgattatgaaaatgcatccatcggtaaacatgcccttgccctacaattatatttactgctataaatctgggcgttcgtcttcgatacaaccactttcaaacgaaattcgaagtgcatgaaccctggtcacacattcttccatcaatcccagcaaacgaaatacttcgttaaagtcgatttttgaatagtctttcatattcacacctacagcaacatttgaacttcgttcagatcgtcggcttcattgataccgcgatcattcctttcgttgagatattgcaaacatacgacaccgcagatcggaccagcttcattgacaaacgccgtattacgggagttcatcggttgtttgcacacaacgcatttgcaatcaaattcttctgccattttatgcaccactctcaagtttacggatctccaacatgtttttgatggagtagcctttgttcttaacgatatccagcgcttttccggtaaactctgcaatcagttcgaagtattggatcagcttgttaacttcaacggtcttaggatcaccggagatagcaattttgatttcacccgaaccagtgtaaatgacatcggtcatttcgctttcgtgtctaccagtgtagaacagtaaccgatcttttacaatcgcttctttcttcgcctggagttgaataagttttttcttagcattcgaatggtatcgaagccattttgaccaaatcttcggaatgtctgctgattcgctttgtaacttcaacggatcaatacgcatatcctcttcaagttcagcctgtagatcttcaagttttagttcagccatgtatcacctcaaaacaaagtaacattataaccagttagatcaagaagtcaaatctacgagcgaagcgagtacatgaacgaacgtagtgagtgaatgttggttaaaaagtatacgaaaatgtactgttttctctatatataaaatataaatattataaacagtacatcgtacttacccatcactcacttcgttcgtgaaaactcgcttcgctcgtttgaccttatagatctttattactataatggtcttctcaaaacaaaacttgttaacacagtttaggtaacttaatacctacgatctgactcagcttagatttacctgcaagagcagaccaatcatcacctttgatcaggtgatcggattcgctttctgctgtgtatgggttcacggaaagaccgtaacgcatcagaatagcaactttcggttgcagggatgccggatctacggatactttgattgaacctgcttcatcagcttcggtatacggagcgaagaacagagagcctacgtgatccatatcacccagatcatatttgcagccagtcagcatataatcgaacgggctgtttgtgtctgtatagacataataaccgttgttcagcttacctgttgccagtgggtgttgttcgtcggtttcgtgcatccaaccagacgcagccagaatgcctacaacacgcgctgttgcgaggacgtaggtagcatcaaatgaagtcgttctattcatttcctgccccatttcacacgctaattggtacaggatacgacccaatgctggagcatccttcgcggtgtatgcggtagtaccgtcaaaaataccatccgtaacgagtccatcaacgttgtaacgtttggaaacggtgatcagtgtttgaataatgtctttgttgacttcttcacttgccacggttcccagaatgtcttcgatcaccccatcagcttcgaactggttcgcttccaaatcctgcatcagttcaaccgtcatttcggttttaaacttacgcgagcgtaccggaatattccagcgatccatctggaaggaggttgacgcgatatcttcactggtttcatacttagaagtatcagcggcttcactcaccagacgaattttgctttggaacacagctttcatgatcgcggtgtctttgtcagtatccagagtgttcagggtaatcggtgcgataacctcataaacaacgtcagtgccgtcatgcttgaacaaatcacctttaacgtaggctttagtcagatcgatttcgtcgatgtctgtacgtccagagattcggcctgaataggttgcagcactggagaaagtcatatcaccattagggttgcgatagcgaacaccgaacagtgttgcaacagggagttctgtttcttgtacagcaaccagttcatgatagatcaggttgttaaccgcgcgagtcaaagaaaccagttctgggcgcgtgttctgtacgttgatgtcggtcgtgcctgttgcttcgttgataactttttctcgtttaccagacggaagcgaagactgacgcatcaacttgtgaattgtgtagtgtttatcactcatttctttggttcctgaatttatagggagtatattgtttatttatgcaacgaatttccattcaggaaatttgtcactctttaaacggtaatcaaggccagatcgagaaagccccaacgctttagcagcatcagaaccacttgcataaacaactccatctatcgacacagaacggcttattttggccttgtgcgcgtctgtgagcttagatccggttctgtcgaatgcagaacccttatacatagctttgatagtctctgaacgcttcctgttggattcttccgattgcttctttcctgttttgatttttgaaaggcgttcgcgcatttctggagcttgcatagctttcgaagtattttcagaaatcagcttgcgttgttcatcactccatccaatcaatgccattggagcacctttaccaccaataccagcattatatgtatctggtcgatttatgaattcaatatcaactatttccctttccttctcatacatttcttcacgggtgtcaaatacatgaagtatttcttttgtgaaatgttccataccatatttcttttgcgcttttttgattgcaataccggaacccatgtatgaatcgttgatatcttcggttgagtgagcaccaacatatattttgttattgatggtgtttgttattttataaatgatatgtttcataatatagcctcaaatgttttcactatttatataaacaaaaagggaacccgaaggttccctttaaaaagtcgttgtttttcaacaacttaggatcaaagtcccttaacccacacgcggcggaagtatgcgtttttaccgcacatttctttgctgatcataccagaggtgatacgatctgccggagcctgagagcgagagttcgcaaacgggttgatgccgataccgtaacgagttttgaagcccattactggctggaagttcttaggatcagaaccacgcagcggagtcagcgcaacgtatggagcgtagtagataccagcatccatttcgttatcacccttgtagcccacggtgaagtaatcctggcgagcgtactggtcgatgtacactttgtaagtgccacccagtacaccagcgaataccgctttagtggtgtctacgttcagagttttctggagaccctgacctgccggagtgatgccgctgtcgatacgagccagagcggaaaccacgttacgggaagcgatgatgaagttaccagcaccacgaccagtttgacgcgcgatttcgttcgcttctttgtcgatctgaatcagcagagctttatagctttcaccagcccaacgagcgccgcgaatatctactggatcttggaagtcaaacgcaccagctttagagcctacggtctgggtgaaaccagttttaccaatctgcgcggtgtagttgatcaggtcaacgatttcgcggttgatttccagcatgatttcagttgccaggattgcagacagttcggcgtcagcgtccataccgtgtacagcgcgaagatcctgtgccagttcaacggaatactgtgctttcagttgacggctacgagcttcgataacctgtttgtcgatacggaaagccatttcgttccacgggttagcgctggaaccgttgaagttttcctggagttctgctacgctggtagccataccttcggaaatttcagccagagtgcctttctcgttttctgcgattacagcagcatccagagcagcagcatcagcaccagttacggttacgttgccggaggttacgttctggaagtacgcgacaccagtttcctggaatacgtgcttaacgatagcgccggaagcgatagcagtaccggaagcgatagcagcaaacgcggtgtttgcaccttcaccagaatacatggtgtctggagcgaacatcggatggaatgcttcacgaacgtttgcaggagtaccgccagccagaggatctttaccgtatacagcacggagtgcgaacacctgaccagtagggccagtcataggctgaacaccgcaaatgtcgaatgcaatcaggttaggaatcgcacggcgaaccataccgattacagcagggccaatgttggtgattgcaccgctggatttaccagaggcaatgttggttgcgtcgtaaccgtgatcacccgcgatctctgcttccgccaggaaaccgccgaaggattcaacgattttttcgtcgcgatatactggatcagtatcagcatccttttcctgagtttccagaattgctgcaaccagttgttttttggatttggtagcgatatccggtaaaccttcctgagattccagaagatcgttccatttttccatcaattcgtttttcttagacattgtttcttaccttataagattaggaaagggctttagccgcttgtacatatttattgatcttcgatttctctgctggaggtgtattttcattcaccggaacaaagtcatctttagtggttgtctgagtagtggtactctcttcaacctgtttttccgctttagtcgctaccatttcaacgattgcggtcagtttggattcgaacttgtcggaatattccaaaccttcgatcaggttctgaaccttttcaatttgcgattcagtcagatcttttgttttttctgaaacgatggtatcgcgtttcatgttggcgatctctttagcctgagcctgattagcttcgaacaggcgtttaacttcctgctgattctcggtcagttcatcttcgagttctgcaacaacatcaacctgcgcttctgggataactacgttgtgttcaacgaacagttctttcattcccattaccagagattcgaacagatcggccttgatatcacgggacacagcttctttgttttcagagagccattcctgcgcgatgtggtcgaagtatttattcgcatcttcgtacagtttattttcgatttcgccagctttttcggcaacctgggcttcaaccagttcatcggagagttccgcgatctgggcgatgtgggtttcagcgagtttcgcagcacctgcttttacagcttgttcgaatacagtggtgaagtttgctttcgcatcatcagaaagttcaactgattcgaaaatgctgtctaactcaactggggtatccaggttctgggcttctgccaacagttgttctttaagcatttctaagtttcctgtttgatatgatattatttatatagacttttcaaacgttcagagagttttctgaaagcgtcatcatcagcactattattctcaacaagcggtttgcttgactgagattcggtaatcggcttaacgtaagcatctggagcgcttggcccccaaacaacatcaacgcctactgccaatttaaacccttcttgtacgataccgtaaccttttccagaatcggaaagtttacccagtccgcgagaagaaacacctggaacccaacctgcgcgaattaacgccgcgagtttatccccatcaccgttatcaccttcgacaacaacagcgcgaccccaaacgtcattacctttccaccacaatttttcaattaggatgcaagcattacgcggatcgacattcggtcgcggcgggtgattcatttcacccagagcttgacgggtattaacctgagttctgatataatcgtttactgcttcttctaatacttttttcggatacagtcgcttattgcggttgactttttcggcttgtaggaaaataccttcaatccgaagtttaccgtcttttttcgactcaccgaccgattctaaaattgaatcggaaatatccgcacaaggtaaaccccattcctcgattagcagcatatcgccgttttcattgagttgggattcattcatatttatagccctaatgcggcgcgtttacggagcgcttttttacgcttacgctgtgcgcgggttgtaatagaagggtttgcacgttttgtttttagcgcacgacgcgcaatttggcgacgttgagatttagttaaaccagttgtttgatacgcattacgttcacgggttttacggtcttttttacgttccacattaccgcgcgaatctacgtgtttaacaatgacttcatctaaactcaaaccctcgacaatggacatcatagccagggctaaatgaggttcattgaccgccaaattttcgatgatcttcacagtgccgtcatcgatccccagaacatcaacacgggctttcgcttcggttaaatggggttcgagatcttcgacgctgatttcttcgagttcgagttgcattatttacacctcttattcgtctttatcgtcgtcttttttatcagacggctttttgtctttgtcgtcgcctttatcatcgccgcctttgtcgtcgtcatcgtcatcgctgtcgtcatcgtcggtttcaccttcgatgcgtacagcttccgcgagttcaacgcgcatttcttggcgaagggcttcggtacggtcttccatgatggaatagaattgcttcttcgcttccaccagatcaccgcttttgattgcttcgataaattctttcatcaaaagttttcctcttcctcttcgggatttttgaaccgttcttctttggattcttcttcgatcagcttcgcttgttcgtcaatgtcttcatcagacattcgaagaatctctttcatgatgtatttatgggagacatatttcccaactacaccttcaacctgtgacatcaacgttaggcgacgttccataatctcaatatctttcacttccgcgtaatatgaatcctgctggaaaatgaaggaaattttactaacgttttcttcccattcttcctctgtgatgatttttttcgcgatcaggttagtttttaacggatcggaaagcacagggctgaactgaatttgcagtgtgcggataaacttactgaatttcagttcatcacgggtgatttcaccacccccaccaatttgcatacccccatcatcgcgaggcatacggcttaatggcacacgcagtgcttcatagagcttacggttaaaccatttgatatcatccatatcagagaagttcgcaccgcctggaagcgtgtctacttcggtgatagctttaccgtcacgacgcattaaccagtaatcttctgtcattgacaggttgttttgctggttcttaacagtacccgttttagcatcgtacacaacgcggtttttaagcccctgtgcgatgttatttacgtactgtgtcgctttgttgccacccatctgacctacatcgatgtagaacacacggcgttcaggtgcgcgggtgatacggtagatgaccatcgcatcttccagtaaacgcaattggtttgctggcttgactgcgcggtgcagatatccgataatgttgttactgcaatcttccagaccagaatgcgcatacacgatagcggagcgcgggattttaaccttctggttatgctggtagatctgcccgttgtatgtatagccatttttaggagcgctatacacgaaaaattcgcgataaccacggaatactttcacgccaccatcgagggtttcagtgatagattcgcggatcagttccatcgaacgcggatcaagttgacgcagttcgcggatacctttgctttcgtctttatgcatgattttatggaagtatatacgggaatccacataccaatcacggaacagacgcgcacccatgttatcaaaatcatagatatttagaacgttatcaaattcttctacgattttgtcctggattgccttactaaaatctgttttggcaagatccaaagtaatgatatctttgccctgttcattcacgatcgcatcgtcaataatttcagaaacagcgttttctacttctgggtaagacatgatgccgcgatatgtattgattaattgttctttgttctgaatcgccggatcttgtccagaataaaactgctggaatacgcttgcgtatttctgattagtcagatcagtttcgatttcataagcaccatcattatttttaggaggcgcgaccgaacctgtatcattttttaattgctgttcaagatctaattcgtcctcacgggcgaaattcttgaaaaagctaagtacattgccaaagcccaaaaagttcatagtaactccgaaaaataatgataggggtattgctacccctgtatttataacctttattcccaccagtccagcgcgaacgtaacctcaaaggttgacacttcgttgttgctgtcccagtccagggtaacttcgcctacgttagtagggaacagcccgtggatggtgtgatcggcggtaatttcatcgttacggtttttctgtttcaccgtagcggtttttttgtagttcgctggaatatcaccactaatctgatcgcccattccgtgcatcatgtttgaccatgctaccagagcgtcacgcgtattatgtgcgtcatcgttatagatcgtgattgtccagtcatcataggtacggtcaccagcaacgttgattttgcggttttggtatcctaccggaactttttcaactgtagccgctggcatggttgccgctttacacttgaatttaaagtttttgcccagatacgggatctctacttcgaacaggttcggacgtgcgaaatcaccggattcaaaggcgcgtaaaatgtcagtaagcatttttaacctcggattatttatgggggcttttcagcccccttgactttatacggcttgcggtcctaccagttcatcgaaatctgcgcctgtagacgttgctacgaagttcagagtgatgtagttgatagaacgaggcggtttcacgtagaccgttgctacaaactcgttacggtcgattacgtccggcgtgttgttcgtggtgtcacagattacacggtaatcgtagcaaccacccagcgcacgaatattagtcatgtactgacctgtatccatacggaacgaagaacgggtgaaatcgtcgttgttttcaaacagtttgtatttcgcgttatcaccgatgtctttcttgatcatgttgaacaagcgacgaacgttgatacggtcaaatggactcggtacgttagtcagtgttttatcaccgaacagaacgaagccggaaccacccgcgaaaccagttaccgggttaatctgaacctgatacattgcgtcacgatgtgctgtgcgcggttcgatagccagtttgatacagttgcggatctgaccacggttgtaacctgctggagacatccacggttgagaaacgctatcagtgtaaacacacaggccagcgatatcacctgccagcggaacccaacggttcacgtcattgtatttatcatactgatatttatagttaccatccaggaagccatagcttgaacttacgttcagattgttatcaacagcagcaccaccactgagtttatagccagtacgccattcaatcatgttatcaaccgcagttgccagcgggatattcaccagaagtgagcgcggaggcgacacaaacacggtacaatcctgacgttcatcaccgattgaaataacatgtttctgaacggtagacataatctctacggtttcgccagcacacgcaccagcaatcaacagaggcacatgcagagcttcgcgatcagcgaacatatcccaaccattcatcagttcatcagcgcctacagtatcgtttgaggacaaaccaccgccgaactccaggataccggagaagcctttaggccagttcagggaagtaccgtaaacgtactgagagccaccgttcgcgaaaaagtcatccatgaagatgttgacaccatagatatctttatcggtcttctcggttgacacgatgaaggattcctgtacaataccaccacgacgcacaacaaaagcgtactggttatcggtctgtggcccgtaggtcattacagaacgaccgctgttcttaacggaaaccccagaagggtagccggaaatcatagcgccagaatcgtaagcagctttggagataatctccacctgaacagttgaacccagttcaccaggatacagagccacaacagacggcaactgatatttctgggtaagagtctggaaagcggttccctgaattgtttcttttgcaatatccaggttcaacagagtgatcccagaatcgctttcgatgccgtcaatcgtaatcgacgcagaaacaccggaagactgagaaacaatttcggtagtccagccagtagaaatatctgggtaagtaccaatctgtttagcacgggcaacgattttttcgcttggaatgattaccgagaggatcttgccgttactgtcaactttggacactttaccgttttcttctacaacaacgctgttgtattttactttaatagtatcgtttacagtgtagttagaaccctgtgatgcgatagttgttttgatctggttaaaaattgcgcttgcgtttttagcggcatctttatcgacaacgcgaaccacgcggagatcattaccgtactgcaagaagttaacagcactcatgaaatagtcagcggtcaagttgtctggggaaccaaaatagtttaccagttcgacttcgttagaaatctgacggatctgataagctggcccccatgaaaatttaccgacaatggcagcgcgaccagttgaatttcgaacaacggtagattgtaccgatgtttctttggtttcaatacctggagattgtaaagccattatagaatttcctctaatttatataaacgaaataccgtgagaaccaaccgaaatcgtttcatcaccgcttgtaacgataaccggacataatgcgtcttcgtatagctgttcgcgttcccgtgcaaaaacttcattggctagtcttaaatcgtccttctcgcagaattcggcaaatttcatttgagttgtaagccaaccgaaacaagcaagcgacataacgaggtcgtcgtgatatccttcttccgcagcccacgaaacgcctttttctgagaaagtacgaaattcgagtattgtctttttgttatttatgatcaatttatctttctcgaccaggtctttcagcgtcgaacatcccatagcttttgatcgcttagtctgtttcatacccagatcgttgtaactgtcacaaataacattctcatattccagttcggaaaacagagatttggcaactgaatgccctgtgctatttagctcaatgtaaatccatgcctcgttatacatattcagataacgtaacaggatgtccggcaaaataagatgcgacgttttgtttgagtgatacaccgcaacctgttcaaatggcatcgtcgtaatgtcgatgatgtgcattgcatggtaatcctgtccgcgaccttccgctggatcaagcaccgcaacatatttatgcccctctactggacgtttatactgataaaagttcgtttccgtttcatcaatatcgatccatgtgagttttgacaacttccagccagcgatcagagttccactggttcccatgaattccgcgcagtgttcctgcaagaatgcctctttgctggagccagcgatcatcttagcagaccacgaataaccgtcatcaaatacgccgttgtcaccgtctgtatacaatcgctctttaaccgatgtccagatcgccgtgtaaggcacgaagccggattttccttctatagcagcgttccagatatcatagaagtggttaagcccgttaggtgtcgttgtgataaggattttcgatttacgaccagaagaaattactggttgaatcgctaaccacgcatcaacaaagttcgggataaacgcgcattcgtcaatgtagatcatcgcgaaggagttaccacgcaccgcatcgggagaagatgcaaacgcaccaattttacatttgttgtcaagttcaatagaacctttgttccattcaacaataccaggctgcaagaagtcgggcagtagttcgatcgcctgtttggtacgatccagaacttccgcagacatcgaggctttgtgagccaacacaccaacatatttatcttcgttgaaacacacgaaatgagccaggaagattgcaacaacggttgttttacccaactgacgcgacaggttacaggcaaccatacggtttttgtgcatttcgatcagcatttcgcgctgatagtcacgcaactgaaccttgattgtaccatagtcaatgtgggtgatcgcacaatatgtttcagcaaaataaacgatatcatcacgacatttcacccactccatcaacatttgttgcgtccatttagtctggatatacgcacgtttcaggtttgggttgccgttatatcgggttttcttgttgcctttatttttgtacgtggcaaagttcgaactgtccttagactgaatatcgaccttttgaatgccgttaattttcaggtagtcactgaacgttgtcggataccattttttatcgtgttcgctttgtgtccactccatccccaattcatcaattttctttttcagatatttgggatgcattaatccgatagggtgatctgattccttactcggatcgatcgtcggttccatttccatcagggtttacctctacagcttcaccattaatgaagccctctttgggttcatatgcactgccgtatttctgcatcagttccgtaggggaaccaacaaatacggttgcattctcgatattcatttcactaccaccaccgcctttttcagcacctggttttgtagtctcttccgtaatctcacgcatttctttgtgaatcttcatcaggccaatgtttgaaacgtttaactgattcatcaggcttgtgaatacctcgacgtggcgaggtgattcggagttcttcgcgttgtgtaatgcgatctgcgccatatccatgatcatctgattcatatggtgcgcagtcttacgcgcgagcgtataatcctcttccagatccggtttccggtctgctggatgtgattgaacatcaaccagttcaagtttctcgtaaacaaccacatcctccccagactcaacgccgccagggagggaatcgatattcagcaattgctgtaaatctaatttttcatccattctcattccctcggcttaggaggttcatcaccagacgggatcggcttatcgtgcgagtacgtctgaatatattcttcgcccgtgtagtcctgcataggcagatctaccggatcggcttgactatccacggattcaaagttatctttatctaacgggttcatgttagagaagaaatccgtgtaaacggttctgatttcgcccttgacatcggttacaggcgggtacagataaccctgtaattcaaacatgaatgaccactcaacatgacggcgttgtgatgcttcgccctcgaatgtggtatccggcgcaaccgattggagactgattttgatgtctcggtcaactgtgatttcgttcttatgcagttcggtaatcttgcagttgaaatgcggttgaaaatatggcaaaatctgttctgcgatctggaacatatcatcttcatatcgcgtatacacacccagttcgaaaatcagacgatatggcacagggttaaactgtgtgatcgtttttcgtggggttgctaactgtgtcattttttggttgaccgcgatactggttttacggattgcgttatattgcagatccaccagtgataagttcatgcgcggtaaaatcgtttccgttttagcaacgttttcctgactcaacgtgtagttaagtttgttcatggaagcgagaaacttctctttcgatgcataggtgatcggaaccttgatgtatttttcttgatcgccgcgtactcttttaacctgaacgtgattaaaaagcgcccccatcaggacgatataattacgcagcgaactattgtaccagtatccaaaaattttctaatccccctgctggacgcgtccagacttacagttatcaaagtgccagcgcttcgctgtattagcggcgcacattatcccacaatgggggcatcgtaccttttctcgttttttgcctttgtgagcagcaacgagacttgctatatgttctggtgatagcttctttcctttatgaacagcaccaattctttttctgaattcgtcggtatggtttttcccgtaaaatgggttgtttttaccgtcatgtttgcctttcatctgttcttttttaacaatgcgcattgcttttcgcgcctttgtcttttcttcaagaatgaactgctgttcttgttcagataacgatgaatagcgtttgtgttcataggtgaacatcatgaagaacgcaagaatcattttaggatcattggtttttgctaatgtcctgtgggccatcaaatgcttcattatatcaagttctactaaattttccggttcgtgttcgaattcaggaaataaagaacgtggtaatatatgatgtttttctgtgtgttcagtttttggagaagcctttatgatatcaacatactcaacgtatagatcatgaggcaaccattctttaagttttgcgtatatcataaaatcctcttcgaagagggtatagacttccgcctatacccatataacgtatttatggcagacttgcaaacggtgaaccgcgtccgttgacaacatcaaaagattcgatgaattcatcaccttctctttcaaattctttgtcttcttcgtactgttcaatgttgatatcagccagcccgtcaagatttcgaattggttcgagatccagttctgcatcaggttcgatatggattccttcatttcgctgcaattcaggagccagttcttcacccgtgtaaatgaatttcgcaaggttgattttgcgttgaggacgatcaccgaactgatagaacggatcggcttctacccacgtaatttcaaacaagctattgtccatcgggaaataaaccaaatcccccagaacaggaataccaccatcagtttgatgtgcgaacaaacgagggttaattaccagtgtcatttcatcgtttgaactcaacccaaatttactaaagaaatctcgttgcccttcatagttggcatacgattcaatataagcagcaattttccatgacttcgtaaatttggattctcggtcttcgcccaggatcttatcaatattcacgaagtcacgccggacgtaatacatatcaggcgatttcatctggattgattctgctgtcagtgaatcgtgtagctgttgtgtcgggttgtatttgtaccagtttacatacgggttagtgacctgatcctttaagttgcgatcaaccccttcccccgtagacaactgagcgaataaactttcatcccagttttgcattgttccccctacaccataatgatcggtactgcgtcagacatcgaaatcagttcatcgcgcagactttgcagtttggtttccgcttcctggatcagtcgcgtaccatctggagcaacaccaccaggcaattgcatcccctggaacttagccagaatttgtccgttgatctctttcaccagtgcggtagagtagtcttttacccagcggttgttatatgcagacgttccgcccgtaacagttgaaccctgtcccgctcgtacaccgcctacaacgctgttatacgggttttcgtagatgtcggctatggattggtcttccactgcgttagaacccgctgtagcgtatcctgcgacgcttcctacggagctagggacatcaacgaaggaacgaaccatcgcttcaataacgataatgtcgcctttgttcacctgcccccatgcgcagaactgaccagtatcatcgttgaaccagtaatcaggcagtggagccagcaggtcttgcattgagcgttgataggacatcatctgggtaaagtatcccatatccgcaccgtatgcgttcataccgtacacgcttgatgcacatcgaccgcccagagaaccaccagtaagccccattaggaaatcggtaaaccacggataaaccgctgtcccgtccattgtggtcaatgaacccatgtttgtgcgcaataccttcgtgatcgcgaagatgtgttctttgctcaagtcgaatacgttgcgcgggttatcatcacccagtgtcaaaatcagatacgttttgtttgtgccgttataatgatattctgcatacaggtctaaagcgcgttgaatgcagtcataaatctgatcttgtgtgatttcgattttgatgattggtgcgcccagacgacgaagaatttcatcctttaactgttctggattgttcgtaatcatatgatcctcaaaaggggcttgcgccccttgttaaaattatgctaccgtcacagtacattcagcagaggtaattttggttgagagtgcatcagtcacttcaactttatatactcccgcttctgctactgtagccaggcttgcgccagtttccccagtaacttcaaccgtatctttaaaccatttgtatgtatatggtgttttgccaccagtaacaacaacggctaaatccatattatcgcctgttgtgtaactcttcgttgccggaagatccgttgtaaacgccagagccggacgagtagttacagtcacagtcgcggttgctgaatcgttggtactgttcatcgcgtcagttacggttacatagtaatcacccgcatctgcgctggttgcagcagatttaacgatagaagaaccagtttcaccagtcaatacagaaccgtctttatgccatacgtaagtgtacgggggtttaccaccgctaaacactacttccagagtcaatgggtcaccatcaacaacagaaatatcgctcaagtttgtatcgaactgaggaaccgtatgtaccgcaatgtcaagttcatcagaagtaatcacggtattttcagcgtcggttacgacaactttatatacgccggaatcactcgttgtgatgttttggatcattacactcggtgaatcagtcccgatattttcggttcctttcttccactggtacacataaggcagtttaccacctgtaacggtaacagataaagaaatatcatcaccctcgatataatcgttacgaccgaccagattttgagtaaatgacaatggaactttcttcgcttcgtatttgttatccgcttcaacttctgtgatatacggaaccagagcatcagtaacatcctggtgagaggctttattctgttccagatcgtccagacgttgttcaacgttaccaccaccgccagcagcttcgagagcagcaacgcgagtagtcagatcagcgatcagcttatagatacctgtttcagagccagcagttttcacaccgattgctgttttgttgtcgcgagccgttttctgaataccatctttgaggaatggatcagaactggttgcgtcaccataaacagctttacccatcgcgatattagccgcaacaagtccagttgacgtattacccacaattgcggtaacatcaatcagtgcctggtgatcgtctcgctgtgtgttttccacattaagcagacggcctttgatgcttgttggctgggagtcagtaccgatatcggtcataacctgtgccatttcaccgcgcagaccatcatcacttgtttcaccaacgatcatattcagatcgctaatgctacgtttcattgtgctgatatcgtaacggatactacccggaacctgcgagttaccaacagcgctttccagaaggattacgcgaggcagaacaccaacaaccggatcattcatctgggtttgcagagtaacgatgttcgtttctgccgctttcatgcgtgaatcaatactacctgatccgcctgtacccgtgcgcccgatatacgtgttgatgtttgacagttcggtgttaatgccagtgatatcgtcaccgatatggttcaatcgaacataaactgattcaaacgttgctaaatgcttcggccccatttcgttacgcagatccgtaacttcatcagtcaattgacctacatctgagtttacccagtcatcttccagcttagtaatacgtgcttcgtggatggataccgcctgagcgttcgccattaccttgtatttcacgccggagccagtagaggacggatcaacatcaccatcttcgttgaagcctggatacgcccccagttcacctttcaggaaaatgatatcttttcgaatcgtgcgatgtttaggatcggttgttgcatcccatacaccaatttccttttcgatatcctgaattttcagagtgtggcttgctgtagttgcctgtacagaagacatatctactttcagcacgtcaacatcagcgacaactttatccagtttgtcgatcacgctttcatcggagattgtcgcgaggttttcggtaatgaggttaacctgatcgataacttcgttgatttttgatgtctgggtagttgtgtttgcttctaattgtaccgcgttcttttgaaccagaacaccgcatctgtttaaagaaccctcgttagtggttttggttttagcaccatcgagagtttcgccgttaacaatccaattgatctgggtttgtgtggtgtccgtagggacaccatcaacaaacgggatctttggtaacgggttaagttttgaaatcatggattaacccctttatcgtactcgaattacatagttgactgcaacgtttttcattcgcgtttcgtttccgccagttgccatagctttagtgtatgctggattcagttgcataattaactggtcgttcttttctgaatttttcaattcgtatattgcttcggatgacggaagattaccaccattacgatagatcatctgtaactggtgttcgtgggatttaaacatatcatcctggtaagtaccgaaaccacgtccaggatctaatccacgtccagcatcgaaaccgcgagcagcaacaccgcgcatatctgggaggttgaaaatatccccagcaccgccgtatgtatacccgatacgggaaaacagaacagggtatgtgttgcggttcattgcgcgtccgttacagataaaaatatttccatagtcggagttaaatgcagatagcatcatacaaccgatcggaatatttacttcaacgtcgctttgtgtctggtatttattgtcagcaacaatagaaccctgatacagcgcaccgccagtgatagcactgtttctgttgcttggaactacgttagcgccagcagacaacgcggtattcgctaatccggtgttgacatctgttgataatttaaccaaaccaaatgcagagccagaacccttcacagcagcaagtttttgcggagtaattgcttttgtgttatcagtacccgcgtttacttcctcctgtgtagcgatacggagtaagcctaaatcggtttctgttgcagtcagacgaataaacgtgtatggtgaaattgcgaaaccgtcacggatagtacctgcgcggacttcggcaactgttgccaactgtaccaaaccgaaattactttcagttgcgtttgactgtaccggaaccatagcagcaattgcttgcttcactttaagcggagtcattgcggtcgtgtcatcagtaccagacgttgcctgtgcagtggttgacagttttgcagaaccccagacgttttcttttgactgacgggtgttaaacacatagttcaatgaacgcggtgttaatgaaaccagatcgttcgttacggttactgattctgcatcagttgcgtaacgggtgtacccccatacggtttgtgatgcatgagggttttgtagacggtattccagcagagccggagttacgatcgtctgtgtgtctgtacctgcatcaatcatttcctgtgtagcaatagcagcaataccacgcacaccaggcgcggcattaggcaagccaacatcagtacgcgcccatgatccgatagatgcaagcgcttgctgaacattcgtgtacgtgctaggccattgcgtaccagcaggatcaaatgtcacgtaaacggatttatcgcttacgtggttaattgtgttgttcatttattgtccttatgcaatacgcttgaaatagtaaaccgtaacagcaggagtaaccggaagatctgcttggcctaatttcgaccatgtaccataaccagatttagcctgtacgtcgatcgtgcctaccatactgatcccattttcggaagtgttcgttacaggatgcggaaccgcgtcaataaaacgaacttctaggatctccccatttaaaccctttcgagttaccagatcgaaatatttttcatcgttcacaaattcagtaaatttgttataaacggtttcgcatacggttgatgcgttcgttgtgttgtcaaaaacaaacgggaacccgtaaacatgaacagtcgctttcgtctgatctggatctgggttctgaacagtaccatcaaacgtaatgctttcgacctgctgaaccgcagacggtgaattatcttctgccattgttactaccccattaatagggatttgttcagacagagaatataagtcatcaattgctgattgtacgttggggtattctaccccttttcgaagttgatcgacgtttgcgccgccaatggtacgtttaccgccaatcagcggtaatttcgaacccatttcatattgcaaaaaatctgcttcgcgggaagggactttcgccccctcccttgttttggaaataaactgtgtcatttatgctacccttatccagcggtgaacagtaatatacggcgggagcgtttttagtttatctggggtagtgttaccctgatttacttttaatacatcctcacggtatttagtgtaacctggccctgttgcatctggatcaacctgacaaccaccgataataatgatcccgttgtcatccttaatcagcaccttatcggttgaatggatttcaggaacgttaatcggtttaatttcataaccacgttcgccaccagtaccaccagaagtgtgagttggttgacctgaaccatccagatcgttgttgttcaaaccgaaatcactatctgcttcgtcggtagtccatccagcaaggaacattccttccgcataacgtgtccagataccaaagcccatataatcgcctgggttagcatcgttgtgcgcgttttcgtagattgtcccgattgggtgaataacgtcaaagaacgcttgcaaatccagaagacgaccactaaacggttctgcgacttttcgcgcggttttctgagtcgggttgttataatcggtgtattcaatctgattaaccagcgttacttcttcttcgttattcagataaatcttatcggtgtgttctttaataccgcctacaccgtcccattccattacagtgccgatatcattgttgaaccagcgaatagttaccacatcgcgagtttccagaggttgagcaaacttaataccagtaacctcggaatcaacaaaaatcagactgtaatcctgaccagaaggaacccacaaaccggagtttgcaatacagctatcttcgtcataaccttctgcgccctcacaaataaatgtcgggagatccgcatcacctgctttaacaagctgtcgaccgttcagcagcagttcgaacgagttcgggttaaccagaattcgcggactgataccaaattcagcagtggtgaatgtgagtttattcggcagatcgccaacccaaatttcaccagggatacttacctgttcggtgtcacccgtgttatatacgcgcatggtatgcgcttcatacgtcgctcgccatgcggcaataccatccagataggtaacgaattgaagcgtatcaccagcgttacacgggtttttaagacgtatgtttacaccatccagttcgatcagttgtccggcgctcgcaccaggtgaaccgtaatcgctgtttgatgcattaaacccgttcttgtcgtcgatgtacagcaagttaccacgatagtaaacttccagtgcgcggacgttgtaagagttaccagggccaaacacattcaggaagtcagtttgtccctgagtcgcgatataggtttctttcgctacagtagccagatccgaagttgtgattttgtcaacctgtttgttttcaacatattcccaacgaccaggagaacaataaaccagttcgacatccatcaaatctttgtacagttctttgtagttcggtgaacctttgatggtatctccgcttgcagggacgatacggacgttgtttgccgcccacttaccccatacgtcacgtaaacgaataaccttgttataatcgcttacgctgcctttaggaaggtttaccgtaatacggttgttgcttgtgttcagcgcccatgaatcaccaaagataggggatagcgtaggcgcggtatgcgttttccacgcacccgctggatgcgggatactcccatcacccagcttatcatacaattcggtaaagttggcgttagtcttctgaccaccacggcgcagataatcacctgcgccatcgtcaaccacgttaccgataataatttcttgtttcatgctgcgatccctgatttgatggtgtcaaccgctttgatcgagaatttaatacgatcttcggttttcgattgcacgtttgcgtaaacaacatcaccagcgccaacagtaaaattaagcgtatacatttcatcttctgtatttttaagaactgcgtattcggttgaataaacgcccttagccacacgatcgacggcaagcagaatttctgctgttttattgactgtgcctgtcatgttttccgcgtatacgagaagtttagcgccgctaaattcgctatatccaaacataggaatagccgttggtgatgctttcaaaatgagtttggtagtatcaacaggcattgtctttgaaccaaacattgattcaacagaataatcccatgtagaaacagaaccttctttcttcacacaccagattttaatctgagtatatggagaggttatgtaaagctgatcctgaacccctttgataccatcgccaacttgcggacggaatacaacaggacgatcaacagaaatgctaccgttactatttatgaaatagaacccttcaccgggtttacccgatggaagcacgaccgtaatcgggcctgttgaggtatccatatcatgcaatgaacccagttcgatcgggttgcctgaataataggttcgtggtagtttctggaaatatccggtcgcgtggagcagcattgtacccacaccatcattcgcagtcaacaaacgcacatcaccaaacgcgttgtacatgttggtgatgatttcgttaagtttaacaccgccgtcatacagcgggtcaccagttgacgggttgccgatctgccccacgtcaattaattttttaccagtttgatatgccattatggttttccttagaattcgaaaataatactgacttcttcggtctgatcaggagaacgaataatcggttgacggttttccatgtagatcatttgccctgagtcaagttcaagctgttctttcgtgtaatactgccccgttgcttttacttctggatcggtcggttgcgcctttttcagtaacgggtttacaattacactaacctgacggaatccacggttgccaggtaaagatgcttgcgggaagaacagggaatccatgtacgcacggaatcgcattgagtgaaccttcattcggaacaccaaatcatacatatctggataccacttgatcacgttgtcataaccccagcgaaccggatcttcttcgagttcattcgggaacggaacaacgatatgttcgttcgtgcatcggttaataaccacatcaggcgggatcgtgtagagatattcccagatatagccgtcacccatgtcgataccgttcgcttctccgcgtggaggttcgaccgattcgtgggtcggtgtccaaatgccaccaatgcgcacacattcaactttacccgtgatactggagattgagcaagaaccaatatcaggaacgtccacaacgcgatacaccatccatcctttaccgtaatcagtacggttataaggagcggagtttactaccacgatgtcattaatgtaaaagatttttgggttaggatatcgagtatcgccccagtctttacgcggaacgattgcatcaatcatttcgcctggtactttcgtcatcccgatcatatgcgtccacatatcaacgataccatctgtatcatcgttaggataagggggcgcgaattcaggatcggattcgttatccgcccattgttcagtacgcccgatcgacatatagatcgagttatgatcggggtcatccccgatcatttcgcgaaagttcatcatgttttccgtgcggaacttaccagttacaaccgcacggtagatgttttgttgagccattatgctacctttctctgagtcggtggattcggatcgcgaggattacccgcgtcgtctttcaatcgtttttccactaagttacggaactgagagtatttaaccgcagaactatcgaacagaggactttgatcaaatcgacgcgcggaaggtaatacaccattcagcggttgttcttcaacgtcatattctggtggaacatcgaacggttgccccgctttagggtgtggttcgtataatgcttcgcctgttacgaggtcaaatgtctggtttccgttaccgtccagacgggctacacgatcaggccaatacttcggataaccgctatcgaagcgatagtttcgaagaatatcaatgatcgtttcgctatgtgtcatagacaaaccggagttaatgaacaccgttaacatggtgatcccgataaaaccaaagcctaccggatgcacgaatcgtaaaacgtcatccttatatcgtgacgctggcagattcgaacgaattttcatcacatagtatgaacgcccacggttgaaatagtcgatcgagttgttcgccatttgcttaccacgcacaccgcgcagaatagttcccgtgaagttagtcttttcagacttgacaacctgcccttcaaggaagttcccgatcacgttatgcagagtcattgaccagcgtaattgaccgtcatcatactggcgttcgatatacgtcacgtttgctcttgcagttggtgtgtaaatcgtccggcctacgatgtcctgactaatattcgttgactgaaccagaatatcatattccagagtgttcgaactttcgatttctacggttacatcttcgttatacagcaatttgaacaggaatttatagcttgcttcgatgcctttcgttgagtaaaaatcactgcaacgagattcaaagaaacgtaccacttgatcgcgcttcgttttatccaggtagatattacggcggtttacttccgaccacagatattctacgctgttcttctcacgcggatatttgttcctgatcaggttcagcagtttgttatagtaggtgttttcacccagcgaaacgaactgcaaataatattcaccgaacttctcaaaatattgctgatccagatagctttgaggcgcaaagcgcgtaatcatatggcttaaatctgggtcaatcaaaccaggtgacagatccggtgtatacggtttttcgcgttcctgctgaatcagatcggcaatcagcaacgtgttatctggtttccagaaaatagttaagctgtcacgggcgcgataactcaattcaaagaacccaatgatttcgcctgaactcttatacaacaacacaccgttcgtatacttcgtgaatccggtaaacttaatgttgttaatgtaaatcgtaacatgtccgcgatcccatacctctttgttcacacgaagcgatgacgaagggccagcactatcggttacaaggctgtaggtgattttcggatacaccaccagaggacggttatcattagtgatccatgtgcgcacagagtcgcggaagaaccagctatagttcgcctcgttgtagtattcctgcgcaccaaatttccaaacagtcgggtcgtcgatatgagcgcgaatcgtcgcaaagttaatcgcaaggctggcagtatagccaggacgcaaatcatattttacagcaccaaccagtgcagggttctcgatcaataattcaggatcgggaagtgtgcctggatatttgtagttcgctacggaaataaaaatctccgtgccgttcgttgacatattggtgtattcatgctggatataaaaacgttcttcctcggtgttcccatacaggcgcacaaaggttttcgtgttttcttgccattgatacacaccagcagcagcggacggaaccacgttagcgggttttgtaggatcttgcagagcggttttcacttcacccgttacgagtgcatagagaataccatccatcacatccattttcttgacaacgatcttatcatttccagggacaactgtatagctgtcagtatcgaaaatcttttctccgaacgttggagaactcggatcggtgtcgatcggtgtctgtttcagtgcgatacgacgcacaacgtttttagcaaccacatagagccagtcatcggaacatgccattgcttctgcatatttcgatacgttaccaggcagtttagcaaatgtgttgtatgagtccacatcgaaatcaaggccagtctggttccccagtttggcaaacgtaacatcatcagcagagaatcgcacatcgtccgcagaccagcgaatatccgttgaggtgcgcccgtagaagatacgatcgtaacccagtacataggttgtgtttcggctttggtacgcaacagagcgcgatacagggtttcctacgcggtcgttaaacgccttgtagtaatgccatgtttgtcctttgtcgtttgacaccttcgccatgttctgaaaacgttcaaacaggtacaataaaccgtttgacgctaccaggaaagttctgttaatgtcattacaaacgtgttcaatatgatcctggatttcgtgatagttttcttgtgtaagaattttatcgctgatctgggatacgtcagtgtaaagtggagaaaacacaaagtcttctttcatcaacgctgccattaccacatctgtattaaagttaacgtagttctgattattttttgcgaatttctcgtttatgaatgcatcgcttggcgtaaattcacgcatggttgaatatgcgtaagcgttaagggtaaacgtccagagttcatctgtataaacccagtcagacggttcaaagcccttgtgcgtaaccatgacgcggaacttgtaaaaattgttgggctgaacatcggaagaaaaccattcgtttacataagcataacccaactggaaccaggttaaatcttcatctggaatagttacaccacctaccccgcgagtttctgccatttccacgacatagtaaaaatccatgccgacgctatcccacttcaaataaacgaagttagcagccagtttatcaacgcgcaaactggtaattgacggcgctttaatcatatgtttctccaaatttgcgttttacttatatcccatatttagcaaacaaaaaacccctgccaaatgacaggggttgtaaattattgactgattggattcatcgtcaacgttgtatattgaggacgtagatcgttttcaaatacaatcagagaaccatcacgggtgaaaatgttctcttccagaggtgtaccagtcagttcgatgtaagcagcgctgaatcgctcggatggaacgttcaggacaccaagatcgaaactaatgaaatcattaaaatgttccacatagccgacttcgtaatatttatcacgatcggttactccaggatatttatcaaaatcgttttctgtataggctgcgataccgatatcaccgtttttgaatggcccgataaccattttcgcgagtccggtcgtggtgttcatatctgttgacgcatagcgcacatcatacgaatcaccagcagcatttgtgtacttgaacccattcgaaacaacagaacgtgatttcacctggtttaagaagtgaataccagacatcggggcgctgtaatagttatccagttcacgcaatagctgaatagtcgcagaagaaccaatgatcgacacgtccgcgttatcaacataagtcaacatcttggatttactgaaagatttgttgaaaatttcaacgttatctgtgtagtatctgtcaatttcattgattacttgaccacgcaaccattcctcagactcgatcaacttactgatatcatacgttactttaacgctttgtacaatatacaggtagttcgggtcaaggatcgacggcgtaatagtcgccaggttatacttcgccagatagttttgcatgtcctctttttgaacagaggttaagcgcaaccctgatttcggtttaacagcgatgaacgcatagccaggtttttctttatcagtaaagcactgaaccgcctgaataacagaaccgaaacggtgagacaggaacgattcataatccgatgcagtaacacaacggcgctgtgtctcacgcataataggcgcgagttcacgaatacgttcgatatcttccggttcaccaccaccatcagcgcctacatagtccgctgaatcagtcgggttttcaacaatacttgtaatgctgatatttgtcaatgtatccacataaacaaagttttccgcaccattggcttcttcgccattggttgaaatatattcaattacaatagtcgaaccgtttgcaggtttcaagcccccgatgtaatccgcagtcagagcaccacctgcgacctgttggctggtttcaccttcaccaaagtaaacttcggtatgtccatccacagtttcacgcatgtaaaaaattgttgatgcgcctgttgcgtttacgatactttcgtttgtccagtcatcccattgagcaccgttgacagtaacgcgaacctggctacggtcgatgttcggatctcgaaccagaatcgtagaaccatcatagatgacttctgtacggactaaacgcccctgtacgatgttcagcatcgaaacatagttattgtctttgtcacgaacgatcaccacgtcatcagatacgacgaacgggaaactgtttgtttctttcactgtaccgatgaatttcgtgccgcgcggaatacggatcgatgtcgggttcagtgggttcttcgcagtgatcaggatcgcagtatttgcagcggtgcgggagtccggcatatagcccaaatcctgagcctgttggacaacagaactacgcaatgcagcggtacgaataaacgattcgaacagtgcggtgttactcatttgctgaatgtacagtgtacagtatgataacagatccacaagtacgttcatgcgtgagccggagaaatcataatccttgaattcgtcctgaccacggagccagttgattaagtcagatttgatttcgtcaaaagtagccccgacaaagatatcggggatctgattaatttgtttctttgtagtagccattattacccctcgttatcgggtatttagtattgaaccatagggacgcaaacactaattgaaccgaatgtgatcgcgagtccgattaatgacaataatttgtttacgtattgagttaccttacttagagcaagcgtacaaatctggttataaatcaccttgcatgtgtccttaaacgagcgggaactgtcaacaaagtttttatatagcgattgtgcgcccgtcagcgcgttctcatacgtttttaacaggtcatcgaatgcaaccccacagtaacctaagaactggttaatctgagccattacaggcagtttcttgagttcagccattgccatgctgtaggtgtctttcatcccattttgcagattagcaatctgtgctttgattccctcatatgcggccttagtcgcattcacagcagcgttagcggcatcaagtgcagcctgataagcagcagtcgttgcttcctttacaggttcccacatccagtttaggtactgatcgaacttacgtttaatcgaatccctttcctgtgtctgtgctttcagggttttgaataattcttgtccctgatcatacagtgcggagatctgcgcataggatgcatcaatgaacgctttcactttcgcttgtgcttgctgatacagatccattgctgtaaaccctgggaagttaccgcccagaatcacatcaagaggtttaatctgtttcatgatgttacggatagccagcaccgcagaccaaagcgggtttggtgtttctggaggcattgaccagatctgcatcatgcgcccgtacaaatctaccaaagcaacgcaaccgttttggaacatagtcaaacaccagtcaaataacgcgctacaagcgtctacaaggtcgcgagcgccagccttgacatattcaacggcgtagttgtaagaactgcctatagccccgtatattgcgtttatgacgctttcatacgtctgtgcgccggaatcaatcagagcctggaaagaatctttcagggattgaaccgaactatcaccaaacaccagatcgtaaatgttgatcgcaacacccatgatcgcaacagtcgggaggaaattcttgatcaaatcccacgccccgcccacgatgttaaacgcagagctaatgatctgtcggaataccttcattgcggtttgccatgcttgctgtgacaatgccagagcacccgctgtgatttcttccatcccgatcgaaagcccgtcaaacatcgtcgcaatgcccttaccgttcttaatcgtacccgtcagcatatcaaaagccagcttgaacgttttacgagtctcgttccacgcagacagcatagcatcactgatattcgtatacgggaaccctacggtcgccggaatacagcccaatccagagcgagcagaaaacaatctggcttcactcggtagcgccccatacgttgacgggagagcaggaggaaccggaggaatgctggtatctgcgttcgtgtttactgacatccctgtatatttgcactggtgcgcgggggattcgtcgtgtttcatgtacgcaatacgattaccattccagtaataatcaatgctggtaaacgcgcctgtagtctgattgtatacctgtcggattcgctgatcgcaacggggaccagaagtcagcaagtaaccaccggagttttccaccttgtacatcgcgagttcgccagggttcttgaacaagtttgcttttgacagatcagccccgtaccagtcattacccgcgagcttagtagccccgatagatgcgatataggcatcaatatccgcttgactggcgaaatagtaaccaatcttcgtaaccagaatgtcagtagaaacccctggggttccgtctggattcgttggtacgtttggagagttcaccaccggaagcggatcgcttttctgcccgaaaggggaactcgtatacaggtgagttccgatcgggatgatttcggtcgcccattctaccccaacagcagggtaattttctgtgtgtccctgccagataacgcgtctgtaatatccagcggggatctcagcatcgcaaggatgctgaaagttttgcataatcccatcaatgatggtttcataatccatgatcatgtttagcctacctgtacagtaccgccagtgatcttagtcagtgcgccggaatcaatgaaagtattattcgatgctcgcatgttgatattacgtgcgccaatatccaaatcttgctcaatatcaatcagagcattttttgcggtaattgttgcatcttctgttacggcaacggttgcattctgtttaacgttagccattaaattctgattcacgtttacggttacatctttttcaacggttaattctgcgttgcctttaatcagccccaaatattcaccttcaacggtttgattcacgttaccgcgcacgaactcggtcacgttaccatcaacggtctgttgaacgttacccatattgtaaatgaacgcatcaccttcgataacaacctgcaaattacccttgacgtttaatttacggccttgcatgacgatttgataatcatcaccaacgattttaacgacacgggttccatcaggacgaatttcttcgtatgatcctgctgggtgaacacggttgtaacgttcaaagcctggggtgtcgtcgaattcctgaatgtgtccagaacgggattcgaataccatgttgtatggatattcagcgttgtatgccgatttaggttcttcaaacattacgcgggtatcaccaggaacaaaaggatcttctggatttgatgcagccaacacaacagcattgtatgcagcactcaatgaacgcccttctggatctggaacctgaacaccgtatgattcgaggttgcccgtcagcacgattttagatacgcgtgaagaacgtcctggtgtctggttagcccatgttgagtttcgcagttcgttgtaagcggtttgccagtcctgacgcttcatagcagccagagcattagtaaatttggcaacaccaccaacacccatctggaagcacatgttttctattgccatttgacgaggacggtttaacgtcacgtatacttctcgaacgtttgaagtgttgctgatcccctgccggacttttgccaaatcctgagcaaacagcgttgaaacttcttctgctgtgatcgttccattggttacttctcgaccaactgctttactgatcgcggcattgatcttcgcagtatcacgggttttctccatgataagcaaatgcccgatcccgatagtcggataaccttcactatcaatataccattttgtgcggataccttcatcctgtttaagcatggtttcgatagtgaacccgccagtatcaggacggttatcttctgggatctcgtcaagtgggcgatcatctggattgacagctaacgaactgttagcatcacgaataatcacgctcgaagaaccgcgcccctctgcgccaccacgagccagtacgttgacatcgttacctacataacgaggatactcaccaaacgggtcacagaagcctttctgggtgtccggtttctctcggtactcacccgcaaaggttcccagtataacgccgtcctggtgccatttatcgcgccagtaaccgataacaaaactaccgcgcgtgataccagtcggggaaaaaccaacaccagaaatagcggcgctgcgaatatcctgaataggcatcatccacggcaattcctcaaccggaataccgatagtttcagatttttgtttctgtgccggatgctcaccgaatacacgcacctgaacacgccccaatagacgaggatcatcgacttcttcgaccaccccctcaaagaaaggggagtatttatttccaccgtatttcataggtttgccttttccatttccttgatataatcacttacaaacgattgaatatcagaggggttaataatcttgatggttcgttttgcttcattttgaagcaccgcatcttcataaatatctacagggactaatgttccctggtactgcaaataacgcatgttcttatcgcctttgtcataccaatgaccggaattcgtagggtcttcaaccaaattgtaataacggttgcccttaccatccatatgataaagaacctgttcaccacctgcttttgaataacgctggatagcgcattgataagccgtttcctgatcggtaatccatccgtaaaacggatcgtaattatcgttaagcatcaggataacccagtagtattgctggtttccgtatagcgtttccgctaattgttcgggtcttaatgaacctgtcagttgatatgtacgcggcttataattcctgatcacgcggttaaagtaaaaacgataatcgcggtagatatcagtagttggtgtgcctttgtaatcaactggtggaaagaatgagaacaacattgtaatttcccctatctaatgtttactatatttaggatctaaaatggctggaagacagacatacaaggggtcttttatgccccagaacatacagaaatataagggagatccgcgaaagataacgtatcgttcaagctgggaaaaatatattatgaactggcttgatagaaacccgcatgtgaaacgctggaacagtgaagaggttgtgatcccttatttcagcaacgcagacggaaagcgacggcgctacttcatggatttctatgttgaaatggataacggtgtgacctacctttgggaagtcaaaccgatgaaagaaacgttgcccccacctaagccagcgaacaacaacgttcacaacaaaaagaaatttgttgatgcgttgtatacttatgctgtaaacattgacaaatggaaagccgcgaatgcagcagcaaaacaaaagggctgggagttcaagatcatcacagaggacacgttgaaacgtgtgttcggatggaaagggcaataaataccctaaacggagggaattatgagctttatttttgagttcgagatcatcgcagaagaagacaagccaaaaccgccaccgaagcgaaagctgggtgaatgggttgaacttggtatcaaattccgacgcgcaaaattaaaaggcatgacagccaaaaagttcgcggacgaaaacgggattgcatacgcaacgttcacaaagtctatgcaccgctacaagcagcagattgatgatgaaatcgaacgccgtacagcagaaaccgaagcccgacgcaaacgtaacgactatcgcaaaaaacacgcggttgatatcgtaaacgatttccgaaacagtttgaagaaaatgactgttggtgtaaccgctgcgaaacgtcagaaggattcgaccgattggtttggtgatttcatcaaaaccagcattaagacgcacagggttgcgaaaccagcaacgggtcgcttgtatacgttcatctacgatgcgaaatacaaagacaccctgccatactgggatcggttcccgctgatcattttcctgggttcaggacgttcgaaagcgggtaacttggttctttacgggctgaacttgcactatgcgccaccgcgagcacgtcaagagtttttagaagaactcctgaaacgtggctacggatcaacagatcgactttctaacaaaaccagactgaaaatcaactggaacaacgtgaagggaatgcgcggggctgatcaaatgatcaaagcctatctgccagcccatctacgttcaccacttgcagagatcgccccaaaagattgggcgaaagcagtttggttgcctacacaggctttccagtccaaaggaaaaccatacagcgcgaagaaagtttggaacagatattaacaaaaaagccccaaccgaaaggaaggggctttatttttacaggatactcacgatttccgcgagtttgccaggggttgcgccaggtcgaaccttcatcgcatctttcaggtttttatcaaccatcttttctgcgtctttttcgttaaacccacgtttcaccaacaccgcaataactttttcgcgaatacctttagcggcttcgttcaaatcttctgattcagctagaaccagtttagacagaacatcacctttgtattcctgggtaaagcgtttacccgataccagacgaggcttaccagaggcatctacaaccgtaaacacggcgtattcgcctgtagctttggttttggtacgtccggtatacaacaaacacatatcgttgcatgggagcttgtacacctttcctttcaccagtgcttcatccagaggcagatcaatttcgaaatcttccgccaactgattatacagatccagattttcttcggcttctttgtacagggaagcgcctttgaatttcagcggcttgtcaaatttcaggtcatcagcaggatcaccgctgtagaatgaaacagtgcctttcgcccagtcaatatacgctgcctgggtttttccagtggttttacctttcaggcggacaacacctttaccgaagtaagcgagatcgtgggaatccggcgcataaacatcgtaatcagcaccgtgtgcgaaatgcaggaaaccgatctgaccttttgatggagcaacaccgttgcgatcaacaagttcaacggttttagcaaattttttgttctgaacagattcagaaagtagttctttgaatgatttcatgttttcaatctcttttgaaagtataggtatgatatacctatttattgaatagatcaactaaaaaaattagatcgcgagcgaagcgagttccgtcaagcgaagcgaagacggatagttaacgattgtataaaaagtatacggaaatgtactgttttctctatatataaaatataaatattataaacagtacatcgtacataacactcacttcgttcgtgtgttcgcttcgctcacggtctaacctaaatatctataaaatggagatcatcatgaatacaactgctatgatcctgaaccagatttcacctactaacttcatgttagatattcctgacaatgattatgtaaaagggttgaaactacaagttcagggtgttacactaccttctatcaacattccaattacggatgtcccactgaacccaatgattcgagggaagatccctggatctgcaatggagttcgatccactgactattcgttttgctgttgatgaagaactgcgatcgtatcttggggtttacctttggatgctcggtactgtagatttcaataccttcgagtctgttcgctggagtgaaccacaacaggcaatggccttgcatatcctggataactcgcagtcaaaaactgtagcgacatttcgcttctatggcgcttggccctccaacctcggagagcttgagcttatgtatactaatgattcggatgaagccgtatcctgtatgacgatgttcaactttgcacacatggaaattgaaatcgacggaaaggtgatcgtgccgactccacggaaaacgcaaaaatgatttatggtatttgtggtaaaaagcgaacgggtaaagataccgttgctcaaatggttgtgcataacttccgcaatgttgaagttatcgcgttagccgacgaaatcaaagctatcctgaaacgttctatggaacatcatgataatacgcaattgcgagcgctggcagcgaagaacccattctatgagggtgatcgtgaagccccgctggtgatgtccaataacgatgcatacgcgctgttttctagcggtatcaaaaaattaagttctcgcgggttcttcatgagtaacgcagatgttatcgctcataaaatttgcgaagaaaacagccagccctggacgattcgtcgtttgatgcaggtgttcgggactgatattgtttgtaaaatagatccgtctatctggacttcgattgctattcaaaaaatgttgaaatcctatgcggatcactttatcattaccgatgtgcgtcaaccgcacgaatataaatacctgagcaagttcgggactcgctttgtgttccttgaacgtgaaactggtattgaagataatcattcaacggagcaaggtttgacacctggcttgagtgattatacaatcctaaataatggtacgttagacgatttgaaacgtaacgtgcttaatgtattcaatcttttaagagtgtaaacaatgactgaacaaaaccaaacccaacagcttcaaaacgatgtcctgatcctgaaagcccgtgtattcgacctgaacgaaatcattcagggtaaagaacaagaactggcaaatcaccgtcaactcgtaggccaaatttgcagtcttctggaaatcgacggttcgcagggtgtatcccctgatgccctggtcggcgcgatcaaagcacttctgccagcaacagcagaaaccgctggcgacgatgaagcgattgatgcatcaaaagcataattaacgcttaggcgtttaaccactggggggcgaaagcccccttttcatttggagtacacatgaaaagttttattgaagtagcgaaacccgtagttgatccggggatctatatgtgtgcgaagttcgatcaggcttcctgtgaagcgctcgcgaaggtgcaaaaacttctgggtgtagagaatcctgtttccgctgcaaagctgcatacaacgattgtgtatagccgtaagacggttgatctgttccctgcatccggtatctctgaacctgcccgactggttgacgtggagaagtgggaaacgaaatacggtaatacgatcgtgggtgttctggagtctgattatctccatagccgcttcaaagatgcaatggatgctggagcaacatacgattatgacgattacaaaccacatgtaaccctcgcgtatgattcccgcatcgaagatatcagcggagttaaaagactgttgacattgcccgtagatttgactatcatccaggaagatgctgaacctctggatctggataagaaagtcgaagacatcacggagcacatcgaacatcgcggcgataagtgggttatactgaaccatgatcgcacgaaagaacttggtgaatatgattcgaaagaggcagcggaaaaacgtctgcgtcaaatcgaatactttaaacataatgggtgatttatgaacagagcacgattgatgtatgttatcaataacttacgcagagaagttaaccaaaatttcagtaaagcgttaagtgattggtatgtgacaaaggtttcaatgactacagatcacatcgcagaccgattcctggatcgttccgcgtcagtcaaaaaagactttgcggtctacagtgaaattcttaatagtctcgctaaacattattcgtgtaacgttctgcattacgcggtgaaagcgaaaaacgaaggtatgcaggaagttattgcgtatcgccggattaatggcaaagtgtttgcctgtgcgttcaccgtccagatgttcgaaaacatggatgattctgttgctcacgaaaagccagtgattgctgtacgattccgaaccgttatccctgagtacacgttgagcctgaacacgcgaaacgcgatccatgtaaactacatcgcacccaaaatcaagttcgagtatgacggctacagacgcgttatgtcacgcctggatcgcctgattgcttcaaaagattgtccacctcaactgtatatgttgaaaaatatttgaaaaaagcccttgcattcgtgcaggggcttttgttatattaggggtgtcgaaacaaaggaggcaatcatgaaactttactggctggtgttctcaaacgggtttgtaatgaaaggcactgttcactgtgcgaaaacttattgcaaatggaatgaatgctctttccgtatcctgagcgttgcatcttctcaacctgtaggggattactaatgactggtgataagtgggttgataaaactttgttgttgacagtaatctactttctggtaaaatacctggtgtagacaaaggagggagttatgagaaacttactgaatatcgcggaaatcttttgctatggtgtcgctgtgtatgtcctgtttaacggtgacggcgcgggatactggatcatgttcggtggtggcttgttcctctctttcatcaaaaaattttttaagtgagaaatatactatgcgctcaaatgtaccgaaaaacctgtataccgttattgatgctggttcgattcgtattgctgatgtaatggcactagtcgaacgcttcgatcgttcaacgacgctggggcaactgctgagtatggttaaatcccagtacccgcacaaatgcccgaaatgcgagggtaaagggttcgaagttgtgcgtgtcaacacgtatccttctggcttgccggattctggctgggttgatcagatggaagatttcaacgttacctgtgatatctgtaacgggcaaggcttcaccaaagaacgccttatcgcaaaacctgtcaaagtggaatatgtaagagcatgaaaattaccgatctcgtaaaagcggctaatgcgcttgtaacaagcgatcattacgtcgattactgcgagcaataccctgttcccctggaacgcgcaattgctcaatccggttatgatggtgtcagtaccgtaaccgttgaaaacctgaaaacgttcatcgtgtttgctaacacgttctggatgtacttacctgataatatcgggattcgccagcctactttcttcacgctgtgcatgttctgcgaaacttatctccctgaatgcgatgactacgaagaacattatggaaaaagtgaataaagtatccctgatgcagtttgataaaaagctggggtttgcattctctcacggattcgccccagacgcggaaaccatgtttaaaatggcttttggcatcgatccggctaccctcgatcaagaggtgttgtcagacatcaacaaaactggtacgctgtattatgcccgtctgccaaatccagaaaacggcattcagtaccaatcgactctcgaaaaactcaaaactgaactgaaagaaataggtgaattatgacttctacagctattcaacaacaaaccattgatcatgatgctgaattcgcacaactgatcaaagagcataacgcttttgcggcttctcgtgtcaacgaagaaagcgaacatacccgccgatctctctgggttagcatttaccgcgaagtgtttagcgagaaatccgctaacaaacacacacaggctgttgatgcagcagataaagcgctggcagcatacgatcgtaagttcagggtgcagtaatggaacggtctgctggtattctcttcctgaataacggcagcgttttaatgggccacgcaaccgaaacgcctcattgggacatcccaaaggggcatatcgaaaaaggcgaagaacctattcacgctgcgatccgtgagtgcttcgaagaaaccggagttcttgttgaaccgcacgaactggaaagcctcggaagactggattataccagtaaaaaagagctttacttattcgtgtataaaggcaataattaccccgaagccgataaatgcttctgtgcgtcaacgttcgtgaagaacgggcgaaccatcacagaaatggacggtttcaaatatgttccgtatagccagatccgcgatcatgcgcgtaagactatgggacaccttctatctaaacttgtgggatatacatcatgaaagcaacaacttttcaaatctgtcaaatgatccttctggctaccgcaacccgcgccgctgaacctatcgcgtatcagtcatggggtgattcattcaccgtgaaaaatattcgcgatctgcctggacgcctttacgcttcccctgatttcgaacccgtcgatccgaatgatttgacgctggaagaaatgaaaaatctgggcttccgtaagtggagcgacgattcaaacatgatgctgatccctctgtatctgttgccatacctgaaagacggtttccgcgctatcagtatcagcggtgaagaatttgaattcagcactggtgaatcagataacgatcatcgtatggggctgctgtctttcggggcattgcctaaatgagtcacgttgatttcaacaccttatctcaattggggctgatttggaaaatcaataaagatatcctgcatcccctggggctggcgttgacgcgtgatcctgaaactggcgtatcaatcggtgcgctggtttccgatgatggggtctggtcgttcagcgaaaaatcagactttgaaaatatcgcaaagctgaataaactttatgctttacaggccgaaggaaagctgttagagttcctacaacaaaacgtgaaagagtgatatattatgacttacaaagctggcgatcgtgtagtaaccgttaaggatggtaagtttgccaaagccggaacgcacggaattgtcaataccgaccgtgatggtattctgggtgtggttgtgccggatcatggaaaatcaacattattcgaaacagacaaagtgcgtatcgcaaccgctgctgatcctggttactatggaacccgcgacgagttcgaaagtgaaaaggatcaggagatcgcagaactgaaaaccaaagttcataacgcgcgggtgttggcggtgatttgccttaccgttgcggctatcaatactggtttgttgggttgggtggtgaatcatgtctaaagatgatattccggttcataaccgtatccgcgatcagttaacttttcgcagtcgcgatcacgcgattatggttgggagttatctgcattggtggaagaataaagatctggatctgaatccatcttatcagcgcccctatgtgtggacgcagaaagagcaagatgcgtttctgactaccctgatcagtggtttcccttgcggtatcatcgcgatcgcggttgatagccagttcaacgaaactcactgggtagaagtgatcgacggcaaacaacgcctgacgacgattatcaaagtctacgaaggtgaaattgggattcctatgccggacggttcccgtttgttctgggacgaaatgccacgacacgaacagcgagcctttgaaaacatttcattacctgccctggggctggatgaatgcaccaaaaaggatcgtctggaattcttcatcaaactgaacttcgcgggtgtgcctcaatcacaagagcatatgaaccgcgtccttgaaatgtataaggctgcaaaatgaacaaagacgaagaactgaatgttgattcagtagaaccaaaccagtttatcatcggtaaagaagatcatgaactgttacaagcggttaaaaacttgctgacctatgctcatatccgcgtaccgaatggcgataacgcaaaactggaaatcgcatgtgctggttacggttacaccgctaccgctgataaaatcattagctattcagcatccagaacccgtgaactggttcattaccgcgataaattgagtgaagaaatccatcaaactcaggtaattgtagatcaattgccagaaaaattcgattaaagtgaaaaaagcccttgcagcaatgcaggggctttgttatattacacacatcgaaacgaaacagagaaaggaaaacatcatgaacatgaacaaaaacattgccgctgtagttggttgtgaagtttctaacgcagaacgttatgacaacggtttctctttctgtgttccgactgaactcgatgcgtacaaagccgcttacaaataccgcactatgccgatggtaaacgttacttacgcgccgaacatcgaaatgtggctggttcaggtttacaacaaagtatgaacttccacgaacgcaaggccgcacgaaccgattattacatgcggttcgtgtatggctggaaattacggaaatgtgttgcatgtaacgggtcggggcgatatgatagcgaccgatctccgaaatgcagttcatgtaatggaaccggaaaagaacgctttaaacctgtgaggaatatattatgcaacatgtgaatctcaacccaaaaatggaaaagtatctgaatcgccgtcatgacaaccaggcgcaaagggatcaggaacgcgcaatcaacattgaaacggctaaactccttacccagatgttccgtaagtttcctagcaaattcccatgcaattctatgcattcaagtaactgtatcagcgtagaactggctgataagcgttgtatcagggttaacctggcttacgggttatccgaagacggatataacctggtgatgggctggacatcaatgatcggtaacttcgttgaacagaacaatattgagttcaatatgatgcgctctgatttgttccagtgtccggtcgattcaatcaatatcggtagcctttacgctatccttcgcgcacaatatgatttgtggagtacaaaatgaaagtaacaagtgaaaaacttgaagaaattgaaaaatcagcccgttcgatttcttctatgatgggtagtaagtggactctcgttgaaaatatgagcatccagggaaatcaggaatatggtttcaggggcaaagagtataaacgcgcgttctcatatggtgttccatatggcgacagccctacacagattaaaagctgggaagagggtctcggaaaatatctggaaaccgtagatccgcaaacggttctggatctggttagcgatctgtcactcgcgcttcgagacaagcaaaaagcagaatcagaagccgcgcactggaaagcaaatcacgaatgcgaagtatcccgcgcccgtgtcctcaaagagcgccctgatatgccgctggagcgcgtcaacgcatacaaccgtatggttgagttggagaaagagaacgaagccttaaaacagcgtatagcgagcctggaggatgtcaatcaaacccgcatgatgttgcagatgattcagagtatggtgattgatacccaaaacatgaaccgcgaacaactgcgctactggcaaacccatttccgcaatcctaacgggtggtgatatgttcggacgaaaacgtaaatgcaagcatgttgctaccggatggatgcggggaactccttacgcttggatgcatcattctgtaaccgatgggatcgggcgtatacatggcgatatgtatgcaacatgcgacaagtgcggggagaagtttttgatgtgtaagatacacgttgatcacgcgatccgtgagctggcaaaacatccaatcacccgcgccgaaatccttcgaatcctcgaagaaacaaaatagcactttttgtttaaaaagccccttgcaaccgccaggggcttttgttatattacacacatcgaaacgaaacagacaaaaaggaaatcatcatgaaacttgttcgcgaagcaatcaaactgggtaacgaatacaacggcaaatggtacttcatcatttatgacgacaacgcagaaaaactggaaaaagttgaagatgcgttacgtgcgatggaaactggtgcttctgttggtggtaaagtgatgacctgggaaaactactgcgacggttgcccttgctacaacgatggtttcggttctggtttctgggttgatgttgaagatgttccagcgttcaaagccgcatggaaaatcgctaagaaaatggcataattagcacgaattgctaaaactcgataaccctgaactgttattgtacacacatcgaaacgaaggaggaaatcatggaaatcatctacaaaagcaagaactacaaaaaagaagatgttgctgcggtttacatcaagtaccgtaacgtgaaatgtgagtacagcgggatctggggttacgaaatcgttgttgaagaagtcaacgccgacaacaaaaccatttgtagtttcaccactaataccgatagccctctgttcactactgaacagcttgaacaggcttatgaactgcgcaaccaggcttttaacgcggtacgtatcaaatgagattccgtccttatattgaattccttcgcggtatcagtgagatcctgaaccgcgaaatcaaacccagtccgttagccgttgagctttaccgactggatgcaacccccgaagatgcagcgaaagattacggagaccagttataatgttaacttttgaagagtacaaagcacagcgtgatcagttaagcaactggcacagagagatcggcagggagttgagcgcgtaccctaaaaacgaaatgggtatgacgatcgaatcaatccgtaatacgccggaatacaaagcgaaacgtgctttgtgtaataaagttttccaacagcttcgcatccttaacgggaagtacatcaaaacgtacaaaaaagaactggctgacgaacgtaaactgaaacggagtgtaaaatgatgcaacacgaaatcaaaacagagattgacaaacgcaccttcctggaaaagaataaaacggtaacgctgatgcattactccaccaaaaacggttcgagtgagttctggcgcgttaacattgacagcaaaggccagggaacatcaatcccgttcgatagcgaaaaactagctcgcgctgtcttccaatcccatgttaaattttgagaattatattatgaaaactgtcgatatcgttaccagcatcaaagcgccgtccctgttcatctatcaacacggcaatatgcgcttcgctcgctcgaagttctacaactataatttcaacgttgatactggtgaattcgctcgctggggtgcaacatattcccacgatccagaatacgcaccattccccgaaattctcgatatcgagatcactaccaaatgcaacgggccagcgggtaaactctgcgggttctgctacaagtccaataacccgaacgggttcaacatggatcttgccaacttcaaaaaaatcatcgacaaaatgccctggcttactcaatgcgcactcggtgctgatgcacaggggcaaacaaaccccgatatgttcgatatgatggcgtatgcgcgttctaaaggcattgtgccgaaccttaccattgctgacgtatcaaaagacgttgcagcgcgtttagcggcggttgctggggctgttgcggtatcggtttataaacacgctggctttgatgtcgctttcgactcagtagcgaacctgacagaagccggacaacagcaaatcaaccttcacttcatggttagctcgaaaacctatgatgatgcgtttaacgtggttgatgccgtgaagaatgatccgcgcctgaaacaagtcaacgcgatcgtgttcctgggactgaaacaaaagggacgcggtaagaactgggacaccgttacccgcgaacaatataaaaaacttgttgaatattgcctcgattctggtgtaggatttggattcgatagctgttcagcccccgctttcgttgaagcgatggagggacacccgaacttcgaacagtacaagcaatacgccgaagactgtgaagcgacgatgtttagctcttacatcaatgaacgtggtcagttcttcccttgctcgtttaccgaacgctgggttgaaggtggctgggaagaaggtctggatgttctggaagccgaagattttgtgaaggatatctgggaacacccgaaaacaaaacagttccgtaaagaactgacgggcaacaaggatcataacggttgccgtaactgtccggcttatgcggtatgtggtaaagatatgcgcgtacacaaagcccctgaaaccgatgtatatgcagtggagttgaaataatgttaatcgtatctcgtattaaatcatacgttcgtgatcgtgatattctggacgtgtcgcctttggttggtgaaactgttaccgtaagaaactatccggtgaatctggatcacgtaacctggatcgaagatgatgcaacaatcgttgttgaagggaagagacacccagcaatcacttttcacctgatctgttcaaccccgattacctgggctggatatgaaaacaaagaacagcgtgataacgctatccatgcgattgagcgtagaatgcagtttgcggagatcacattctgatgatttatcaatcccataatgattcaacgatgcgaatggttccggtaacggttgacattccagtaaaaccgcgtacactggaatcgttgattgaaaaatactctggaatggttatttgtccttctactgcacaattagcaatggcagaacgcgatgaaattgtatttgaatgtgatatgaaaggatatcataccgttgaagatatgcagatgattggatatctctgggaaatccgaaacgctgtagtacatcacatactgaccgctgaaaagaaagccgaagccgtgagagaagttgaacagcgcgaagagatccgctataatcggatgtctgcacaggaaaaggatgaagcatatgaagtgtaccgccgtagtcgatgaattaatgagcgcgtttaaaacgcgtcatacagatgggcgtattaaagatccgaagtcaatcgcgattatcgaacggtacgcgatgaagttaagcgaacaggaattcacgccaaaggcgctcaatagcctgatggttctgaaactgctgatcgcttcgggtgacgatatgccgcacgatgaaaacagtgctgaatcattccaaaaggcttatcgttcatggggagtgatttactcccgctcgctgggttcgtatgactccgttatgtggaatctgatgcacctggatcgcctgatctgggaagtgctcgaagaagagggtattgtatgattttcacacatacaggaatggttgattctaataaaacagggcgtagacgaattcctttgatgaagtccggcaaatactggaagagtgaagaacataagttcgaccataacggcaacgctttcgggccttacgatgctcggttaaaacttgattctattaaagagattaaatcatgaaactcgatcgtgaattaagcggagcaatccgcaccattgaacaggtgcttgatgatttgagcgctggtaaagaaatcaatgttagcgacattgaagcaaagctgtatgaatggcgaagtgctttgtataaagcaacgaagggtaacgatccgcttttcgatgaatacgatgtgtacaacgtcaaggtctggaacactgaataccgtttcaaatggcctggtgatgcttacgggcatattcaaaccatttacgtaactggtggtatggtgtttgcgaccagtgttggggctagtgaacttccgatcaatcccaatagtaaaatcacaacaccgaacccattcggacatactaccgtttgtttgggtatggcggaggacttctccccgaactattcaggctggattgaagcctgcaaaactaaccttaaacgagtataaattatgtggaaaattgttgcgtgtattttgatggttgtcgtcgttgtgttcttgcagtcaaactgtactgacgagaaagaggcacagcgtatcctggaagcacagggttatacgaacatccagttcacgggttataagtggtttgcatgttctgaaaaagacacctactcaaccggattcgaagcaactggtgtgaacggcaagcagatcaaaggatctgtgtgttctggaatgtttttcaaaaatagcacaattcgtttcgaataactgttgacactaatccccgttgtgataatatctctctcgtagacaacgaaacagataaacaaggggattaaaatgaacttactgaacgaaatgctggaaatggttgaagcgaacaaagaagcaatgaaagcgaaagaaggttgggtagttgttactgactgcttcaaaccgcaaagctggcttcctgtgttcctcaataaagatggtaacgaagaacacggcttctatgatgctgcaatcttcgaaaccgctgaacaggcttgcgatttctggtcttacctgagcggtgacaagcctttcaccaaatacggtgtttgccagtgcaaagacatttaatcccagccccgaaaggggcttttttgtaggtgaaatatgaccaaagcagaaagaattatcaatcatcttcaaaccggattcccgtaccagggagatttacagcgcgatatcatcgaactgttatcccagcatgacgggatggaagcggagataaaggaattgactcaccctgacgtgaacgtattcgcttcactgatggatgatgtgatcgctatcgactcggacgaactgatctgcatcgagacaacgaaccctgaagataagacgatcctgaaacaagcgtatgaacggatcgaagcattacacgatcgccttttcacgttaactttcccaaataaaaacgatagaccttgttgacatcaaaacagattgtggtaatctgtatatgaaaactaattgtgaggaatacattatgaacgcttttgaaaaacgtgctgtcctgaaagatatcaaacctggcgcaatcctgtacgaagtaatcagtatcactggtgaaaaggcacagatgggtcgaaaacatatcatcactggcttcccgcgtgaacatcgtgggctggggctgtttgttaacggaatcactgtgtatgatgattgggaaaataaaggtaaattctctctggatgatcgtaacttaactgggcgcaaccattataatttccatgcgttgttccgtagcgaagcagatgcgcaagcatatattgaacaaatcaataatgataaacttcctcctgatgacaaacaggaaagtgttgaaatgacgattcgctggaaacgcgatcgcgcggaagatgcaatttggggttacatgtaaaacgttgcgcctcttaaaccataaataccatgtgtagcccatagggtattttcataatagaggtatgtatgtttaaatttagtcagaaaagcctgaacaacctgcaaggcgtgaagccggaactggttaaggtggtaaaacgtgctctggaactctcgcctgttgatttcggtgtccgcgaaggtctgcgcaccgtagagcaacagcgcgaaaacgtccgcaagggtgtttcccagaccatgaactcaaaacacatcactggtgatgctgtggatctgtatcctagcgttctccctgctggctggcagactaacccgaaagtgtggttgcctgtcctgaatgcagtgaaacaagccgctggtgaacagggtgtaaaactgcgttacggtatcaactggaagaacgatccaaatcttcctattgaaacgaaatttatcgacgcaccacacgttgaacttgcataaggcgacaacatgatttcacaattctatgttgacgctgtaaagcagtcacgtaacctgcacctggcgcgaatcattgatgggcgttgggggcaagaatgcggcggggtgtctatcttcgaaactgcgctggatatgggccggatgtcgggtaaaaccaaagcggctttcgatatcatcaagcagtcgaaagggacactgaatatctacgttgcgccgacaaagcaaatgggtatttgtgctgcggcagaacatggaatggataagggcgctgattcgtctttcattctgtcgaaacgtcaagatctgaataccattttccgtggacaaacgatcaagtatcaggcaatcaacctgattttcgatgaatgcgacatgacgatcgacgaacggtttgaactggcaaaaacactgaccttgtgtatgcgttcaagtcatcttcacccgttcccatatatccatattatccgtttgggtatgtaatgaaaagtcatggttattcatcaagaaccatacaggaagagattcaagggattgagtctcttctgagttatgtagatgttgatacatctacgggaaaagtgtattggaaaattcagcgcggccctatgtctcctggaagtgaagccggaagcaagaacgagtattcccaaattcattttaaaggttctatgtatttgcgacaccgaatagtgttttacgttgagaatggttatcttcctcctatcgtagatcatgtgtatggtgttgaaaatggagatacagcaagaaatctacagaaagcgacgaaccaacaaaacgcgatgaaaaagaaatgtaattcaaacagcagtacggggttgaaaggtgtttcttatcacaaagcaaatgggaagtataaagcgcagataaacatagatggaaaaagaaaatttttggggtattataccactccagaagaagcaaaagccgtttatgaccggaaagcgaaagaggttttcggcacattttttaacgaaaccacataaggttaatgtatgtcaaaatacgtattagacaccaatgttttgattagtaacccatattcaatctattcttacatcgaacctgacagcgaaatcattatcaccgctgcaacgatggaagaactggatcacctgaaaagcaaagagcgaaccgctcatgaagcacgactggcgatccggcttttgtccaaagcaatcctgggacaaaattatgaagcaattacccaaacaggggtttcgttaaacttaacaaacccagcagtaccagaaaatgtaacactaaaaatcgtcgattatgtcggccccgaagagttccctctcgataaacaggatgcgcggatcattgcaacctgtattcaacagggcgcaacgctggtgactcgcgatattaacatgctgttgattgcgatgtctaaaggttgtccggttcttcaatacactggcgatgactcgctgaaagatagtgatgtgttgtattcaggttatatcgacctgccgctgttctgggaaactgtcgaagtcctggagtatgtcgggactgttgccgttataacgtattcatcgcttcctgacgcagatttctaccctaaccaatacattctatcggatggtgagattgtggggcgtgtggttgctgctggagagtttcagcttgaagtattgcctattaagcacgaacaagcgttaaagcgtaagctgatgaaaacaattcagccccgcgatgctctgcaagcgtcattcgttgatgcgatcctggacaagaacaatgacgttgtgaccatcatgggtgcggctggttccggtaaaacaatgctggcggttgctggtgcgatgcacatggtaaacgcgggacacttcgcaaatctgatgtatgtcaaggctgatagtccgctgtctggtgaaatcggtttcttgcctggcactctgggcgaaaaactccgaccgtctgttgagccttgtatcacgagcctgaacattctgtttaaggatcaaccggaagttgacaagtacgttgaaggacttctggaaaaaggtgtggtgcagttccctagcctgtattacttccgtgggcgttcaatcgggcatcctgatccgggtaaaggttcggttctgattgttgatgaatgtcaaaacttgagcaatcacgaaatcaaatccattatttcccgttgcggtgagaacacccttctgatactatgcgggaacattaaacagattgacaacccgcgcaacactgctgttaacaacggctttgtgtatgcggttgaaaaacttaaagagtacggtcattcaagtcatgtgatcctggataccgtatatcgtgggcgacttgcagcttttgttgaagacaatttttgatcaagggggcttcggcccctttttcgtgaggtatacatgatcaacgttattatcagtccaaagctaattaccgtttgcgctaattgcaaaagtgggttagagtatgaactgtctgatgtacagaagaaaaacgaagtgttctacaacggtttcttccgtgctgctgattacatcgtgaaaaaacatatcgtctgcccgaaatgcggtagcgaagtgaaactattcttgtgaggttattatggttcaagttgtaagcattaccccaaaacaaactgcctgtcgttgtggtgctgttctgtcatacactgcgcaggatgtcaaagaaaaggtatcaactgattacactggcggtcgtgatgtgtatcgtgtgattcggtgtccggtctgtgataaggatgtagtagtatgaaacgtgaagaacgttatgtcgtgatgaaacatgcggatattgattccgcgttaagtgatagcgataaactgcttctctctgcggtgctaagtaaagttgagcgctaccgaaaagagcaacacaaagaacccctggaagcggttgttgtcgagcatgattggcctgaatatgaacaggtctggaagatgatcgaaacccgtgttgatcgcgaagaaaataatcgtaagtttgaaacgatgctggacaataaagaacgtctgggctatttctttgtggttgagactcaccaggggaaattcctgatcaccagcaacgcgcacagcgcaaaccgtttgaaagaatacacagggtacgaatatcgcgccatgttcagccctgattgtgggttcaacaacagcgaaatctttacgactagctggagcgttcactttaaacatgtggttcgggtatcgtttgatgaaatcatagcgctgtacgatccgattgcgtcaatttcaaactataacattgctgaattcatcgagaaaaagctgaccgaagcaaaacagcgtaaaatcgttgcataaataataagacgagggtatcatagccctctcttgttacaaataggtattacaatgaagaaaattatctttgctgccagcattttcttatgctctttttctggcaacgcggcgactgatccgttaggagagtttatccaaacactcccttctgtgaagtcaactttaccgctacaacaagcaacagtaatgaagaaagcgccagccaatgcccccagctatgttaaggaattggatgatattacaccaaaacagaaaaaggttttggagtacgctttcaggatcggtaacgaatacgatctcaaaactgcaaagccagttgaatcggaaacatcgaaacgtttgggatatcatttagcggctattgcctggatcgagtctcgcgcatgtgagaacgtagggaaaggcaaaaagaatcatcatgcttatggttgttttcaagtaacagcccgtagcgcgtccgcacgaatggataaatcatattccaaacgcgtagtaatcaataagctcgaaacccttcggggtggttccaagtacgcacttcacgaactggaatactggcttgattaccacaaaggcgacttgaaaaaggcgctggcgagttacaacgcggggttcaagtattcaaagaaagaagcccgtgattatgctcgcatggttaaccataccgcgaagctgttagaagaaaaacgcattatctgataaaaagcccttgcaatttcgcaggggcttttttattatgtgtgtaccaactattgaggattaaattatgagcacatcacatcgagttattaccagtcacccgactatcatcaagccgaacatgctacacatcattcagggtgtgttagatgaactgaacaaagatccaaaggttaaagtggaaaccatcacggtcgatcgtcatcgtatgtaatcgttcagtatctacttcgcatacggagaagaaaaacgcaaactgtttatctgcgaaagtcaagatacgtatcttgatgttggcaacagcacaattcatagcggcggtgtttacttcaacctgaacgtgtggggcagcaacaaagagatcatggatatcgtgaaagtgggtattcgtaagcacgtcccgaatgacgttagcatttacgaatgtgttaatgatgcaattgaagatcgctttgtgcgcgtaggggcttaacatggaaactaaactgacaccggaacagcagttagcgatcgttgatgaacgtatcgacgagatcagggcggtaatgaaaccttaccaggaaaagctgaataaacttctgaacgctcgcaaagacatcaaagaagagatcgatcacaaaaccgcttcccgtgtccgcgcgatgactccaaaacaacgcattaagttttacatcaattccccgaacagcggacgagagattttccatgatgcgactaagttcttccaggatatggggttggggattgatggatacaacccagaaaccaatcagcatattcttcgtatcgcgatgaatgaggatcgcagtaacctcgaaacagtcctgaaatcgcttcaacgcgtgaaaccatatgtgaaaccgatcggcggtaaactactattcgacatcttcgaacatacatgttcacagttcaacatgtattggttagcctttgacgttgcagaagaacgctggatgtgcttcactggctggagtctggaactcaatcaaaagccagaatttgaaagcgatagtttgcgatcagtgcttgcttatgtctgcgaaacccattattatacccctatcgaaaacgattcatactaaggtaaaacgatgaaaaaacttgcgctgttactcactctgtttgctggctttgctcatgctgatgatcgactggctgaactctgcaataatcgtgacattaaagacgttgcggtatgtgaacaggtaatcgctgaacaactggacgcggcttatgtatggggcgaagaaaatgcgcacctcttcaagcgtcagaagctggttaaacagcgtgagtttttgcagtctgaaccgatgatgaacctctgcaccaaagcgccaaataaggaacgttgtgaaaaactccgtacttacctggttgaagaatataacgctggtataggattatactgatgttgggattagtgatcttttatgggtgtgtgattgctgctgcaatcattatctggtattacgttaaaaagccaaacgaaagctcgttccctgtatatgatgacgagttggaagcgtggcaaagatgggatgaccaatttaaatgaacacaggttatatcttaatgtgtgttattgttgtgatcgcggggctggctgtgctggcttaccgccactatacaggtgatgaaaatgattattaaagaaatcaaagggaacgctgtagagttgttcctgaaacgaaaagtacacttgattcatgggtgtaactgttattgcaacatgggtgcgggtattgctaaagaagtgaagcacaaaatccctggtgcgttcaaaattgatgcattgacgatgaaaggagaccagcgtaagttaggcactaactccatctacatgacggaagaaggtcagattgtcttcaatgcctacactcagtttaaattctggggtactggcccgcaagtggattatgacgcaatccgatcatgctttgtgagcgccgtagaacgcgccagtgcgtttcctgaaaaattgcctatcattacccctcttatcggtgcggggcttgctggtggcgattggttgcgtattagcgccattatcgacgagtgtacgggtgattatccaatcatcgttgttcacttcgatccatcggttgatccacataaggcggatttatcatgagaccgcaagaacaaaagctgttaaaacacaagctgaaacaactgggcgaagcgtatcaggattatgccgaagatgatgatcctgattcacgtaactacaatcaatcctgtatcgacgatattacagcggatatcctggatttcgttgaaaatgaaatcaccgatgctgttcgtgatgcggtagcggtggagcgagctaatcatgactgacaaaatcaaagctaaagcaatgaaggtgattgcgacatacggaacactccgttggtgtaacgcgcaggtgtgcgggtgtatgggttgcgcaaatcatactatgacgaaagaagagtatgatattgctatccagataccggaaatcaaagagcatcttgcgcgacataatgaaaaactcatgggtaaaggatggttttcaattggctaacgcacacattatagaaaaagttcgttgtcgggattgtcattttcctttgatttgcgtcatgaacattgacaaacccccttacgacgagtgggattggtggatatactgttcaaacaaaacatgcaaaaaccatgaaggtgagggcaaattccagaatcatattaagtttgtggagcgtgtcaatggctaaattgtattatcactatgcatccatgaacgctggcaaaagtgcgcgactattgacggacgcgcacaattacaaagagcgcggtatgcgagttgtaatctataagccagcgatcgacacccgcacatcaaacacagtgagttcgcgtatcgggctgaacgaaaagtgtgaattgattgcgcctgatatggatctgttctgggacatccagcgccggaataaaattgcttgtatcttcgttgacgaggcgcaattcctttcgaagaaaaacgttttcgatctgtgtcgtgttgttgatgaactcgaaatccctgtaatggcttacggtctgcgtactgatttccagttgaatctgttcgagggttcttactggttgctggcctggtcagacgagatccgagaactgcgcggaatgtgtcactgtggacgcaaagcaactacggttgcacgtatcgacgcacaaggcaacttcgtaaccgaaggggcgcaggttgagatcggagccgaagacaaatacgtttcgctctgtcgcaaacattatcacgaaaaacttcttgataatgttggtctgaactgttaaggtgtattcagacaaacaaaggagaacactatgagccgtacttaccgtaagaaatatgttccagtccgtgataagtcctccatcgaacagatcgaagagacaaaagcattttcagagtattatgcacagcacggggaaagtcctgatggtttacgttggtatacaaccaactggaaacacaaatcaggttgcgcatatatccggttcgataaaaacctgaatcgcgacggtaacaaagctcatcgtgatatctccgcgatgctttcaatcgctgtgaaaaagattgattcgaaagtacgcgctaaaatgcgtcaggaattacgccggatgaaagctggcgtaattggatgggatgaaaatatcgagaacgcaaataagatccgcgcttttgagcgtagcttatgctggtatgagataacttgatgtatttttagactaattttacataaggggcgaatcgccccttttttgctataaatatatacaggaacggatctattgttgatccgtaagcacgtagagaattgcttatgaacattaaacgcatatctaaagcgctgatgtttggtttgttaatcttgtctccgtcatcacatgctgatgataggtcagtagtcgccaaagagttcgattactatatcaatgcggcgctacaggtatatcttgacaccatccctcccagcgtaaataccagtgaactattctataattacatggaacgaaaatggcagcagaagcaatgtaaatccgaacccgaatgtaaacgtttagggctacgggttgcaagtgaattcgccgctattcatcgttcataagggatgaagatgcagacgtttaacgaagtaacagaacgcgataccgcgagtaaaattgatgcctttattggcacttgcttaatgtctgtaacctatatgcacagcgcacactttgcgactggttcatattcacagcataaagcatttgaagggttttacgaagatatgcaggatttggttgataaattcaccgaaatccatataggcattactggtcgatacaaacccgtattaaaaacagaaaatgtgcttgacacggtcgcgtatctccgtaaaatagccgatgaagccaacgaaatctatgattcagtagatagttcattgaagaacgtcctggacgagatcaaaggcttgtgctatcaaacgatttacaagctgacaaaactttcttaaaaagagtttgacaagcgaaaaagtgatgatagaataactatcgaattgaaacataaacccaatggaaataatgatgaacttaaacactatcgtaaacaacccgaagaaaaccactctgatcgctctgggcgtaatcgccgctctgtggctggttccgaactcgtacactatcgttcaggatggtacggtaaaaactcaaaccttcatgggtaaagtttcaccgaagcctgttctgcctggtttccacctggtaaatccactggctgatttcgaggtgttcaacaccaaagacatcgcaatgaagtttgacaaattgcaggttccgtcccaggataaattcaaatccactgtggatatgaccgtgatgttacagttcgatggtagcaaagccccgatcaaccgtatcaatgcgggtagtcaggatcaggcgctggataaatatgtgactgaaaaacttctgtcaactgtccgtgagttcggtaaatctgtaccgaaagcacaggatctgtataatgcagaagttcaaagccagctacagatcgcaattcagcaggaagttgaagagtatgcccgtccttacggttacacagtgaaacaggtattcttgcaggacatcgacctgccggaagcgattaagaaacaggttgaaaacacgaaaattcgtgaagaacaggtgaacgcagaaaaagcagaactggcacgtaaagagcaaatcgctcaacaggcagttgttcaggcaattgccgacaaagaagcccgtagcaatgctgcacaggctaacgagcgtgatgctgatgcccgtctgtatgcggctaagaaagaagccgaagcgaacgccattctgcaacgcacaatcaccccagaaatgatccgctggaaagaacttgatgttcagcagaccatcgcggacaaatatcagggcggtgtacctcaaactgtcatgggttctgattacgctggtaaagtgattttcgattctcgtaaataaggttttaaagcccccgctcttgggggcttgactcctaaaacgagaatactataatgaacataaaacagatcatccttactatcttcatttcgctattcttcggctttattggcggttttcttggtgtattggtgattgcgtctgttttatgattaacctttaaacgtggagcacgttatgaaacaatttgataaagctgtcgtaattggcagattccaacccttccataatggtcatgcagcaatggtgcgtaaagcactcggagaagcaaagatcgtttacatccttctgggttcagcatatgcttaccctaacgttttaaacccgctgacggcgcgtgagcgtcaaaccatgatcttctcatggcttaacgctaacttcccgatcgaagatgttgttcgtgttcagtttgagaacattccagattatctttacaacgaagagaaatggaaaacctctgttcgtactgctatcagggaaaccaaaggcgacaaaatcgctatctacggttacgaaaaagatgcaggttcatactggcttaaagcgttcggatggacacacgtaccagttccacctgtccagattaacggcaaggatctatcagcaaccgatcttcgtccgattatctttaaccataaaaacgggtgggataagaaactgttgcgctttgttcctcaagcaaccgttgattatatcgacaaatggatgatggaagacacgttctggcgtttattctacgaatacgagaaatgggaaagcgaattggagaaattcaaaaactacccataccccgacgcgctaaactgttgcacgggtgatagtgtggttgtgtgcaacaatcacctgctggtaattcgtcgtaagttcgccccaggtaaagacgcgttagcccttcccggcggacacaaaaacgcaaatgaaacgttcctggattgtgcgatccgcgaactgctcgaagaggtgcggatcaaagttcctgaaaaggttatccgtggttcaatccgcaattcgatgttgttcgatcatccgaagcgttccgtacacttctcaaaaccgactgtggcgcagtacatcaagttagagcctaacaatgatggtagtctgccccgcattatgggcggttctgacgatgcgttagacgcgttctggatgcccttacatgaggtcgtgcaacgacaaggggaattcttcgatgaccactatcaaatcgttgtagctttcacgggactctgataaaagattaaaaaagcccttgcgttcgcgtgagggcttttgtattatatacacataccgcatgaataatgaaaaggaagaaaaatgaatacgatcaacgtttctaaagctgatgttatgaaagcaacgattattgctaccgaagccatttcattcatggctaagaaagcaggagttgatggtgctgttatcctgatggagattacaaacaacccagaaggcaacaccgcaaggtatttcaaagatcttacttcctatgcaatggaagaatttaaatgattaaacgtccttactgcctcgtaaaccgtccgatctgtgcgggtggtttacccgtcaactgctggcagttggttgaaacaggtgaagcgttcctgaataaacgcggtgataaagtattcgtctatggtgtggactcgatcgagaatgaaacgatggtgatcaccgacgagaaaacaaaagaaaaatatacgttgacttccgaccacgattgccgtaacttcaacgtgtactggaaatctgatgatgatgaatttgagaggaataaatcatgaaagtggcaacccttagcgcggtatctctgatgtaaaatgtcgtatggcgctggaacctggacatcgtgtaggaattaaacacacgggttctgtaggtacaaagaattacaccttgcaatcagttgcgcgtgataaaaatgatatggtttatgtgtttgttactgaaccaatgtcaaataatatccgccaaacgctggtgatgaaactgggaacaaaagaacccgcaatgctgatcggtggaactgtagagcctgttactgttgcgagcatcgcgcataaaggtattgaatgcgccgtagacggtaacggtaaactgtccttcgaagggactaaacgccaacccgtcgatcgtccggttgttgctggagacatcttcacgtcagaacgccgcgaataccacgttgaatacatcgcacaagatggttctctggtttgtcgcatgtactcccgtaagagcacagacgataacaaatacatgggattgaccgtcattgatggacgtgacgcgatcctgctggattccctgaatattaaaattaagtttgcatactcatgactcacacaattagcgttattatgggtgatgtcgtaaacatcaacggtcacgattactacgtagcggaaatcaatacaaaaggtaatcgtgagatcctggaactggacattgtaaggccgtccgaagggcaatcccttacaatcgaagtagttcataacacgaacacaggggaagacgtagtgaagccagttctggcacgtcttccggtgttctactgtgaaaagtcaaaatgttggaaaatgaaatgaatccgaaagatttaactgatgtgaaagtgggcgataccctttacgatcctggtataagtcgatacaaccatcatacaaatcagcatcctcgcgaatttcatgttctcaaggttgctcgtcaatatctgtacgcatcaacagataaagatgctggcctgaaagattggaacgtcgagaaagtagatcgtaagactggattgactgctggtactggagggggctggggtggattttatttgtatcgcagcgaagcggtatacaacgaaatcctgtatcgtgctgaactgtgtgaaaagatcagaaaagagtttggttctcactctgttgttgttcctgaaatcactaccgctgaactgcgcggtatcgcaaaaaccctgggggttgaattttgaaaactgtaatggaaaccgtgttcggttctcacctgtacggactgaacacaccgacaagcgacaaagactataaagggatcttcctcccacacccgcgcgatattctcctggggaaagccccaaagactatcgacacaagcacgggcgataaaagctctaaaaacaccgtggatgacgtggatcgtcaactgtatagcttgactaagttcattagccttgcgtgtgatggtgataccgtagcgctagatatgcttcacgcttcggatgacaagctgatcgctaactctgaaatctggcaatatatccgcgctaaccgctggcgtttttacaccactgaactaactggcctgttcggttatgttcgtaagcaagccgcgaaatatggcgtgaagggttcccgactggctgcactgcgcgaagttgtcgatgtactgaaagaaaccgaaacgatcggtggtattcaggaattcacgccagatatgaaacgctatacgcgtgaagtgaaagtgtctgacatcaaggatcgtttccctacaaacgagttctgccgattcgttaccgacacgacaatgaaatctggttgtcaggacttctatgaagtgctggggcgtaaattccagttcacgatcaaagccgatgaaatgcgtaagtctgtgtataaactctgggatgaatacggagaacgcgcacgacaagcagaagccaacaacgggatcgactggaaagcattaagtcacgcgttgcgcggtggtatgcagttgatccagatttacaaagatggtgatatcgtttatcctctgcctgatagcgcattcctgaaactggttaaatctggcggcgtaccgttcacaacggtacaggaaaagctggaagaagtcatgggtgaagtcgaacgccttgcagcgatttcaacatatccgaaagaagttgatcgcgaattctggaacgatttcatcgaacgcgtataccgtgatcatgttgtggggtattacaaatgatgtatcctaaattatccggcgctgaaattgatgttctgtataaactttacggatatgcaactaaggtgctagacttagatttcgatgacgtacccagcaaatcagggcgtgatgccctgattcaaaaaggttacgctcgaagggtaacgggttatcacgataattcgaaagcatggttgctgattaccccactggggattgacgcataccgacatggtattaaaacggagtggcactaatggttaaagatgtaaatctgtatgtgggttacatcgagaaacgtgatattcctcgcgtagaggatattgtttccgatatgattaacctgtacagtgagcctccggtgcttgctgaaaagatccgcgatgctctgtatcatgcattctttcgggtatatgtcgttgatgttatcaaacatgatcgttctgtaacaaatgaggattacgattatgaaatcagtatcaacgaagaaagcccaacacacgtaaatttcaacacctacgggaagttttactaatgactgatgttattttgaaagttaaagatgttgtactgggcgataccaaaaacccagacgcggttacactggaacaggctgttgttcagatcatgcgcgatagcctccgcctggaagttactgaacgcaccgaaagcaattacacgggcggaattgttggtcgccagttgtacgaagatagcaaacacgttaatgtaaccctatgggcggacattgacgaaaactcatacaaaattgacgagattgattttgacgtatgaaaataattgacctctgtgctggtgtgggcggggttcgattaggatttgataaggcgttcggcggtgtcgaatgccttttaacgtctgaaatcgacaagttcgcacagcaaacatatatcgaaaactggggcgatgataacctacagggtgatctattcgccattgatgaaaacaaagtgccggatcatgatatcctgctggcggggttcccgtgtcaggcgttcagtaaagccggattgaaactgggctttgacgatgtgcgcggtacggtgttctttgaaatcctccgcattatacgcgctaaaaagccccgtgtattgttctttgagaacgtgcctgagctactaacccatgacaagggaaagacgttcagaacgatttacgggcttctggaggccgaaggatacaacgtattctatcaacgcctgaacacaaaggatttcggactaccacaaagacgggaacgcgtgtttattgtctgcttcctggatgatgtattcttttcgtttccggttcccccgcgcacccctacacgagtaggcgacatcctcgaaaatgctgatgattcgttcaccctgtcagataacgcatggaagggctttagagagcgtaaggaacgaaataaggcaaacggtaagggtttcggttatcaggccgtcacaagcgattctacgcacactgggactatcacccagcagtattacaaggacggcgttcaatgtctggtgttgcaggaaggaaagaaccccagaagacttactccccgtgagtgttttcgtttgcaagggttcccagattcatttatcataccggatagtaaaaaacaggcatatcgtcaagcgggaaattcagtttcaatacccgtgattgaagccatagcgaaacaaattaggaaagtattatgagaaatcaaccagaaatcccgatcgataccgttgttgaatggcattacaaccactgggataatgatgaatggtctgccagccagggcgtattgaagtatcataaaggaaacttcatcctgatcgaactcgaaggtaagccaaccgtgctggacggtaaagatttggtaatgcgtccgtacaaagaaagaccggaaacaaaattcttcaaaaaagtgtttgtatccagtagttgatagtggtatcttagctttaacgaaacgaaactgaaaaggaacataccatgacttttaatgacctgtttaacggatgtactggcgctggtgcgaaattcaatctactgaaagattacccgctgggttctaatccaggttacgtgatggttgaagtgcgtaacggtgaatactacaacgtgttcatgtgggatcgttctttctcttactgctggttcggtgcgaaatacaaaccagattacatcctggaacaaatcgaaacagtgaaagcgaaaaaccctgaactgtacgcgttcgcagagtctattcgtggtgtgttcggacactgattaatcaagccccgaaaggggctttttcgtgaggaaattattatgatttacactgttgaatgtttggttgattatgaacctggtaatctgatctgcgcgtctgataccgttatggactgcatcgacgcggtgaacaatcacgaaaccttcccgtatgttgcggataatctgcatttcactgcgtggaaagacggtaagaaagttgcggttgcttctttagtaggaaacagagtaggcgatacaataggcgctaacggctatgaacctaaccctgtgacatacgaagaagtcattggtaaaatggaggcggtatgaaggttaaaaacgccgaacgctgggagaagaccaaagaaatgttcttcatccgtcgcaatcgtaagcccctcaaacgcgggtatgacgacatcgacgaagccctgagcaagtttaacgaaatcattcgttcatccgtctaccgtagcggggaacaccctggcgacctgtgggaactggtagcaaaagacccttacagtaacatcgtcctgaaatctgaaacaaaaggtaaagtatcgtgaaaatttatactgttgaaagtttaagcgaagattactatacatttagtgatttggtcggttctaccgtatcgctggaacgtgcgattgaaatggctaaaccttttgactgggtaagtatcactgaatgcgacggctttactggagaacgtctgcgcatagtaacactgagcaacgaaaaagccattgcgaacgcaaccaaagaaaacttacaatttgaggatgtaaaatgaaaatccgttctggttttgtgagcaacagttcatcaagtagtttcatcgtccggttcccgaaagatccgactaatatcgacaacctgcgcgaaatgatgggtgattgcgttccgaactgcggttactacaatcctccgttaacagcggaagaagtggtcaatcatgttcaccgtgacttaggcggtcatctgggtaatagctttgaatcgttctacgacgataaacgctatgactgggaaaccgaagaaagcgcagaaacccgctaccgttcaaaccctcaaattgcgcttgcgtatgacgggcgagactggtacgatctggacacagaagagaaagacgctctgatcaaaatgtggttgtatgaagagtacaacacgaagtatggcaatcaggacggcgtgtttatctatgaattcacgtactccgatgaatgcggcccgatcggaactcaactggaacatggaaacatcttccgtaaccttgaacacacatcaaagagtcatcactgatggataagttaaaaaccgaagtctgtgttgttatgcctcgctatgcattaggggattcgatcccctttagccaggatcgccccgcaccgtttgatgtattttctttgcgaaaatatcttgaacgttttgaactgaacgagtatactctccaaatcgttcgggtatggaatccggtaatgtatgcgcttgcgtttgacattgcagaatccaaactcactacgatggatgaatacgttgaactcctggcgcgtaagttcgggtgtgatcgtacagtcgaagcagtaagcaataaagttaacgaaattttagaaaaattcaaatacgagaaaatttaaatgtcaataacaaatatcgaattcaaaaacgctgtatcgaagccaaccccgacaaaccacgttttcgtgtgtgacgtatccggttcaatgtataacgaactgcctaagatccgtaaacacctaaaagcaaatctggcgagtctggttaaacaggatgacaccgtttcgatcctgtacttctccagcaaaggcgattacggcacggtgttccgtggtgagaaggttagcaatgtctctgacctgtctaacatctgcgcggctatcgaccgttacctgaaacctactggttgtactggcttcgttgagccgttgaatctggctgcggaaatcgctaccgatctgcaatccgaaaacggcaacctgaacagcctgatcttcctgacagacggttatgataactgctggcgtaccgatgacatcctgaaagcgtgtgcggttctgccactgactttcaacagtatcgcgttcctggaatacggttattacgtgaatcgtcctctgctggaaaaaatggcagaagcaaccaacgcattacacaaattcgttgaaggtttcgacgcatacgaaccagcatttgccgaaatcatcactgcgcaaacttccgcacgtatcgaagtcaaagttgctgatgctacccatgcgatctacctggacgaagggcgcgtgtatgtcctgaacgctgcaaacggtgttgtgctggttccagaacacatcaaaaacatctgggcgctgggtgaaaacgcgattaatgatgttgacggattcgatccgaacatcgccagcgaacagcaagttctgtatgtcgtgctttatcatgcactgcacacaatgaaccctgatctggcatggaaagtgcttcaaaagctgggtgatgtccgtctgatcaaagcgtatgacaactgctttaccaaacaggactactccaacgcgaaagacctgattgcacaggctgttgtagatccatcacagcgtttcgttgatggtattgattacaacatggttccagacgaaaacgcgtttactctggttgatgcgctcgaactgctggcacaaactgacacagtgatcgacctgtcttctgagcactgggcgtataaccgcacaggccgtcagactgtacagaaagaagatgatacactggatcaactgaccgaacagatcgcaaacgctgcaaccccagaagaacgtaaagcactggcggcgcaaatggtagcgcatgaagtctggacaccgaaatttacccaaaccacaaccaaagtatcggttaaacatctggtgggtaacagttcccgtcctaacatttccatcaacacggatctggaagggtatgtgactatcccagaaagcaaacagaaagaattcggtctgccggaaaaaatcgaaactaagcaggtgcgtaacttcaccatcgttaaagatggtatcgtgaacgttaaagttctgccgctggaaaccgatattccgacactgaaaaaccttcgtgcttctggcctgactatcaagccgctcgaaaaaatcggtgatgatcgtatgtctgttctggtagactttacctctctgcctctggttaaccgtggcatgactcgcgggttaagcggtaaagagttcgtgactgataacgtgcgcctggaaatcctgaaaggccgtcagaaggttatgaagttcttccgtgacaacgcgatcggactgcgcaacgcagaagggctgaaacagcgctttggtgaagctgcgggtgaatggctgtctgaacagggtattcgtgattacgggttctctccgaaggttgagcgcacagaatcgactgatgtttacatgtcgaaagaactgaacgtgaaaatcaagggtgtttcctcccttcctgctgtagcggctaccgtcgcgaagcgtgaagaaggtaagaagaaactgaacaacggcgacctgattatcctgtgggcttacgatcaggtgaaatctgaactggatgcgcttgacaaagatcaggtagtcgagtatcttgataagcagacaaaggcaacgattcaggaagtccgtaaactgaatgcccgtttaagtcgcgtaatgtacggtgttgtagtagcacatgcatggttcgcggatctggacttcgaagaaaccaaagtttctatcgctgcgaaagatattcttccgaaagaagataatattccgtccgatttctggaaagtctgggaaaccacatcattcgaatgtgaaattgtcctggaagaaaaagaagtcaaaatctaacaatgtccgcccccgaaagggggcatattgaggaaaatactatgtcacgtaacgtattctggggtgaagttgtaaaaggcgatatcctgtacctgtccgaaccacaagcctatcgtgaaaacaacgaaaagaaccacgcatacgcgcctatgctgccggatttcgtggttgttgatgatgtatttgtcggtgaaaatggctggcagatcgatttagtcgggttcccttacaaaaagggtgcaatccttctcgaactggaagaccataatttcttcgcccatgttggcaatatcggagatcatggtgaattcggtatcgaagatatccgcgaaaacccgtatgtattcagcaactactacaaggtcggcggacacctgcgcagtgataacaaaactgttctgtatctggatggtcttctgtctggaatgcataatttcagcatcgagaagccaggcaacagcgcagaactctaccgcctgtttgagaagtacaatcatcaagatggtaaactgttgccgtcagaaatggcttacattgtcaaccgtctgatcatgggactacacaaaacattcctgattcactttgacggtgatgtacaacaggcgatggaaactgtgatcaccatcctgaaagaaaaatcacgctgcatggataccctgtcaaaatgactctattctttatcattgcattgggtgtgtttattctgggcgctgcgatttcattcatggcgttcgataagcgcgaatatcaaatggttgtcattggccttatcgtggcaagtatcccgctggtgttgtcatacaacctgtatcatgagaaaatcgcggagaacgcgaaatatgaggcaagacgatgaagattcgttctgggttcgtgagcaatagctcaagcagtagtttcattatcgggataggacttgtccgccctggtaaagaacaggaagttgcaaagatttacggtgagtcaaacgttgaatctctgatggatatgtttgatgatactcgtcctcgctgggatttacctcaaatacacgatgacggcacaatcacactggaagcgttcggatgtaatagcgtagaaataacccgcatctgggacaagttgaaagaactgaatctggatgatgttaaaatcgttcacttcaatgagcgcggcggcgaaccggaatacgacgatgaaaccggaagttataactatgactggtatgacgacgcggacgcattcgggccggaactcgaaaagaaatacaatctcctgagagataaccgcgaaatgttcattgaaggtgatgttcgttgcggtggtggttatgacggctaaacgattggtgatctgttatcgctgtttgcatgtgtatgatcacaacacagcgaagcgaacagcaacaaagcgcttgcgcgttaaagaggcggaatgtcctctctgtaaatgtaaaatctgtttggggtaatccatgataacgatagtatactgggaagaactggaaagcgaattcagtgatgaagctggggaaatggctgctgtagcgggtgaatctgaaatacttacagctaccgaaagcatggatgatgcatttgatcgcatcaagaaacaccagaaagaaaacgaaggtcgggatattcagtacatgctatcgttctggctggatggtgaaatcttctgtcatgctgctattgctgaggatactccggtcgatatgtgtcgtgaagaaatcgtgaagtacgtcaaatcttttatgcattaattaaatgagaattgaaaaatggcttatgtatctaaaaaaattgaaataatttcgtcgatgatgggtaaaactctggaagagatcgaccggattgggaagaactttaaagatgaagttttccgtttacctgaacgtgaaataaatttaatcccgtatttcaacacggttaaaattctgatcgatcctagttttggtctaacggcaactcattacattgtcggtaatgctccatatatgttcgtgttcagaaaatctaagttgattgcgtatttcgatcgcgcgaatcttggacatattcgggcaatcatcgaccggatcgaccgttatgaagtcgggaattacacggaacaaaccagacgcactacatacggaaagattacgagtatgctggaacaaaccagacaattcgacggagctaacatcgaattgattgatgacctgctaaaaagggtcaacaagttcaaagaagcgtttgacgtaaagaaaaccgcgcttgctgaaccagaaacggtgaaagcgccaaccctggcatctttcgaagaaccagaaaccattccagtaaacacagcgttgaaatacatcatcgaaatcgaaccaacagatcttgatgcaacatgtaaagcattgaattctatagggattaatttcactctctataataaattcagttaacccaaaaagcccttgcgttcgcgtgagggctttgttatattacacatatcgaaacggaacagccaaaaggaacgagaacatgaaagctaaaatgatgaagttcgtaaaagactggagaaaaggcgcgacaatcggtgagagctacgtaatcgtagacatcgaaagcaacctgctcgaaggtgcgaacgttttagaagttcctcgttacggtatggttgaagccgctgataaagcaaaagaactgaacggttacgttctccacatcatcgaagcaatcgagaaggaattagcatgaacagcgtttatctgattgaagaaaccattatccagccaaacggcggagtgtatgaaaagaatatcgtgtgtgctgccctgaatgaacaagaggcagatcacaaagtgaaatatttaaatgaaaatgctgttgtatgtcagacgtattccggttatagtgttgcatatgcttggaaagcggttagtttagaaacccaaccatcttggttaatcaacctgaaaaaataaggggcttatcatgaaaatgaattacgttcgcggcggtatcatggcactgttactgaaaggtgtttctcgtagtgagaatcgtatgggtatggggccgatgggtaaagtctggtctgtctatattggcggtgactgtatcggttacatcggcaatgatggattgagccgcgtttacctggctatctcaagcggaggccgtgaagtcgaatgtagtaatttcatgcaagcacttgcgcagttcattgatactgcgattactcagattgaaaaacagggttgtatcgaacgtcgttacgcgaacaagatcgggatgattgaatattccaacttctgcttcgaagtcgaagaagtgcgttatgatacgatggatgaagtatacgaatatgtgcttcgtggtgaggaagtgattaagtcctataacgggacgaaggttgtcaataaccgctctttcatcactccgttcgaattgcgatatcaacagctaatgggctggatcgtgatggaataagaaaagcccctttcggggcttttttgttatgaggatgatagctggagtttgattctttctatttcttccggttcatcaatgatgctgtagtaaatcgttacggtgatcgcgttctcgtcatactgcggaatcacttcaacatccagattgtaaacacggggttcgtatgcgcggatcgcggagacaatcgaagtccttactgcttccgctgttagcgggttcatgttctcgaaaatctgttccccgatctcacaaccaaagttgctatcgaaaggccgtgtgcctttttgtgttgttacgataccgatcagactattctttaccgctgccgcccctttcgaggcggttacgtcattgttccagtcttttgttaagttgggatcgatatcgctatacagtaagcgaaggttaacacccattttatccaaccacctttagaaacgcctctaagcctctcagtgcaacgatatgttcgtagccacacgaacaccttaccggaatgtttgcaacgattgctggcttatccagagcgctatttattgatttaaagaccggatagtcgatactatccagaacggcttctttctctgactctttacagtcatcccataagatttgttcaccgtcgatgactacaaacttaatcagttcgggcaactcttcctttccggtgcggtgtggttcgactgaaatcttgatctcattgccgtacagcttttcttcgtattcgtccaccatgatatgatgacgattgagcacaaacttaatcagttccccacattcagggcatttgatttggagatctacagtctctttgttgatactgtcgaacagagccataatgtaaacataatcgcgctgatgtctgaacacatcaccttcaataatgaagttatccgtgtcatcaagatcgccaatggttaacgggcgataagtcacattatattttgggatatgtcggggtgtatgtttacgcatttgcattctcttttcgtttcaagtcttccgccagcaatgcaacgtaaattgaacgttccatcgggcttccattcattataggttcaatctgtacggtattcttatttaacaaatagttggttttgaagaactcattcagttctgatttgttgaataggattttgtacagtgtcaataagtcgctgaactcaatatcacgcacggtaacatgacaggacttgcgtaacagtttaacgatattttccatatcttcaatagacaccagatccaggatcgcgttctttgtatcctcgtctaatgcattccattcgtatctttcgccgtcctgcttgacatactggatacattcaaggaataattgttcactgttgttacgatgtttcgggaatttgaatcccagagtaagcgagtcatcaagggcatattcattttgcagaacgtaatcagttacatgcatgaatgcttctgattgtccgctgcttcctttgattcggatcttgattgcgttcttaccgaacgatacgcaatacaccttagtgaatatgttttcctgttcggtgcgggaataacccggatacagaatatctaaaatttcatccagcatttcttgctgttctgtgagcgtcttcccttccatgtccgcgcttgtgagtaagaaactcaactgatcgcgcacggtaaacatagggaatcgcttcactccaccagggagttttacgcggattatatcaatcattttaacctcaaaaggggctttcgccccttattgtcctgtaaccacaccacgaacggcaattgctgcgccttcgataagtgattgtttgaatccgtcccaaccttctttatctgcttcaacaagccagcctgttttataggcaaagtcaacagtgaatgtccagatttcgttattgctttcataactcagttctgggttgctgactttaacaggcaaacacttctggaatacatacgtgctgtgcgggacaccatcgcgattgtgtaagtttacctggatcgcgcttgatacttcatcaatgaatgcgaactggcctgatacatcatcacgaatagctgataaccattcgttgaatactttcaggttacgcgcttctgaatccacacggaacgttagcgataattcaccattctccggtcgggtgaatcggatctggggtacaccgccattatacacgtattcataacccagtgttttaccaggcaactgaacgccaacgatgctcaaccccatattgtacatcattttgtcacggaattctgttagcatctgtccgtaaacactatcaccaaacagggaagtaattaaacgagggcttaacgcccccatgattttactgaaacctgttttgttcagggacataatagctttatcaaccgtatagctgaatagcttgcttacgccccctgtaatagcgttcatgaactcgttcgggttattcgcgttaatggaactcatagtaccatcaattaaagtatcgcggatactcccgatcgtgctgtcgagaatgcgtgatgctggactggttgcgaatacaacactaaacaggttgcttcgctgaaagtctctatttgccattcctgacaaaaattcatctacgctatagaacattgttcccccttaatactgcgtatcaaaaatcgaatcctgacgcatatcgatcagttccataaactgaatttcgatttcaactgcgatcggggtgttcggtgattctctcaacgtatttacaatgttgtccattgtacgcccgaaacgaacgctggtaatacctgctggcccaaatgtagaatgagggaaccgtaaactgtcacctgtctggaagtcacgaataaaccacacaggaggcgatttaataacttcaacgttcgatacgaagtcaacaatctgatccccgatactgccgttgaaatcgcttgctgtcgtctggtttgttgatggtgcaaaaacgtttgcaaccttcgaagcgctggaattatacgcttgcttaaccagtccggctaattctgctggagtaccacccgaagtagtaccataacccaacaccgtgaacaggtaatagattttaatcagttccagcaggtcataacggctttcgataacgaatgtattgtaatacatctttgtgcgcttatcagagccttgaaacgctgctttcgtaccgatgtcgattgcttccctacggtctgccagaataccaccagaaacggattctacagcgccccagataacgtttgatactgcacgggatagacctttagcaacaatactatcggtcgcgtcctgatagcggtgtgagttcacttcgttatcgttcaggcttcgcggtaaaagtatttgacaaattgggttaagtgtacccatagtacgggtattcaaaacctgtttgtatcgaacgttcccagtgttggcactaaggatctgttgcgcgttctgtgcggcctgacgcaatgagcgatagttatctttgcttcctggtgcaagtccaccactgaaatcatatgctgtaaacagcaagccgttattataaaggcttgatgcgttgtacgcgttatcaatacctgctgcacgttgggaaggaaattccgctgttacgatcggttgagtcaacgcgtttttagttgttgcagcacccccagaggggatgccagcatttttgatttcagcaaatgattgtacagtgtcttgcaatactgtaattttcatttaaatttcctttaagctaatgcaatcaatggtttacggtcagttcgttggactgaatgctgaaccgtgttgtttactgttttgttgttgacctgaacgctgttaggcgttgtaggctgaacaggcgctttcactgcttccggttgcttgtcaatacttgcactcgtttccggtactgcggtgattttttcctgccagcgggagatcatatcacgatatcggtctttatcgtcctcattcagcttgttcgaattgtttttctcttcaagcgattctatgagtttttccattacctttttatcgttgcccgtcagattgtctttgttcaggatttcatcgccctgatcgaattcattatctgctttaggtttcgctttctcttgcgctgcttcgatctgtttggtttcatctacacgttgacggttcgcggtattctctttgtcaacctcagcctgtaacagtgcagggttttcctgcaatgctttcagttctttcttcttctcttcggtgatcttctcttcgagttctacctgattgcgaagttcttcaagatgcttggattgtgctttctgtgcttctgtctgttgcccgaaactatatgagaatgtaccctgcgtagccttaacctgatcgacgagcttagaacgctgttcaacaactttatcgttctgatcctggatctcttgctgtttcaacagaaccaaatcatctttatcaatctcaagaccgtatttctgtttatcgcgtagcgctgataccttcatcccgcgtccggcgttagtaatcgtttctgatccggtatattcgcccagagcatagattagattaccgataccttccgtgattgcggttttaatggtatcgcccagaattttaaacggttcgaggaacaagtttttcaatgatccgcccaaatccttcatattgaagttttgcagcccttcattgattttttctgcaagggctttaatatttccgaagtatgatccaaataactctttcgaggcttcaccctctgcgagaatatcctggaaccacttctgaataaccttgctcagaacgtcgatagcgaatacgatactaccgataatcaaagtccatttggcaaacttcgccagcgcttcgagagagtatccgataaagcgagacagaagaccagatgtattatccttgattgaacccagcaacgcaagaacgcgcttactgaatttcttctcgtctttatccttatcgcggatcttcttcttgtcccgatcgacctccggttcctcttccggtactggttcaggttccggcgcgggggctggtttcttttcagcgagttcgataaacttggtgattgcttctgcaatcgttccggtgtatgtttcgattttcgcaaatgggttatgctggttcgatacactgacggagttatcaacactggttgtgctgttgtctgttaatgatggtggacgcgctggcccaacaaaatcgggcaactgttcagcaagtggttgttgatcctgttcgtattgttcctggaagccagcgaatttctctttgaaacgatcctcaaaggatttcacactgtctttgatgtccagtgtattcagcgcggtttcaagggtgttatcattgatatcctttaactcgcgcatcgaatctttatctaacgttgcctggatcttccgaacagttggttgcgcctgtggttttggtggattctgcatccgacgacgttgttcttcgttaaaatatggattgctagccattatcattcaccgatgatgttaagccctttaatggttttcccctcatgcacaatatagacttcctggagtacgccacgttttacatcgtcatattcataacgatacaggcagttaattaattgaatacggttttcgtccgtcagttcgatcggcttcccgttgtcatacgcttctttaagcagtaatgccagatcatccagcattagggtcggtttgttgaagaccaatcgaaggttatcaaaagtatgttcatacttagcttcgctgattttcatatcatccagattaataccgatctctttcagtatcgccattgctttatcgtcattatgataatgcaggtgaatcaaaaggaattcggtttctgctgcggttaattcgcgcggttgaatctctttgatgatatactcaagcaactgcattgggtctttcattgctttaatctgggtgaaatgacgatagcccagacgggggatcgtaacctgttcaccagtaggcaacgtgactactttatttttgctgttcttgatgtttaaacgcgtaaccataaatttatcaagtgtgtttttcttctctttcatgatcgcctcaagtatcccgatatttactatttagtaaatagaatataaagggaggatgtctaatgtccagtaaagttataaaccgcgtcgtgtcggttaaattatatccaacatatgaaaagttcgctgataacgtctatcttgaattgttacctgcccttgtctcaatgagtgagaaaaccatcattaacggtacttctgaaacattgatgcagatctatgataaccagttaatctatcagttgacagagaaaccgattattcaggtatccttccagtataacgaaacgttagaacagcattactacggtgttctgtattcaaacgtcgaaaccgatgatatgaaccgctctatactgcgcctaaacctttctccggtgcatacggtgtttcgtcgtaagttttcccgttcgttcagtaacaacgccgtacagacgattacagagtgcatgacggcactgtataatgatatgaagttgatcacaccacctatcgacgcatcaaacgtgcgtattcctccggcttgcctgagcgggacgtatgaaaccgtgtttgattacatccgtgacaacgggcagagcgtagattcgtctgacttctgttatctgtgggaagatggttccggtatctttatgaaaagcaatacggagatcctcgcacaaaccccgttaaaggcttacaagttcaacgtaagtaacccgtttttaggtgacgctttggtattcactaaagcagaatacattacccataaggataacactaccctgttaggggatgcaagtttctttagtttctcgatgacggataaaaagctgtacagtgatatccttgcgagtaccgatattgaaaacgcatggatcaccatgaacaggaacgcggtatatgagaacaacttccagaacccagacaaacagggtcaaccgttccaggctgtgaagtgtcggacgttatccagttatgaaaaacgtattcggtttgatatcaatcagggtcgaatggatgttaaagtgggggcattgattgaggtgttaggggatgaatattcagggaagtatctgatcgttgaatgtatccgcgatgtatcaaaagatttccacctgcaaacattggaatgtgtacaggtggcagcggctacgaacgacaccagtaaaaccagtgaggcttaggccgtagtttcttcatgatagcccatgaacaggtcgaacacgttgttcttgttctgtttacgggctttcttgatattctcgtagttctcgcgaggcatatcgatcatgaagcacttctgacgcgctgtagcgttctctgtgagcgcgaaaagttcatcttcggtgtaatccttgtttttgtccagatcgagaatgacgcattgccaggtgtcttcatcactggtttgctgcatcatcaccagtgcggcgtttttgaaccccagattatgagcaagcatttcatgaacgaattcgcgatcgtcgtcttcataacggatttcttgcccttcccaacggatcaggcggatagttttacttggttctgatttcataatttattcctgctcatgatttcacgcaaacgcttcgtcggttctggtggattcttaatgatttcctgaatctgattccagacttcttccgaaacttctttcctttccatgataacaatattcgggttatcacagcattttccaaccataacacaacgcccacaattaaggcagattgtgtccggtatcgttggagcattatcaaggaagcgaccgaaatcaatatctttcagcgcttccgcaacccgtgcttcaacggcttctttactcatatcaaccatttttcgcctcgttcatccaatcgcggaatttccacaatttgttctgtgctgcgatgtagctttcttcacggaaattagaagcgcaatagatcagagtcgggaactgaacttcgttattgcttggcttctcgtcaaacacatacacctgaatgttgttgcgagttaaacgcggtgcgttcatgccagcaatcagagccagaaaatccgctttcttagttaagtgagccattgacataatcttttcctctttccgtgttgtttcgatgtgggtaatgtatcactacactacccaggaagcaagcattatttttcgatttcgtagcactcttcaacttcgatgttcaccagaggtacttcgatatcccatgaatccgcttgtgcatcgtatacggctttgtcttcgtcgttcagaggcagacaagtaacccaaccgtcagtaacacgcatcacacgcattttagaaaggctttcgagtgcgtccgctggcagtttttcaccaccgttacccagttgtgccaaacggtcttcatttaccagaacgattactttgccttcgagttctttattgatattcatgggatgttccttttgtctgtttcgtttcgatgtgtgtaatatacaaaaagcccctcacatatgcaaggggcttctttagcaaaaagtgctatttaaaacagatcagcgaagataacgtgaatgtcatccggttcggtcttatcgcgtcgaatcttcttgatgattggcaggaagaaactgaactcaggttcgcccttcttacgcgttttcgatttctggagtccgtcaacttccatttcgacgatagcgccgatatagtcatctttgttcgccataatgtattcgcgatccagttcaccacgttcttctaacgggatgtacacgcggttaataccgtcttcatcgtatcggtagtccgtatcagtcagaccggaacctgtgttcgttctggcttcccctgataagtcctcaaccacaaacccgccaaccttatgaggttctttggtgtgttcgtacacgtcgatgattcgcagttcgatcggggttttgttcttcaacttcacctgatccgcaacgcgtgaatccttccatttgaaatcaacgtttttcaggattgaaccctctttaccgtcattgcggtaattgttgtaatcctttttcgcttccgcatagttctgcaccaggatagaagggatcaacttaaccgatgttacaccagagccagccagcgcaccttccaggatagagaaacgatcgcaatatggttgaacactcggagcatcaccatagtatacttcatacggtacgatatcccagacaacataaacgatattgcgctgttcttcgtcgctgatagtacctttcagggatttgtttacaatcccgttgccctcttcgcgtttcgcttccgcttgtgtctcgttctcggtagcttcccgcctaacatctgccacaaggtcagaaacagaatcgtcgtcatcgcccataaacccagcaagactaaatggaacgctgtttgaaggaacgacagcagttttttcagcagggacataaatcagttctccatcaagtacaacatcataacccagatattcacgaatctttttcagatccttgtccagattcaccaaaccttcatactcattccccgcgcgggttgctttgcggatctggttctctaacagatcggacatacaacgcgcaccatcggctttaagctgcgagtaagcagggaagcgaatacgttttaaggctttctcgctaaacggcgtagcgaggcattgaggctgttctggaatgagtttcttccatacgcggtttggtaacgttgtaccagcaccacattccagatcgcggttaatgatacggcgaagcacttcgcgatcattctcgttcactgatgatacaatatccagcagacgatcacgggctgcgttgcccgtatattttcgcgttgccaaatcagacatcaaatccgcgatagcattcgatagcggggttgtgcctggcttaccgtccacctgcgggaacttcttaatgtgaaacataatctgtttcgtgtacgtaatgcggaaaatctcttttagcagatcattacctgcattacgtttcaggatcgcttccttctctgaaattttcagagtcgaagcgagttcatttagaatctgtaagatcatgtaatttctcttcgatttcaaaccatgatttaactgactggtgaggcgaccacggggtttcacgttcaccacgcaacatatggaataacggcaactgactgatgacgttatggcattcgtttaagtttaccgcaaggtcatcaacgaagcaaaccagacgattgccatatttggctttcgcttccaggtagcggtgtactttggtttcaccatgcccgacaaccatcacttctttgaatgcagaagggaacagcgtgttcaggtttgcaatacggttaaggcttgctgtaggagtggttcccagcgccgtgacagccacgaaatcatatttggctttcagacggttgatcacaattaacgcatcgtcatacgcgcttagatagcgaataaacgaactgttattgtattcttccatgaggattttagccagttggtgatcacacccaaagatttcagtcatatcacggaacttttcatccgtaaccatatccagcgcgatatcggtcggcatgttgtgtttagacaaaaagaacgggaggccgctttgccattttacggcgatcccgtcaatgtcggtaagaataactggtttcaagatataacctcataacggtcgaagaaaagggaacttttaaacgcttgtatatcagcgaggaattgatcacgctcgaatgtacgatagtaatcaaattcgatgcacaacatatcatcgtttgttacaccaatgccaacgacatcttgatgatatttctttgcctgttgcagaacgaaaggatcgagatccgaacagtcgaaataaattacgtaactcattatcaacccttgtacatataaacagcgtcgaagcctggaacatccatttcgactttatcgaacacaatatctttcagcttacatttttcaacgtagctgttgatcacgttaatgttgttcgcgccgatggtaacgtaatacacacccgctttgtagataacacccataatcagggtagaactcaaagcaccctgtgcgtggagtaatgccagcgggttaatcgcgcctttgaacaggaacgcgcattctactctttcatcataatctttcataacagatctctcaatcgggttaaatttcggacaaactcacgttcagtgagtaccgtttcattcatcttattctttcccattgaatgagtcaaggtactttttccggttgcagccagcgcacggcggaacccgtcattcaggaaaagagcattgtacgcgttttcaatcaggatttgatacgcttctgattcacggtgaatcggcatacccttccagtatagggtctgatcgcgataccatttctttttcttgcctttgaacttggcggctttaccaaccagcgtacacacatgcgcttgcatatctggattgctgaatttcagactttgtaaaaagccctccattgatgcacattctaccccgtcaaacgtaaacggatgcggggcgaagttgctcaatgcgcatgatggatactgactacctgatccgatatccattatcgaataacctcatacactttattatttttgtcgatcaacttagcacccagcttacgaaggaaataatcagtaagtcccttgctttcgctttcaaagtgagcactgatgtaatcaaatccgccaccgtcatcggtagaaacggaaacatttttgattttctgtttgtgtgtttcgatcatttcaaaaacactactggatatataaccatgaggaaatcggatgtaataacccataatcaccccgcgaagttaacgagtaatgcagaaaccatacaacccagagcaaaaccaaaagcaatcaaagccagttcactattctgtttcattttcagcttccttcttcccttcctggcgagcgcgtttgcgtccagcacgtaccagagaatcatagtacggacgtttgcgatcgatgttgtcagtgcggtatgctttaccgtaatgactcgttttgaatccgtaatacttcacgctttaacctcgtaaggcttatggagtccacgcgccggatcataacggtcatatgttgtcccgttggttgatgccatgatagagacattctggcgacggttccagttcaacagagcaagaacgatacgatctgccgcttcaataaaatactttttcattagaaacctaccttccatactttttcgaatttgtcgaatattgcaccgatacttttcagatacgcggttgcgtcgtcttcggaatttgtgtacatcgcgaaggagtatcccccaaattcacgacacactgatagcggtttgatgctggtaatgttttggttatatacccgcatcttatcgatcattgcttcggtaatttgatgctcatgatattcgagaatatatttcatttgattgtatacccgtatttgttggtttctgcattcaatgcaatagccagcttattcagatccccaatatcaccctcaaggtctaaatcaatgctgtcaatcttcgcatcattataaagatcagtacccgcgtatgcatcaatttctacgattttcacgttgtgttctcgaatgagattcattgatgcttctgggatacgacgcatttcgaactgaaacgttcttacttcgataccttcacgcatcacgctctctccagacgggttgttacttcacggttatagatccgcgcatactggcgaatgtcttcgttatcgctggtgttcttcgcgatatatgcatcatcttcggtttcgaatgatgctgggttgcgatcgtcgtttgacagatacagtttaccgaagatatctttctttacagtctgtaccccaacaaacatcacaaaatctttttctgtgttaattgaactcatgttaagccctcaaaccaaagctacgttttttgatgacggtgacattatgaacacctctgttattgcaagtgctggttttcagagtttcggctttacgcgcacccagaaccagagttttaacaggagtcacaggagcagcgataaccacaacagcagcccaacgtgcgccaacagctttatcagtacccaggtcgattacagcagaggtatttttaccagcagccagaacatacgcacgggcttcacgacgagtgttgaagcaaaccagttctttcatgttgtaagttttcataatgtcatcctcaaagttaagttgtcttgcctacgtggttaaagatacaagaaagtcggattcagtgcaagcattattttgcataaaaacgaaaaaagccgctacctttcggcaacggcttgatttttaatacttttcttctggctggaacaccgcgcgacacgcccacatagaggcttctttcagtcggtctttcgccagttggatttgatggacacgttcaagcatcgcatcgagttcttcggtagtgaatgaatcggtatccgataccgcgtaatcacttgaatactcttcatccagttctttgaagatttcgcccagggcaacttctgcggccttgatgcggtttactttgtcgatcttttctttcgagtggggcttatagccctgtacgtcttcaatcgccattatatactctctgtaaaggttcgggcgataacgtcgcgctgttgttcaggagtcagtgaattgaaacgcactgcatagccggaaacacggatcgttaactgcgggtatttttctggatgcttcacagcatcttccagagtttcgcggcgcaacacgtttacgtttaagtgttgtccaccttccactttaacagtgggttgaaattcaatatcgacttcacgttttgcgaatggagcaacgcgagctttaccgatcactgaatccatttcgagggttttggataccaccacacgaacatcattaccttcttccaggtagattgtgccagtgtgtaaaccttctaaaatctgatatgctttcattgtattacctttctacgacataataacgcaacgggttgatatggaacgccagcattgcacgatccagcccgttaggatcagttacttcctgtttcagtttccacccgcaatacacgcgtaagcagaactgaacctttccgactttaagccacggtttgaagacataaagcccccatgccgaatcattccacatcaacagataaccgtgacgcgaaggatcggaaccaccttctgttttcgggttacccttccaggcgaagtctgactgtgcttcacgccctaagacgtgataagcgaagttgtacgctttgttacgccacaaccagcctacacgttgcgcatacacacccagatcgcctaagtgataccggatgttagcccaacgccggatatgtccaccatcaccatcgatcgggttatcgaatgtttccatccaacggaaccctttaggtaagtgtccggtttcttcactgtagaacggaaccacgaaaggagccagcagaatagcaagaacacccgtaataatatccaggggaaccagtacaagccagcttgcgtatttcaaaaagcgcatatgcttctccagaaaaaaggctatccgaagatagcctgttgattaacgaactgctttgatatacttatacgcttctgcgaactcttcttccagagcttcgttacagaacgggataccttctgctttaaatccaccagtgataaggtactggataaagaatacagaagaatccatagagatcaattgatggtttgtaggttcgatgtcagttcgacgaacgatattgacgatcgaccagtcaaagaatcgtcgatgatattcgtgtttgctattcacctgcggtgatgcaaagaaaccatcaacagaatacgcatcgaacgctttacggtattcgttatcgaaatctgggatttcttcggtaaacagtttcatcaatttaccgttgatttctttttcagttgatgcagcgacgatttcgcgaatttttggggttaattcaaacagcttttgaagacctttcatatttttctcttttaaatttcatatgctgcgtctatacaagattggattagtgcgtcgggcgaattctcgataattggtactgtttcaccacatacatctgctgcataaggatcgtcatcaacataacattcacggaattttaatttatatcggtagtcatttttacataaccccgctttccattcgttgaatgtcatgccgtaccgctctttgaattgcgctggcgtaatctctttgaacgtatggattgttttgcctaacttagagtcatacaccgtcttttcacgaattctcatatagatctcacattgtttagtgggctggaagtttctttacttcaccccgcattccggggaacctattaccggataccaacagagcctatcccgtgggatatggttgcatattccgaaccatttaacggcattgcgctacgcacccgaattggagcaggtgaagggactcgaaccctcaacaatctggatggaaaccagatattctaccaattgaactacacctgcgaatttttttagaactgtttgcgatagatctcgcgaaccaacggatcaacatctttcgcgtacttacatacgtcttcgaactggacgatgtacgccatgacttcatcggcacgggatttaagtttaccctgatgcgcatcaatgatcattgctgtcattacgtcaatacgcgctggggcttccagaatttcgcctttgtcgaacagctttttggatttgctgacggtatcagcgataattgcttgaattgatttagccatttttagatctcgtagattgcctggattgctttgtaatgtgcggaaacgtattttgtttccttctcttttgcttctttttcggaaatgtaacccgcaaccagatcagggtcaggaacattcgccatgtgagcgcttggcagtgggatatatttacccaggattcgttctgccgcttctgctggaacgtctacgcctacagaaacaactttaccataaaaaggttgttccccgtgctggcgtacaccaaccacgataccagattcagatttgatttcggaaccctgcggacgcgcagtagcttcgatgatcacatattcgccggatgcttttactttcagttcagacatttctttactcattgttgttaaacactactttggaaaagtcgataaacgattctaactcttcccgtttaatttgttccacgacacagccatatttctgcaagcgtgaaatccattcatcattaccacgatcgtatttatcgagataatacaccgatgtaatcgccccgctagcaacataccattcgatatgtttcgcacagttagggcaaggcgatgcagttgtgtaaagtgctgcgtctttgagtataacacctcttgtgtgcgcactcaatagcgctttcatttctgcatgaatttcgttatcgtttgaccatgctgaatgttcaggacgatcaaccgctttcagtttaccgtcatcattcaccatatgattgttgcatgagttgcaacgacaatcaaggtcaaccgtattattttcgccccacgcgacggcacgaccaccaatcgcgataatagcacctacacgattcgaaatacattgagaacgttgactccgatcgattgctctcaacatattcattactttgaatttcattaacggtcatccatatatttcagaatgtctttgatgaaatcgttatcagggttgacgatgtgatacgtagtacctgaacgtgtcaccacttcaacaaacgatttgttcgccggaatcgcatattcaacaaccggacttgttgcaatgtcctgttgaggatcattatcaaccaacccaaacacacaaccataacgaagcatcgttggttcagtacataaccatgcctgatgaatctttctgattttgtcgctcataatactcccgcccatgctacgaatttagttaccggattccactgaatcccgaactgctgttcaacgatgttacgttgactcaaaatacccagaaggaaggagaactgaccatcgcggacaatcttcactgtataaccagcaggaattttatcagcaatgcgctggcctaactggttgagtttcagttgaagttcaacaggattctcaactttaacacgatcacccagttcaaccatcacattttcattttcacgaataaccataatattctcctttgtttgtgcgggtatcttatcacacccgcactcactgtcaactgttttttagaagtcgccgtaatcaacctggaaacacggaataccgttcattcgccacatcccgactggtgtatccctgtcgtccactgcaagaacaggataatacttatcgagaatcttttcaacaagtatttgctcttttacgtgaatatcgtgacgatgatcaccttcttcgcgcatgtagataccatcgctcaggtcaacatcgtatccgatcaggcttgcagcggtatcatgtgcgcactgtacagtaccctcacgcccagacacaacaacacaggcataaccagcggccttatacatcctgaacagttcttgaacaggagggttaggcggatcgttgataaccttcgtgaagtcatacgggctacgttgtccaactttggttaatgtcccgtcaacgtcgaagatgacgcatttcggtttgctcggatctgcatagctcatagccggaacccagccacggagtttacggtactgttcgaacatcgcccagacacgggaaacaggtagagcattcacaccgcgtttatggttgcgtttcaggagttctacgatatcggcatcaatccattcgatatggaaatcagcattgaactctttcgcgatctctcgccacacatcatgatctttttggtgtaaatgggtattgtgaacgataacgttcttcccactcgccagggcattacgaactgtatcttcttgcacacggcaaacaaacagttctttctcttcggtgaagcgatagccagtgagatcaccgccagcacagtaaagggttttgcggatatcgtcacgggaaacagtcagagtgttccccagttgacgcgctttttctttcgcccatgtagttttcccgctacctggtacgcctacagtaataaacagattcatttcacaatctcatattcaatcagttctttgttatgctcattcgttagattgagccacatatcacggttccagtcattttcgatccagagaccttctttgtccttcttcgcatcataaacctttccttcggttatgtcacggaaaaatgacttgattattttgacttgcatttctcagggtatcccacggtacacagaatgttatccgtctggtctttctgacgcttaacgtcattcatccagctacggaagattaacgaatcgggatatgaaagggcaacgtatggattgccgtcataaggcatgacaaggtattttttaccgtcaatctctcggacttctgcaaccactttccatttcacattcaccggattcaccttagcggggagcgtaggcaaaatcttttctgggggcttctcagcacacccgaccaacagaacgcccagaacaagggctaacgttgcaattttcatttgtcgtactccgccatatactcttcgaaggacttgttgatcttgatttcgatcagtcctggtttcttgaacaacaggtctttacgtccggcatccttgaccaactgctgatccttacctttttgttcgacatagatcaccgtattggtgttgtttgtctctttgacttttttgatatcagcctgtaactctttgatatctttagccaattggtcattttcacttttcagcgtgattgtcatgtacaaaagccctgctaacgaaccagcaactattacaggccatatccacgaacttatattaaacgtacccaatacgtttttgatattcatataacgcttcctcgtaagctattgatgcttgttcctcggtatcatagtaaccgatgtgtttttgcttcccgtctatctttatctgtgctcgatattttccacgcgaagccctgtaatcaacacctttggatttaaccgttttaggtgttgatttagcttttcttttcagcatattatgaagcggatctgattcctgtagattttctataccatccccagcttccaacccatgcttatgatcaataagcaaaggcagataaccattacagtaatagaaaattatgcgatgtcttaaatattttctatcgccgtgccgaattctcacgtaaggttttgatttgctcataatagaaccagcttcttttccctgattctgttttgctgcattgctattccaaaaaatttttccggtttctgggaaaacgtcaacgtaaagaagcagggaatcgatccctgctttctcttcttctaacgttgtgcttccagcgccaaagcactttgtcatttatattcttccggtataaactgttcgtagttcttcgccattaatgcaacgatgttatcaaccagcttttgcttatcggtatcatcgaaataacgcatcataggcccgaagataatacgaccgtcaggggttaagtcagcgctcagggcgatcgcgtagtctttgcgtgatttgcctttcgtgtcttcgattgcctggaatgcttttgcagtcagacgattgagactatcaaggaataacgtttcgaatgcgtcaattttcttgagtgcgtacatatcatcgaggaacatttgtttcaggtcatcgacggtattttcaacaatatttaagaacagatctttgttattgttgatgctatccttcgtgcggtgaaggtttacataccagttggttttcgctttcacaaaacctttatcagttttgatcacgtaaccctcgaaaccttctttcgtgtaggcttcggtaatgaacgcatccagatcggtgatttcgattttctcgcgctcaaccaggaacggacgtaatacaccatctgcgaagatatcctgataatcgacatattcgcccgtgtcgttattacggatgttcaggatcaccactgctggttcctgatagccaattacaatacggtttgtcggtgcgacgtattccatgttgactgtgaaaccatcgttaaccagttcggtcaggcgatcgaacaatgcgcggttagtctggatcacgctcatagcgtccatagcctgttcagattgaacggatgctttagacttaacgcccagatagccggaatcacagaaggtggagatcagggaaccatcttccttaatcatcacatccactacggtttcaccaatcgtcacaggagaggatttcagtgcttcccatgcctttacctcggcatagttgaaaaacttctccatagggcgactgacgagttttacgggggtatccccatccatcgcaaacatgataccgcgacattccagcgcaccgggttttaaccagtcggaatagctcgccatgcgatagttaaagatgcgcacgttggtttgcatcacagttttttgatcaatgaagtagaagcattcgctttcgttacacagtttcatcaactggtcaaagagggttttctgatttttggttagctttgtcatagtgctgtttgttccattcaggattgatttttcggatcatgtttatttcaaaatcatgatatgtgtcttcatcgtgtgttgtcacgataagatttacacgcttacgttttttgattgccatttccagacgtgcggttttcagaatattactggggtttgcttcccgccagtatttcgaattgcggtatgtgtctaaccgcttccacaaatcacgacattttccaacatacactatccgaccgtcgatttcaataaaatacacacaatgccggaattctccacatttaacaaaactccggtctatccttttgtctgaacccagacgcaaaggaaatattacaccaaatgttacatcgtccattatatatccaacttattcacctttccggtcaacacattgacgcagtgagcaatataatcaccgtggcacggtagaggtttgcatgtacatcctaaccgcttcccgtccaatgctttcagttcgtcgattgtgatcacgccagttcgaatcaagttttggaaatacgggatgaagttcattatgttttcagcccgtgttcccttgtagaagggattgccgaatttcgtacctctctgaatatcgacatcccagctacctttatacttgtttacgacgcgacaatcaagcgtatttttgtcgccattttgcataggcttcgtcgctgatctcggtgttgaggttgccaaccaggtaagaactcacttctacttcctgtggggctacctgtacgttgtcagacttcaaccatttgttcatccacggatacgggttcggcgttggtttaaatggagactgcaagccaaccgcgcgcatacgctgatctgtcaggtgttcgatataggcaatcgtacttttcagggatacgccgtctacatcaccgatagagaacaggtgttcagcccattctttttcctgttcgtacacttccaggaaaatctttgtcgcttcttcttcgtactggtaagcgatttccgccatttctgggtcatctttacccatctgccagagtcggatcttactttgagtgcctttctgatgaagtgcttcatcacgggcaatcagacgcatgatcttcgcgttaccttccatcttgccttgttcggcaaagttgaacgtgaaggtaaacgacacgtagaagcggatcgcttccagagcattgacagcgtgcatacacagatacagagcaaccttgcatttacgcatttgctctttgcgtttcttttcgtactctgcgatcgattcgtctgggtatccgtgggacgttaacatttcgattttgagcacaatgtttttcagttcatgacattctgcgatcagatcatcgtagtattttgtcatggaagccgaacgtttcatgatcgcttcgttgcgcagaattttatcgaactctttcgacgggtcgatgtgtaggttgcgctgaatgtgcgtataactgcggctatggattgtttcgctgaacgcccatgtttcgatccacgtttccattgagacatcggaagcgatagggaggaacgccaggttcgggccgcgtccctgaatggtatccagcagggtttgatattgcaggtttgaatcgaaaataaccttttcgtgttccggcattttcgcgtactgcatacggtcgatagacagatccacttcttccggtcgccagaagaatgacagttgtttttcagtcagggtttcgaatacacggtgtttctgttcttcgtatcgtgctacgcccgtatcctcaccaaagaacataggctgttctaagtgtttgtgatctgggtttgtgttcattacagttaacatggatttaccttataaaaagcccccgaaggggcattgaatcaaattttgcaaccttcgcaatcttccgcttcttcctcacctgcaccgtcgcgggtgttgtggtagtacagcgttttgatgccgaaatagtttgcatacagcagatcttcaaggatgatttcagatttcactttaccatctgggaagttagccggatcatagttggtgtttgcagagatagcctgatcaacaaacttctgcataaccgctacgtgcgacagataacctttgtttccacgttttgccattgtccagagataatcatagaagtcaatctgattattctggtttggtactacctgattgaatgaaccttctttcgaagatttcacactcacagggccgcgcggaggttcaatcccgttggttgagttactcacctgcgagctactttcacaaggcattaaagcagaaagtgttgagttacgcaagccgtgttttttaatttcaccgcgcaaccattcccaatcgcagttatacacaggtgatgccagttcatcaacgcttttgcagtaccagtcaataggcaacagcccttgtgcatatttcgtttcgtggaacagtccacatgcaccgcgttcctgtgcgagttccatagaggcaaccagcaggttaaattgaaacgcttccatcaactcatgaacgtttccggcgtatgcttcggagtagtcgcaatagttgcttgccagccatgatgcatagttggtgatacccacacccagagaacgacgctgtttggctttcagagccgccgcaacagggtagttctggtaatccagcaagttatccagtgcgcgtactgcgatgcgtgtaagggctgggaattcgcttatatcggcattatcgagaacgatcgccataagcgtacacagtccaatttcgccagccagtttatcatcgtcgtccagcggtgaagttgggatcgcgatttcacagcacaggttcgacatacgaaccggaacagagaaactaccctgctggtttacgtgatgactgttgaaaatgtatttgcgtccggtctgtgcgcgttcctgaacaagcaactggaacagatctaccgctttaatacgtttcttgcgtaccgttgggtctttttccagactggtatacagttcttcgaactcactctgatccgcttgatagaatgcgtcatagaggcgatcattcgcaacgtcagggctgaacagggtgatgtaatcgttattgattaaacgcttatacatcaaatcgttaagctgtacgccatagtcaaggtgacgaatacggttttcttcaacgccacggttatttttcagaaccagcaggttttcaacttcaagatgccagatcggataatacagggttgctgcaccaccacgaacaccaccctgtgaacaggatttaaccgccgtctgaatgtgtttccagaacgggataacgcctgtatggactgcttcaccaccacggatttttgaacccatagcgcgaatgtgtccggcgttgacaccgatacccgcacgttgagagatatacttcacgatcgcggacgtaacagcgttcagagaacccagagaatcaccggattcgattacaacacaactggagaactgacgcgtaggagtacgcacacccgccataataggcgtaggtaatgacagtttacgatccgaaattgcgttatagaagtcaattacatgactgattttatcagcgtgtttttcgtcctgatgcagacacatcgcgatcagcatgaatgcgtactgtggtgtttcgtagatgtcgccggacgtgcgatcctgtaacagatatttcccgatcaactgctgaacgccagcatacgagaattcaaaatctttatcgtgattgattttcgattccagataatcaatctccgctggagtccattttgtcaggatttctttatcgtattttccagcctcaaccagcttagtga
